United States Patent 11,931,406 (FLAVIVIRUS VACCINE) - sequence listing, part 55

SEQ ID NO: 19812 - RNA, 9876 nt, Artificial Sequence
  derived and/or modified CDS sequence (opt5) from DENV-2__EU482757__SS-prME
acagccggagugaucgucaugcugauucccacggcuauggccuuccaccucacgacccggaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaaggugcgcccuacauuugccgcgggccuucugcucagaaaacugaccucuaaggagcucaugauggcuacaauugggaucgcccugcuuagccaguccaccauucccgaaaccauccuggagcucacagaugcccuggcucugggaaugaugguccuuaaaaucgugcggaacauggaaaaguaccaacuggccguuacgauuauggcgaucucuugcgugccuaaugcugucauucuccagaacgccuggaaggugagcuguaccauccuggccgcuguguccgucagcccccuccugcuuacaucuucccagcagaaagccgacuggauuccucuggcucucaccaucaagggccugaaucccacagccaucuuccugaccacgcuuagccgcacaucuaaaaagagauccuggccgcugaacgaggcgauuauggccguugggauggugagcauccucgcuucuucccugcucaaaaaugacauuccuaugaccggaccccugguggccggcggccuucugaccgucugcuaugugcugacagggcggagcgcugaucucgaacuggagcgcgccgccgacguuaagugggaggaucaagcugaaaucuccggaagcucuccuauucuuagcaucaccauuuccgaggacggcucuaugagcaucaaaaacgaagaggaggaacagacacugacgauccucauuagaaccgggcugcucgugaucuccggagucuuucccgugucuauuccgaucacagcggccgcuugguaccugugggagguuaagaagcagcgggccggcgugcuuugggaugucccuucucccccucccguggaaaaagccgagcuggaagacggggcuuaucgcauuaagcagagaggaauccugggcuacucccaaaucggcgccggggucuauaaagagggaaccuuccacacaauguggcaugugacccggggcgcgguucucaugcaccgcgggaagagaauugagcccuccugggcugaugugaaaaaggaccugaucagcuacggaggcggguggaaacuugaaggagaguggaaagaaggcgaggaaguccaggugcuggcccucgagccuggcaagaauccgcgggccguucagacgaaacccgggauuuuuaagaccaacacaggaaccaucggcgcugugucccuggauuucagcccugggacaucuggaucccccauugucgacagaaaaggcaaggugguggggcucuacggaaauggcguugucacccgcagcggcgccuaugugucugcgaucgcucagacagagaaguccaucgaagauaacccugagauugaagacgauaucuuucggaaaaagagacugacgauuauggaccuucaucccggggccggaaaaaccaagcgcuaccugccugccaucgugcgggaggcuauuaaaagaggccugcgcacacucauccuggccccgacccgggucguggcugccgaaauggaggaggcgcuuagagggcugcccauucgcuaucaaaccccugccaucaagacagaacacacgggacgggagaucguugaccucaugugucaugcuaccuucacaaugagacugcucagccccgugcgggucccuaacuacaaucugauuaucauggaugaagcccacuucaccgaccccgcuuccauugccgcccgcggcuauaucucuacaagaguggagaugggggaggcugcgggcauuuuuaugaccgccacgccgccuggaagccgggaucccuucccccaguccaacgcuccuaucauggacgaagagagagaaauccccgagagaagcuggaacucuggccacgaauggguuacagauuuuaaggggaaaaccgugugguucgucccuuccauuaaggccggaaacgacaucgccgcuugccuucggaaaaauggcaagaaagugauucagcugagcagaaagaccuuugauucugaguacguuaagacacgcgccaacgacugggauuucguggucaccacagacaucagcgagaugggggcgaauuuuaaagcugaacgggugauugauccgagacgcuguaugaagcccgugauccugaccgacggagaggaacgggucauccucgccggcccuaugcccguuacgcauuccucugccgcucaaagacgcgggcggauuggcagaaacccuaaaaaugagaacgaccaguauaucuacaugggagaaccccuggagaaugaugaggacugcgcccacuggaaggaagcgaaaaugcuucuggauaacauuaauacaccggagggcaucauuccuagcauguucgaacccgagcgcgaaaagguggacgccaucgauggggaguacagacuccggggagaggcucgcaaaaccuuuguggaccugaugagacggggcgaucugccugucuggcucgccuauaagguggcugccgaagggauuaacuacgcugaccgcaagugguguuucgauggaaucaaaaauaaccagauccuugaggaaaacauggagguugagauuuggacaaaggaaggcgagcgcaagaagcugaaaccccgguggcuggacgccagaaucuauuccgauccucucgcgcugaaggaauuuaaggaguucgccgcugggcgcaaaucucuuacccugaaucucauuacggaaaugggccggcugcccaccuucaugacacagaaggccagaaacgcucuggacaaucucgccgugcuucauaccgccgaggcuggaggccgcgcguacaaccacgcccugagcgagcugccggaaacacucgagacccugcuucugcucacacugcuggcuaccgucacagggggaaucuuucucuuccuuauguccggcaaagggauuggaaagaugacacugggcaugugcugcaucaucaccgccagcauucugcucugguaugcccaaauccagccucacuggauugcugccucuaucauucuggaauuuuuccuuaucgugcugcucauccccgagcccgaaaaacagcggaccccucaggauaaucaacugacauacguugugauugcgauccugaccgucguggccgcuacaauggccaacgagaugggcuuucucgagaagacgaagaaagaccuugggcugggauccauuaccacacaggaaagcgaguccaauauccuggacauugaucucagaccggcuucugccuggacccuguaugcggucgccacaaccuucgugacgcccaugcuucggcauagcaucgaaaacuccucuguuaaugugagccugaccgcuauugccaaccaggcuacagugcucaugggccuggggaagggauggccucuguccaaaauggacaucggcgucccccuccuugccaucggguguuacagccagguuaauccuauuacccugacagcugcccugcuccugcuuguggcgcacuacgccaucauuggacccggccugcaagcuaaggccacccgcgaggcucagaaaagagccgccgcgggcaucaugaagaacccuacgguggaugggauuacagucaucgaccucgaaccgauccccuaugauccuaaguuugagaaacagcugggacaggugaugcugcucauucuuugcguuacccaagugcugaugaugcggacaaccugggcucugugugaggcccucacccuggcuacaggccccaucucuacgcuuugggaagggaauccuggacgcuucuggaacaccacaauugccgucuccauggccaauaucuuuagaggcagcuaccuggcuggggccggacuccuguucucuauuaugaagaacaccacauccacccggcgcggcacgggcaauaucggggagacacugggagaaaaauggaaaagcagacucaacgcgcuuggcaaaucugaguuucagaucuauaagaaaagcgggauucaggagguggaccggacccuggccaaggaaggaaucaagcgcggcgagaccgaucaucacgcugucuccagagggucugccaaacugcggugguucguggaaagaaacaugguuacacccgagggaaagguggucgaccucggcugcggccgcgggggauggagcuacuauuguggcgggcugaaaaaugugcgggaaguuaagggacuuaccaaaggcgggccgggacaugaggagccuauucccauguccacauacggcuggaaccuggugagacuccaaagcggcgucgauguguuuuucacgcccccugaaaagugcgacacccugcugugugauaucggggaguccucucccaauccuacaauugaagcuggacgcacccuccgggugcuuaaccugguugagaauuggcugaacaauaacacacaguucugcaucaagguccucaauccguauaugcccagcgugaucgagaagauggaggcccugcagagaaaguacggcggggcgcuugugcgcaacccucuguccagaaauucuacccacgagauguacugggucagcaacgccacgggaaauauuguuuccucugugaacaugaucagcagaaugcucauuaaucgcuuuaccaugaaacacaagaaagcuacauaugaacccgacguggaucugggcuccgggacccggaacaucggaauugagagcgaaaucccuaaccuggacauuaucggcaagagaaucgagaagauuaaacaggaacaugagacaucuuggcacuacgaccaagaucaucccuauaagaccugggccuaccacggcuccuaugagacaaaacagaccgggagcgcuucuuccauggucaauggagugguucgccuccuuacgaagccgugggacguggucccuauggugacacagauggccaugaccgauaccacacccuucggccagcaacggguuuuuaaagaaaagguggacacgagaacccaggagccuaaggaagggaccaagaagcugaugaaaaucaccgcugaguggcuguggaaggagcucggcaagaagaaaacaccccgcauguguaccagagaagaguucacacggaagguccgcagcaacgccgcgcugggcgccauuuuuaccgaugaaaauaaguggaaaucugcuagagaggccguggaagacgggcgguucugggagcuuguggauagagagcggaaccugcaccucgaaggaaagugcgagacgugugucuacaauaugaugggcaaacgcgaaaagaaacugggcgaguuugggaaggcuaagggauccagagccaucugguauauguggcugggcgcccgguuccucgaauuugaggcgcugggguuccuuaacgaggaccauugguuuagccgcggaaauucccugagcggcguugaaggggagggccuccacagacugggauacauucuucgggaugugucuaaaaaggaaggcggggcuauguacgccgacgauaccgccggaugggacacacgcaucacccuggaggaccucaaaaacgaagagauggugacaaaucauaugaagggcgagcacaaaaagcuggcugaagccaucuucaagcugaccuaucagaacaaagucgugagaguucagcggccuacgccccgcgggacagugauggauauuaucagcagacgggaccaacgcggauccggccaggucgggaccuacggccucaauacauuuaccaacauggaggcucagcugauuagacaaauggaaggagagggcaucuucaagucuauucagcaucuuacggccaccgaggaaaucgugguucagaauuggcuggcgcggguggggcgcgagagacucagccggauggccaucuccggagaugacugcgucgugaaaccgauugaugacagauucgcuucugcccugacagcucuuaacgauaugggcaagguucgcaaagacauccagcaaugggaaccuagccggggguggaaugauuggacccaggugcccuuuugcucccaccacuuccaugagcuggucaugaaggacggaagagugcucgucgugcccugucgcaaccaggaugaacugauuggccgggccagaaucucucagggggcgggcuggagccugaaggagacagccugccucggaaaauccuaugcucaaauguggacccugauguacuuucaccgccgggaccuuagacuggccgcuaacgccauuuguagcgcuguuccuucucauugggugccgacaucccgcaccacguggagcauccacgccaagcacgaguggaugacaaccgaagauaugcucgcggucuggaaucggguguggauucaggagaaccccuggauggaagacaaaaccccuguggagucuugggaagagguucccuaucugggcaagagagaggaccaguggugcgggucccuuaucggacugacaagccgcgccaccugggcuaaaaauauccagacagccauuaaccaagugcggucccucaucggcaaugaagaguacacggauuauaugccuucuaugaagagauuccggagagaagaggaagaggccgggguccugugguga

SEQ ID NO: 19813 - RNA, 9876 nt, Artificial Sequence
  derived and/or modified CDS sequence (opt5) from DENV-2__FJ906956__SS-prME
accgccggcgugaucgucaugcugauucccacagcuauggccuuccaccucacgacccggaauggggagccucauaugaucguuggaaagcaggaaaagggcaagagccugcuuuuuaagacagaggacggggugaauaugugcacccugauggcgauugaucucggagaacugugugaggacacaaucaccuacaagugcccgcuucugcggcaaaaugaacccgaggauauugacuguuggugcaauuccacaucuaccugggugacguauggcaccuguacaaccacaggggagcaccgcagagaaaagcggagcgucgcucucgugccucauguuggaaugggccuggagacccgcacggaaacauggauguccucugagggcgccuggaagcacgugcagagaaucgagaccuggauccugcggcaucccggguucacaauuauggccgcuauccucgccuacaccauuggaaccacacacuuucagcgcgcucugaucuucauucuucugacggccgucgcgccuagcaugaccaugagaugcaucggcauuuccaaccgggauuuuguggaagggguuucuggaggcagcuggguggacaucguccucgagcacggguccugugugacaaccauggccaagaauaagcccacacuggauuucgaacuuaucaagaccgaggcuaaacagccugccacgcugcgcaaguauugcauugaagcuaaacucacaaacaccaccacagagagcagauguccgacccaaggagagcccucucugaaugaagaacaggacaagcgguuuaucugcaagcauuccaugguggaucgcggcuggggcaacggguguggacuguucggcaaagggggaauugucacaugcgccauguuuacgugcaagaaaaauauggaaggcaagguugugcagccugagaaccucgaauacaccaucgugauuacaccccacagcggggaggagcaugcggucggaaaugacaccggcaaacacggcaaggaaaucaaaaucacaccucagucuuccauuaccgaggccgaacugacgggguauggaaccgugacaauggaguguagccccagaaccggccuugauuucaacgaaaugguucugcuccaaauggaggacaaggcuuggcuggugcaccggcagugguuucuugaucugccgcucccuuggcugcccggggccgacacacagggaucuaauuggauccagaaggagacccuggucacguucaaaaacccucaugcuaagaaacaagacgugguugugcucggcucccaggaaggggccaugcacacagcccugaccggcgcuacagagauucagaugagcuccggaaaucuucuguuuaccggccaucucaagugccgccugagaauggauaaacuucaacugaaggggaugucuuacagcauguguaccggaaaguucaaaaucgucaaggaaauugcggagacacagcacggcacgaucgugauccggguccaguaugagggggacggaucccccugcaaaauucccuucgaaaucaccgaucucgagaagagacaugugcugggccgccugauuacaguuaacccuaucgugaccgggaaagacagcccggucaacauugaagccgagcccccuuuuggcgauucuuacaucauuaucggaguggaacccggccagcucaagcugaauugguucaagaaaggguccagcaucggacaaauguuugagacaaccaugcggggcgcuaagagaauggccauucuuggggacacggccugggauuucggaucucugggcgggguuuuuacaagcaucggcaaagcucuccaccagguguucggagccauuuacggcgcggcuuuuuccggggucucuuggaccaugaagauccugauuggagugaucaucaccuggauuggcaugaacagccgcuccacaagccugucugugucccuuguucucgucgggguggugacccuguaucugggagccaugguccaggccgacagcggcugugugguuucuuggaaaaauaaggagcucaagugcggguccggcaucuucauuacagauaacgugcacacguggaccgaacaguacaaauuucaaccugagagccccuccaagcuggcuucugccauccagaaagcucaugaagagggaauuuguggcauccggagcgucacaagacuugaaaaucugauguggaagcagaucaccccggagcucaaccacauucuguccgagaaugaagugaaacugacaaucaugaccggggacauucgcggaaucaugcaggccggcaagcggucucuuagaccucaacccacggagcucaaauauagcuggaagaccugggggaaggcgaaaaugcuguccacagaaagccauaaccagaccuuccugauugauggaccugagacagccgaaugccccaauaccaaccgcgcuuggaacucucucgagguugaggacuacggcuuuggcguguucacaaccaacaucuggcugaaacuucgggaaaaacaggacgucuuuugugauuccaagcugaugagcgccgcuaucaaagacaauagagccgugcacgcggauaugggguauuggauugagucugcccucaacgacacguggaagauggaaaaggcuuccuucaucgagguuaaaagcugccacuggccuaagucucauacacuguggagcaauggagugcuggaguccgaaauggucauucccaaaaacuucgccggcccggugagccagcacaacuaccgcccuggguaucauacccaaaccgcuggacccuggcaccuuggcaagcucgagauggauuuugaccugugugaagggacaaccguggucguuacggaggauugcggaaaucggggccccucucugagaacaaccacagccuccggcaaacucaucaccgaauggugcugucggagcugcacacugccuccgcuucgcuacagaggggaggacggauguugguacggcauggagauucggccccugaaggaaaaggaggaaaaccucgugaauagccuggugaccgccgggcauggacagaucgauaacuucucucugggcguccuugggauggcucucuuucuggaggaaaugcugagaacgcgcauuggaaccaaacacgcgauccuccugguggccguuagcuucgugacacuuaucaccggcaauauguccuuucgggaccugggcagagucauggugaugguuggggcuacaaugaccgaugacauuggaaugggcgugacguaucucgcccugcuggccgcuuucaagguccgcccuacauuugccgcggggcuucugcucagaaaacugaccucuaaggagcucaugauggcuacaaucggaauugcccugcuuagccaguccaccauccccgagaccauucuggaacucacagaugcccuggcucugggcaugauggugcuuaaaaucguucggaacauggagaaguaccaacuggccgugacgaucauggcgauuucuugcgucccuaaugcugugauccuccagaacgccuggaaggugagcuguaccauucuggccgcugucuccguuagcccccuccugcuuacaucuucccagcagaaagccgacuggaucccucuggcucucaccauuaaggggcugaaucccacagccaucuuccugaccacgcuuagccgcacaucuaaaaagagauccuggccgcugaacgaagcgaucauggccgugggaauggugagcauucucgcuucuucccugcucaaaaaugacaucccuaugaccggcccccuggucgccggcgggcuucugaccgugugcuauguucugacaggacggagcgcugaucucgagcuggaacgcgccgccgacgugaagugggaggaucaagcugagauuuccggcagcucuccuauccuuagcauuaccaucuccgaagacgggucuaugagcauuaaaaacgaggaagaggagcagacacugacgauccucaucagaaccggacugcucgucauuuccggcguguuucccguuucuaucccgauuacagcggccgcuugguaccugugggaagugaagaagcagcgggccgggguccuuugggaugugccuucucccccucccgucgagaaagccgaacuggaggacggagcuuaucgcaucaagcagagaggcauucugggcuacucccaaaucggggccggaguguauaaagaaggcaccuuccacacaauguggcauguuaccagaggggcggugcucaugcaccgcggaaagagaaucgagcccuccugggcugaugucaaaaaggaccugauuagcuacggcgggggauggaaacuugagggcgaauggaaagagggcgaagaggugcagguucuggcccucgaaccugggaagaauccgcgggccgugcagacgaaacccggaaucuuuaagaccaacacaggcaccauuggggcugucucccuggauuucagcccuggaacaucuggcucccccaucguggacagaaaagggaaggugguuggacucuacggcaauggcgucgugacccgcagcggggccuaugugucugcgauugcucagacagagaaguccaucgaggauaacccugaaaucgaggacgauauuuuucggaaaaagagacugacgaucauggaccuucaucccggagccggcaaaaccaagcgcuaccugccugccauuguccgggaagcuaucaaaagagggcugcgcacacucauucuggccccgacccgggugguugcugccgagauggaagaggcgcuuagaggacugcccauccgcuaucaaaccacagccauuaagacggagcacaccggccgggaaaucguggaccucaugugucaugcuacauucaccaugagacugcucagcccuguccgggugcccaacuacaaucugaucauuauggaugaggcccacuucacagacccugcuuccaucgccgcccgcggguauauuucuaccagaguugaaaugggcgaggcugcgggaaucuuuaugacggccacacccccgggcagccgggauccuuucccccaguccaacgcucccauuauggacgaggaacgcgagaucccugaaagaagcuggaacucugggcacgagugggugaccgauuuuaagggaaaaaccgucugguucgugcccuccaucaaggccggcaacgacauugccgcuugccuucggaaaaaugggaagagaguuauccagcugagccgcaaaacauuugauucugaauacgugaagacccgggccaacgacugggauuucgucgugacaaccgacauuagcgagaugggagcgaauuuuaaggcugagagagugaucgauccucgccgguguaugaaaccggucauucugacggacggcgaagagagaguuauccucgccgggcccaugccugugacacauuccucugccgcucaacgccggggcagaaucggacgcaaccccaagaaugaaaacgaccaguauauuuacaugggcgagccucuggaaaaugaugaggacugcgcccacuggaaagaggcgaagaugcuucuggauaacaucaauacccccgaagggauuaucccgagcauguucgagccugaaagagagaaaguggacgccauugauggagaauaccggcuccgcggcgaggcuagaaagacauuugucgaccugaugcggcgcggggaucugcccguguggcucgccuauaaaguugcugccgagggaaucaacuacgcugacagaaagugguguuucgauggcauuaagaauaaccagauccuugaagagaacauggaaguggagaucuggaccaaagagggggaacggaagaaacugaagccuagauggcuggacgcccgcauuuauuccgauccccucgcgcugaaagaguuuaaggaguucgccgcuggccggaagucucuuacgcugaaucucaucaccgagaugggaagacugccuacauucaugacccagaaagcccgcaacgcucuggacaaucucgccguccuucauacagccgaagcuggcgggcgggcguacaaccacgcccugagcgagcugcccgagacccucgaaacacugcuucugcucacccugcuggcuacggugacaggaggcauuuuucucuuccuuauguccgggaagggaaucggcaaaaugacccugggcaugugcugcauuaucaccgccagcauccugcucugguaugcccaaauucagccgcacuggaucgcugccucuauuauccuggaguuuuuccuuauuguucugcucaucccugaacccgagaagcagagaacaccccaggauaaucaacugaccuacguggucaucgcgauucugacaguggucgccgcuacgauggccaacgaaaugggguuucucgagaaaaccaagaaggaccuuggacugggcuccaucacaacccaggagagcgaauccaauauucuggacaucgaucuccggccugcuucugccuggacacuguaugcgguggccaccacguucguuaccccgaugcuucgccauagcauugagaacuccucugugaaugugagccugacagcuaucgccaaccaggcuaccguccucauggggcugggaaaaggcuggccccuguccaagauggacauugggguuccucuccuugccaucggauguuacagccaggugaaucccaucacacugaccgcugcccugcuccugcuuguggcgcacuacgccauuaucggcccuggccugcaagcuaaagccacgagagaagcucagaagcgggccgccgcggggauuaugaaaaaccccacagucgauggaaucaccgugauugaccucgagccuaucccguaugaucccaaguuugaaaagcagcugggccagguuaugcugcucauccuuugcgugacacaaguccugaugaugcgcaccaccugggcucugugugaggcccucacacuggcuacggggccuauuucuacccuuugggagggaaaucccggcagauucuggaacacaaccaucgccguguccauggccaauauuuuucgggggagcuaccuggcuggagccggccuccuguucucuaucaugaaaaacacaaccaauacgcgcagaggcacagggaacauuggagaaacccugggcgagaaguggaaaucccggcucaacgcgcuuggaaagagcgaauuucagaucuauaaaaagucuggaauccaggaggucgaccgcacccuggccaaagagggcauuaagagaggggaaacagaucaucacgcugugagccggggauccgccaagcugagaugguucguugagcgcaauauggugaccccugaaggcaaagucguggaccucggcugcgggcggggaggcuggucuuacuauugugggggacugaagaacguuagagaggugaaaggccuuacaaaaggcgggcccgggcaugaagaaccgaucccuaugagcacguacggcuggaaucugguccgccuccaauccgggguggauguguuuuucaccccucccgagaaaugcgacacacugcugugugauauuggagaaagcucccccaaccccaccaucgaggcuggccggacacucagaguucuuaaucuggucgaaaacuggcugaauaacaauacccaguucugcauuaaggugcucaacccuuauaugccgucugugaucgagaagauggaagcccugcagcgcaaauacgggggagcgcuuguccggaauccccugagcagaaacuccacgcacgagauguacuggguuucuaaugccaccggcaacaucgugagcuccgugaauaugauuucucgcaugcucaucaaccgguuuacaaugaagcacaaaaaggcuaccuaugagccugacgucgaucuggggagcggaacaagaaacauuggcaucgaauccgagauucccaaucuggacaucauuggcaaacgcaucgaaaagaucaagcaggagcaugaaaccagcuggcacuacgaccaagaucauccuuauaaaacaugggccuaccacgggucuuaugagaccaagcagacgggauccgcuagcucuauggugaacggcguugugcggcuccuuacaaaacccugggacgucgugccgaugguuacccagauggccaugaccgauacaacgccuuucgggcagcaaagaguguuuaaggagaaagucgacacccgcacacaggaacccaaggagggaaccaagaaacugaugaagauuacagcugaauggcuguggaaagagcucggcaagaaaaagaccccuagaauguguacacgggaggaguucacccgcaaagugagauccaaugccgcgcugggggccaucuuuacggaugagaacaaguggaaaagcgcucgggaagccguggaggacggaagauucugggaacuugucgaucgggagcgcaaucugcaccucgagggcaaaugcgaaaccuguguuuacaacaugaugggcaagagagagaaaaagcugggggaauuuggaaaagcuaagggcucucgggccauuugguauauguggcugggggcccgcuuccucgaguuugaagcgcugggauuccuuaaugaggaccauugguuuuccagaggcaacagccuguccgggguggagggcgaaggacuccaccggcugggcuacauccuucgcgauguggggaagaaagagggaggcgcuauguacgccgacgauacagccgggugggacaccagaauuacacuggaagaccucaagaaugaggaaauggucaccaaccauaugaaaggagagcacaagaaacuggcugaggccaucuucaagcugacguaucagaauaaggugguucgggugcagcgccccacaccuagaggcaccgucauggauaucauuagccggcgcgaccaaagagggucuggccaggugggaacauacggccucaacaccuuuacgaauauggaagcucagcugauccggcaaauggagggggaaggaauuuucaaaagcauccagcaucuuaccgccacagaggagauugcgguucagaacuggcuggcccgcgugggcagagaacggcucuccagaauggcuaucucuggggaugacugcgucgugaagcccaucgaugaccgcuucgccagcgcucugaccgcccuuaaugauaugggaaaaguucggaaggacauucagcaaugggagccguccagaggcuggaacgauuggacacaggugccuuuuugcucucaccacuuccaugaacuggucaugaaagacgggcgcgugcucgucgugcccugucggaaccaggaugagcugaucggcagagcgcgcauuagccagggagccggcuggucccugaaggaaaccgcuugccucgggaagucuuaugcccaaauguggacacugauguacuuucaccggagagaccuucgccuggcugccaaugcuaucuguagcgccguucccucccauugggugccuaccagccggacgacauggucuauucacgcgaaccacgaguggaugaccaccgaggauaugcucgccgucuggaauagaguguggauccaggaaaacccguggauggaggacaaaacacccguggaauccugggaggaaguuccuuaucugggaaagcgcgaggaccaguggugcggcagccuuauugggcugaccucucgggcuacaugggccaaaaauauccagacggccaucaaccaagugagaucccucauuggaaaugaggaauacaccgauuauaugcccagcaugaagcgguucagacgcgaggaagaggaagcuggcguccugugguga

SEQ ID NO: 19814 - RNA, 9876 nt, Artificial Sequence
  derived and/or modified CDS sequence (opt5) from DENV-2__EU482759__SS-prME
accgccggagugaucgucaugcugauucccacagcuauggccuuccaccucacgaccagaaauggggagccucauaugaucguuggacggcaggaaaagggcaagagccugcuuuuuaagaccgaggacggggugaauaugugcacccugauggcgauugaucucggagaacugugugaggacacaaucaccuacaagugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaagaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuaugugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaaccuuccacacaauguggcaugugacccgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuacggaaauggcguugucacccggagcggcgccuaugugucugcgaucgcucagacagagaaguccaucgaagauaacccugagauugaagacgauaucuuuagaaagaaacgccugacgauuauggaccuucaucccggggccggaaagaccaaacgguaccugccugccaucgugagaggcgcuauuaagcgcgggcugcggacacucauccuggccccgaccagagucguggcugccgagauggaagaggcgcuucgcggacugcccauucgguaucaaaccacagccaucaaaacggagcacaccggcagagaaaucguugaccucaugugucaugcuacauucaccaugcggcugcucagcccugugcgcguccccaacuacaaucugauuaucauggaugaggcccacuucacagacccugcuuccauugccgccagaggguauaucucuacccggguggaaaugggcgaggcugcgggaauuuuuaugacggccacacccccgggcagccgcgauccuuucccccaguccaacgcucccaucauggacgaggaaagagagaucccugaacggagcuggaacucugggcacgaguggguuaccgauuuuaagggaaagaccgugugguucguccccuccauuaaagccggcaacgacaucgccgcuugccuuagaaagaaugggaaaaaggugauucagcugagccgcaaaacauuugauucugaauacguuaagacccgggccaacgacugggauuucguggucacaaccgacaucagcgagaugggagcgaauuuuaaggcugagagagugauugauccucgccgguguaugaaaccggugauccugacggacggcgaagagagagucauccucgccgggcccaugccuguuacacauuccucugccgcucaacgccggggcagaauuggacgcaaccccaagaaugaaaacgaccaguauaucuacaugggcgagccucuggaaaaugaugaggacugcgcccacuggaaagaggcgaagaugcuucuggauaacauuaauacccccgaagggaucauuccgagcauguucgagccugaaagagagaaaguggacgccaucgauggagaauaccggcuccgcggcgaggcuagaaagacauuuguggaccugaugcggcgcggggaucugcccgucuggcucgccuauaaaguggcugccgagggaauuaacuacgcugacagaaagugguguuucgauggcaucaagaauaaccagauccuugaagagaacauggaaguugagauuuggaccaaagagggggaacggaagaaacugaagccuagauggcuggacgcccgcaucuauuccgauccccucgcgcugaaagaguuuaaggaguucgccgcuggccggaagucucuuacgcugaaucucauuaccgagaugggaagacugccuacauucaugacccagaaagcccgcaacgcucuggacaaucucgccgugcuucauacagccgaagcuggcgggcgggcguacaaccacgcccugagcgagcugcccgagacccucgaaacacugcuucugcucacccugcuggcuacggucacaggaggcaucuuucucuuccuuauguccgggaagggaauuggcaaaaugacccugggcaugugcugcaucaucaccgccagcauucugcucugguaugcccaaauccagccgcacuggauugcugccucuaucauucuggaguuuuuccuuaucgugcugcucaucccugaacccgagaagcagagaacaccccaggauaaucaacugaccuacguugugauugcgauccugacagucguggccgcuacgauggccaacgaaaugggguuucucgagaaaaccaagaaggaccuuggacugggcuccauuacaacccaggagagcgaauccaauauccuggacauugaucuccggccugcuucugccuggacacuguaugcggucgccaccacguucgugaccccgaugcuucgccauagcaucgagaacuccucuguuaaugugagccugacagcuauugccaaccaggcuaccgugcucauggggcugggaaaaggcuggccccuguccaagauggacaucggggucccucuccuugccaucggauguuacagccagguuaaucccauuacacugaccgcugcccugcuccugcuuguggcgcacuacgccaucauuggcccuggccugcaagcuaaagccacgagagaagcucagaagcgggccgccgcggggaucaugaaaaaccccacaguggauggaauuaccgucaucgaccucgagccuaucccguaugaucccaaguuugaaaagcagcugggccaggugaugcugcucauucuuugcguuacacaagugcugaugaugcgcaccaccugggcucugugugaggcccucacacuggcuacggggccuaucucuacccuuugggagggaaaucccggcagauucuggaacacaaccauugccgucuccauggccaauaucuuucgggggagcuaccuggcuggagccggccuccuguucucuauuaugaaaaacacaaccaauacgcgcagaggcacagggaacaucggagaaacccugggcgagaaguggaaaucccggcucaacgcgcuuggaaagagcgaauuucagaucuauaaaaagucuggcauucaggagguggaccgcacccuggccaaagagggcaucaagagaggggaaacagaucaucacgcugucagccggggauccgccaagcugagaugguucguggagcgcaauaugguuaccccugaaggcaaaguggucgaccucggcugcgggcggggaggcuggucuuacuauugugggggacugaagaacgugagagagguuaaaggccuuacaaaagggggacccggccaugaagaacccauuccuaugagcacguacggcuggaaucuggugcgccuccaauccggggucgauguguuuuucacaccgcccgagaaaugcgacacacugcugugugauaucggagaaagcuccccuaaccccaccauugaggcuggccggacacucagagugcuuaaucugguugaaaacuggcugaauaacaauacccaguucugcaucaagguccucaacccuuauaugccgucugugaucgagaagauggaagcccugcagcgcaaauacgggggagcgcuugugcggaauccccugagcagaaacuccacgcacgagauguacugggucucuaaugccaccggcaacauuguuagcuccgugaauaugaucucucgcaugcucauuaaccgguuuacaaugaagcacaaaaaggcuaccuaugagccugacguggaucuggggagcggaacaagaaacaucggcauugaauccgagauccccaaucuggacauuaucggcaaacgcaucgaaaagauuaagcaggagcaugaaaccagcuggcacuacgaccaagaucauccuuauaaaacaugggccuaccacgggucuuaugagaccaagcagacgggauccgcuagcucuauggucaacggcgugguucggcuccuuacaaaacccugggacguggucccgauggugacccagauggccaugaccgauacaacgccuuucgggcagcaaagaguuuuuaaggagaaaguggacacccgcacacaggaacccaaggagggaaccaagaaacugaugaagaucacagcugaauggcuguggaaagagcucggcaagaaaaagaccccuagaauguguacacgggaggaguucacccgcaaagucagauccaaugccgcgcugggggccauuuuuacggaugagaacaaguggaaaagcgcucgggaagccguggaggacggaagauucugggaacuuguggaucgggagcgcaaucugcaccucgagggcaaaugcgaaaccugugucuacaacaugaugggcaagagagagaaaaagcugggggaauuuggaaaagcuaagggcucucgggccaucugguauauguggcugggggcccgcuuccucgaguuugaagcgcugggauuccuuaaugaggaccauugguuuuccagaggcaacagccuguccgggguugagggcgaaggacuccaccggcugggcuacauucuucgcgauguggggaagaaagagggaggcgcuauguacgccgacgauacagccgggugggacaccagaaucacacuggaagaccucaagaaugaggaaauggugaccaaccauaugaaaggagagcacaagaaacuggcugaggccaucuucaagcugacguaucagaauaaggucgugcggguucagcgccccacaccuagaggcaccgugauggauauuaucagccggcgcgaccaaagagggucuggccaggucggaacauacggccucaacaccuuuacgaauauggaagcucagcugauucggcaaauggagggggaaggaaucuucaaaagcauucagcaucuuaccgccacagaggagaucgcggugcagaacuggcuggcccgcguuggcagagaacggcucuccagaauggcuaucucuggggaugacugcguggucaagcccauugaugaccgcuucgccagcgcucugaccgcccuuaaugauaugggaaaagugcggaaggacauccagcaaugggagccguccagaggcuggaacgauuggacacagguuccuuuuugcucucaccacuuccaugaacuggugaugaaagacgggcgcguccucgugguccccugucggaaccaggaugagcugauuggcagagcgcgcaucagccagggagccggcuggucccugaaggaaaccgcuugccucgggaagucuuaugcccaaauguggacacugauguacuuucaccggagagaccuucgccuggcugccaaugcuauuuguagcgccgugcccucccauuggguuccuaccagccggacgacauggucuauccacgcgaaacacgaguggaugaccaccgaggauaugcucgccguguggaacagagucuggauucaggaaaauccguggauggaggacaagacacccguggaauccugggaggaagugccuuaucugggaaaacgcgaggaccaguggugcggcagccuuaucgggcugaccucucgggcuacaugggccaagaacauccagacggccauuaaucaaguuagaucccucaucggaaacgaggaauacaccgauuauaugcccagcaugaaacgguucagacgcgaggaagaggaagcuggcgugcugugguga

SEQ ID NO: 19815 - RNA, 9876 nt, Artificial Sequence
  derived and/or modified CDS sequence (opt5) from DENV-2__EU482760__SS-prME
accgccggcgucaucgucaugcugauucccaccgcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacgaucaccuacaagugcccccuucugcgccaaaaugaacccgaggauauugacuguuggugcaauagcacaucuaccugggugacguauggcaccugugcuacaaccggggagcacagacgggaaaagcgcagcgucgcccucgugccucauguuggaaugggccuggagacaagaaccgaaacguggauguccucugagggcgccuggaagcacgugcagcggaucgagacauggauccugcgccaucccggguucaccauuauggcugccauccucgcuuacacaauuggaaccacccacuuucagagagcccugaucuucauucuucugacagcggucgccccuagcaugacgaugcggugcaucggcauuuccaaccgcgauuuuguggaagggguuucuggaggcagcuggguggacaucguccucgagcacggguccugugugaccacaauggcuaagaauaagcccacccuggauuucgaacuuaucaaaacagaggccaagcagccugcuacccugagaaaauauugcauugaagccaagcucacgaacacaaccaccgagagccgguguccgacacaaggagagcccucucugaaugaggaacaggacaaacgcuuuaucugcaagcauuccaugguggauagaggcuggggcaacggguguggacuguucggcaaagggggaauugugaccugcgcgauguuuacaugcaaaaagaauauggaaggcaaaguugugcagccugagaaccucgaauacacgaucgugauuacaccccacagcggggaggagcaugccgucggaaaugacacaggcaagcacggcaaagaaaucaagaucaccccucagucuuccauuacagaggcugaacugaccggguauggaacggugaccauggaguguagcccccggacaggccuugauuucaacgaaaugguucugcuccaaauggaggacaaagccuggcuggugcaccgccagugguuucuugaucugccgcucccuuggcugcccggggcugacacccagggaucuaauuggauccagaaggagacacuggucaccuucaagaacccucaugccaaaaagcaagacgugguugugcucggcucccaggaaggggccaugcacacggcucugacaggcgcgaccgagauucagaugagcuccggaaaucuucuguuuacaggccaucucaaaugcagacugcggauggauaaacuucaacugaaagggaugucuuacagcauguguaccggaaaguucaagaucgucaaagaaauugccgagacccagcacggcacaaucgugaucagaguccaguaugagggggacggaucccccugcaagauucccuucgaaaucacggaucucgagaaacgccaugugcugggccggcugauuaccguuaacccuaucgugacagaaaaggacagcccggucaacauugaggcugaacccccuuuuggggauucuuacaucauuaucggcguggagcccggacagcucaaacugaauugguucaagaagggcuccagcaucgggcaaauguuugagaccacaaugagaggagccaaacgcauggccauucuuggcgacaccgcuugggauuucgggucucugggaggcguuuuuacgagcaucgggaaggcccuccaccagguguucggcgcgauuuacggagcugccuuuuccggcgucucuuggacaaugaaaauccugauuggggugaucaucaccuggauuggaaugaacagccgguccaccagccugucugugucccuuguucucgucggcguggugacacuguaucugggggccaugguccaggcugacagcggaugugugguuucuuggaagaauaaagaacucaagugcggcuccgggaucuucauuaccgauaacgugcacacauggacggagcaguacaaguuucaaccugaaagccccuccaaacuggccucugcuauccagaaggcccaugaggaaggcauuuguggaaucagaagcgucacccgccuugagaaucugauguggaaacagaucacaccggagcucaaccacauucuguccgaaaaugaggugaagcugaccaucaugacaggcgacauucgggggaucaugcaggcgggaaaaagaucucuucgcccucaacccaccgaacucaaguauagcuggaaaacguggggcaaggccaagaugcuguccaccgagagccauaaccagacauuccugauugaugggccugaaaccgcugagugccccaauacaaaccgggccuggaacucucucgagguugaagacuacggauuuggcguguucaccacaaacaucuggcugaaacuuagagagaagcaggacgucuuuugugauuccaaacugaugagcgcugccaucaaggacaaucgcgcggugcacgccgauaugggcuauuggauugaaucugcucucaacgacaccuggaaaauggagaaggccuccuucaucgagguuaagagcugccacuggccuaaaucucauacgcuguggagcaauggggugcuggaauccgagaugauuauccccaagaacuucgcuggaccggucagccagcacaacuaccggccuggcuaucauacacaaaccgccgggcccuggcaccuuggaaaacucgaaauggauuuugaccugugugagggcaccacagugguggucaccgaagauugcgggaauagaggacccucucugcggacgacaaccgccuccggcaagcucauuacagaguggugcugucgcagcugcacccugccuccgcuuagauaccggggcgaggacggguguugguacggaauggaaaucagaccccugaaagagaaggaagagaaccucguuaauucccuggugacagcuggccaugggcagauugauaacuucucucugggagugcuuggcauggcgcucuuucuggaagagaugcugcgcacccggaucgggacgaagcacgccauccuccuggucgcugugagcuucguuacccuuauuacaggaaauauguccuuuagagaccugggccgcgugauggucauggugggcgccaccaugacagaugacaucgggaugggaguuaccuaucucgcccugcuggcugccuucaaagugagaccuacguuugcggcuggccuucugcuccggaagcugacaucuaaagagcucaugauggccaccauugggaucgcccugcuuagccaguccacaauucccgaaaccauccuggagcucaccgaugcucuggcccugggaaugaugguccuuaagaucgugcgcaacauggaaaaauaccaacuggcgguuacaauuauggcuaucucuugcgugccuaaugccgucauucuccagaacgccuggaaggugagcuguacgauccuggcugccguguccgucagcccccuccugcuuaccucuucccagcagaaggcugacuggauuccucuggcccucacaaucaaaggccugaaucccaccgcgaucuuccugacaacccuuagcagaacgucuaagaaacgguccuggccgcugaacgaggccauuauggcuguugggauggugagcauccucgccucuucccugcucaagaaugacauuccuaugacaggaccccugguggcuggcggccuucugaccgucugcuaugugcugaccgggcgcagcgccgaucucgaacuggagagagccgcugacguuaaaugggaggaucaagcggaaaucuccggaagcucuccuauucuuagcaucacaauuuccgaggacggcucuaugagcaucaagaacgaagaggaggaacagacccugacaauccucauucggacggggcugcucgugaucuccggagucuuucccgugucuauuccgaucaccgccgcugccugguaccugugggagguuaaaaagcagcgcgccggcgugcuuugggaugucccuucucccccucccguggaaaaggcugagcuggaagacggggccuauagaauuaaacagcggggaauccugggcuacucccaaaucggcgcgggggucuauaaggagggaacauuccacaccauguggcaugugacacgcggcgcuguucucaugcacagagggaaacggauugagcccuccugggccgaugugaagaaagaccugaucagcuacggaggcggguggaaacuugaaggagaguggaaggaaggcgaggaaguccaggugcuggcccucgagccuggcaaaaauccgagagcuguucagaccaagcccgggauuuuuaaaacgaacaccggaacaaucggcgccgugucccuggauuucagcccugggaccucuggaucccccauugucgaccgcaagggcaaagugguggggcucuacggaaauggcguugucacacggagcggcgcguaugugucugcuaucgcccagaccgagaaguccaucgaagauaacccugagauugaagacgauaucuuuagaaagaaacgccugacaauuauggaccuucaucccggggccggaaagacgaaacgguaccugccugcuaucgugagagaggccauuaagcgcggccugcggacccucauccuggcuccgacaagagucguggccgcggaaauggaggaggcccuucgcgggcugcccauucgguaucaaaccaccgcuaucaaaacagaacacacgggaagagagaucguugaccucaugugucaugccaccuucacaaugcggcugcucagcccugugcgcguccccaacuacaaucugauuaucauggaugaagcucacuucaccgacccugccuccauugccgcuagaggcuauaucucuacacggguggagaugggggaggcggccggcauuuuuaugaccgcuacgcccccgggaagccgcgauccuuucccccaguccaacgcccccaucauggacgaagagagagaaaucccugagcggagcuggaacucuggccacgaauggguuacagauuuuaaggggaagaccgugugguucguccccuccauuaaagccggaaacgacaucgcugccugccuuagaaagaauggcaaaaaggugauucagcugagccgcaaaaccuuugauucugaguacguuaagacacgggcgaacgacugggauuucguggucaccacagacaucagcgagaugggggcuaauuuuaaggccgaaagagugauugauccucgccgguguaugaaaccggugauccugaccgacggagaggaaagagucauccucgccggccccaugccuguuacgcauuccucugcugcccaacgccgggggagaauuggccgcaaccccaagaaugagaacgaccaguauaucuacaugggagaaccucuggagaaugaugaggacugcgcgcacuggaaagaagccaagaugcuucuggauaacauuaauacacccgagggcaucauuccgagcauguucgaaccugagagagaaaaaguggacgcuaucgauggggaguaccggcuccgcggagaggccagaaagaccuuuguggaccugaugcggcgcggcgaucugcccgucuggcucgcuuauaaaguggccgcugaagggauuaacuacgccgacagaaagugguguuucgauggaaucaagaauaaccagauccuugaggaaaacauggagguugagauuuggacaaaagaaggcgagcggaagaaacugaagccuagauggcuggacgcgcgcaucuauuccgauccccucgcccugaaagaauuuaaggaguucgcugccgggcggaagucucuuacccugaaucucauuacggaaaugggcagacugccuaccuucaugacacagaaagcucgcaacgcccuggacaaucucgccgugcuucauaccgcugaggcgggaggccgggccuacaaccacgcucugagcgagcugcccgaaacacucgagacccugcuucugcucacacugcuggccaccgucacagggggaaucuuucucuuccuuauguccggcaaggggauuggaaaaaugacacugggcaugugcugcaucaucaccgccagcauucugcucugguaugcucaaauccagccgcacuggauugccgcgucuaucauucuggaauuuuuccuuaucgugcugcucaucccugagcccgaaaagcagagaacaccccaggauaaucaacugacauacguugugauugccauccugaccgucguggcugccacaauggcuaacgagaugggcuuucucgagaaaacgaagaaggaccuugggcugggauccauuaccacacaggaaagcgaguccaauauccuggacauugaucuccggccugccucugcguggacccuguaugccgucgcuacaaccuucgugacgccgaugcuucgccauagcaucgaaaacuccucuguuaaugugagccugaccgccauugcuaaccaggccacagugcucaugggccuggggaaaggauggccccuguccaagauggacaucggcgucccucuccuugcuaucggguguuacagccagguuaaucccauuacccugacagccgcgcugcuccugcuuguggcccacuacgcuaucauuggaccuggccugcaagccaaagcuaccagagaggcccagaagcgggccgcggcuggcaucaugaaaaaccccacgguggaugggauuacagucaucgaccucgaaccuaucccguaugaucccaaguuugagaagcagcugggacaggugaugcugcucauucuuugcguuacccaagugcugaugaugcgcacaaccugggcccugugugaggcucucacccuggccacaggcccuaucucuacgcuuugggaagggaaucccggaagauucuggaacaccacaauugccgucuccauggcuaauaucuuucggggcagcuaccuggccggggcgggacuccuguucucuauuaugaaaaacaccacaaauacccgcagaggcacgggcaacaucggggagacacugggagaaaaguggaaaucccggcucaacgcccuuggcaagagcgaguuucagaucuauaaaaagucugggauucaggagguggaccgcacccuggcuaaagaaggaaucaagagaggcgagaccgaucaucacgccgucagccggggguccgcuaagcugagaugguucguggaacgcaauaugguuacaccugagggaaaaguggucgaccucggcugcggcagagggggauggucuuacuauuguggcgggcugaagaacgugcgggaaguuaaaggacuuaccaagggcgggcccggacaugaggagccgauuccuaugagcacauacggcuggaaucuggugcgccuccaauccggcgucgauguguuuuucacgccgcccgaaaaaugcgacacccugcugugugauaucggggagagcuccccuaaccccacaauugaagccggacggacccucagagugcuuaaucugguugagaacuggcugaauaacaauacacaguucugcaucaagguccucaacccuuauaugccgucugugaucgaaaagauggaggcgcugcagcgcaaauacggcggggcccuugugcggaauccccugagcagaaacuccacccacgagauguacugggucucuaaugcuacgggaaacauuguuagcuccgugaauaugaucucucgcaugcucauuaaccgguuuaccaugaagcacaaaaaggccacauaugaaccugacguggaucugggcagcgggaccagaaacaucggaauugaguccgaaauccccaaucuggacauuaucggcaaacgcaucgagaagauuaagcaggaacaugagacaagcuggcacuacgaccaagaucauccuuauaaaaccugggcuuaccacggcucuuaugagacaaagcagaccggguccgccagcucuauggucaacggagugguucggcuccuuacgaaacccugggacguggucccgauggugacacagauggcuaugaccgauaccacaccuuucggccagcaaagaguuuuuaaggaaaaaguggacacgcgcacccaggagcccaaggaagggacaaagaaacugaugaagaucaccgccgaguggcuguggaaagagcucggaaagaaaaagacaccuagaauguguacccgggaagaguucacacgcaaagucagauccaaugcggcccugggcgcuauuuuuaccgaugaaaacaaguggaaaagcgcccgggaggcuguggaagacgggagauucugggagcuuguggaucgggagcgcaaucugcaccucgaaggaaaaugcgagacgugugucuacaacaugaugggcaagagagagaagaagcugggcgaguuugggaaagccaagggaucucgggccaucugguauauguggcugggcgcgcgcuuccucgaauuugaggcucugggguuccuuaaugaggaccauugguuuuccagaggaaacagccuguccggcguugaaggggagggccuccaccggcugggauacauucuucgcgaugugggcaagaaagaagggggagccauguacgccgacgauaccgcuggcugggacacaagaaucacccuggaggaccucaagaaugaagagauggugacaaaccauaugaaaggggagcacaagaaacuggccgaagcuaucuucaagcugaccuaucagaauaaggucgugcggguucagcgccccacgccuagaggaacagugauggauauuaucagccggcgcgaccaaagaggcucugggcaggucggcaccuacggacucaacacauuuaccaauauggaggcccagcugauucggcaaauggaaggcgaggggaucuucaaaagcauucagcaucuuacggcgaccgaggaaaucgccgugcagaacuggcuggcucgcguuggaagagagcggcucuccagaauggccaucucuggcgaugacugcguggucaagcccauugaugaccgcuucgcuagcgcccugacagcgcuuaaugauauggggaaaauccggaaggacauucagcaaugggaaccguccagaggauggaacgauuggacccaggugccuuuuugcucucaccacuuccaugagcugguuaugaaagacggccgcgugcucgucgugcccugucggaaccaggaugaacugaucgggagagcccgcauuagccagggcgcuggauggucccugaaggagacagccugccucggcaagucuuaugcucaaauguggacccugauguacuuucaccggagagaccuucgccuggccgcuaaugccaucuguagcgcgguccccucccauugggugccuacaagccggaccacguggucuauucacgccaaacacgaguggaugacaaccgaagauaugcucgcuguuuggaacagaguguggauccaggagaauccguggauggaagacaagacccccgucgaguccugggaagaggugccuuaucuggggaaacgcgaggaccaguggugcggaagccuuaucggccugacaucucgggccaccugggccaagaacauucagacagcuaucaaucaagugagaucccucauugggaacgaagaguacacggauuauaugcccagcaugaaacgguucagacgcgaagaggaagaggccggaguucugugguga

SEQ ID NO: 19816 - RNA, 9876 nt, Artificial Sequence
  derived and/or modified CDS sequence (opt5) from DENV-2__EU482762__SS-prME
accgccggcgugaucgucaugcugauucccacagcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugcuacuggccuaaaucucacacacuguggagcaauggggugcuggaauccgagaugauuauccccaagaacuucgccggaccggucagccagcauaacuaucggccuggcuaccacacccaaaccgcugggcccuggcaucuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguauggaauggaaaucagaccccugaaagagaaggaagagaaccucguuaauucccuggugaccgccggccacgggcagauugauaacuucucucugggagugcuuggcauggcucucuuucuggaagagaugcugcgcacgcggaucgggaccaagcaugcgauccuccuggucgccgugagcuucguuacacuuauuaccggaaauauguccuuuagagaccugggccgcgugauggucauggugggcgcuacaaugaccgaugacaucgggaugggaguuacguaccucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaucaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuacgugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaucugugggagguuaaaaagcagcgcgccggcgugcuuugggaugucccuucucccccucccguggaaaaggccgagcuggaagacggggcuuacagaauuaaacagcggggaauccugggcuauucccaaaucggcgccggggucuacaaggagggaaccuuccacacaauguggcacgugacccgcggcgcgguucucaugcauagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuauggaaauggcguugucacccggagcggcgccuacgugucugcgaucgcucagacagagaaguccaucgaagauaacccugagauugaagacgauaucuuuagaaagaaacgccugacgauuauggaccuucaccccggggccggaaagaccaaacgguaucugccugccaucgugagagaggcuauuaagcgcggccugcggacacucauccuggccccgaccagagucguggcugccgaaauggaggaggcgcuucgcgggcugcccauucgguaccaaaccacagccaucaaaacggaacauaccggaagagagaucguugaccucaugugucacgcuacauucaccaugcggcugcucagcccugugcgcguccccaacuauaaucugauuaucauggaugaagcccauuucacagacccugcuuccauugccgccagaggcuacaucucuacccggguggagaugggggaggcugcgggcauuuuuaugacggccacacccccgggaagccgcgauccuuucccccaguccaacgcucccaucauggacgaagagagagaaaucccugagcggagcuggaacucuggccacgaauggguuaccgauuuuaaggggaagaccgugugguucguccccuccauuaaagccggaaacgacaucgccgcuugccuuagaaagaauggcaaaaaggugauucagcugagccgcaaaacauuugauucugaguauguuaagacccgggccaacgacugggauuucguggucacaaccgacaucagcgagaugggggcgaauuuuaaggcugaaagagugauugauccucgccgguguaugaaaccggugauccugacggacggagaggaaagagucauccucgccggccccaugccuguuacacacuccucugccgcucaacgccgggggagaauuggccgcaaccccaagaaugagaacgaccaguacaucuacaugggagaaccucuggagaaugaugaggacugcgcccauuggaaagaagcgaagaugcuucuggauaacauuaauacccccgagggcaucauuccgagcauguucgaaccugagagagaaaaaguggacgccaucgauggggaguaucggcuccgcggagaggcuagaaagacauuuguggaccugaugcggcgcggcgaucugcccgucuggcucgccuacaaaguggcugccgaagggauuaacuaugcugacagaaagugguguuucgauggaaucaagaauaaccagauccuugaggaaaacauggagguugagauuuggaccaaagaaggcgagcggaagaaacugaagccuagauggcuggacgcccgcaucuacuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccgugcuucacacagccgaggcuggaggccgggcguauaaccaugcccugagcgagcugcccgaaacccucgagacacugcuucugcucacccugcuggcuacggucacagggggaaucuuucucuuccuuauguccggcaaggggauuggaaaaaugacccugggcaugugcugcaucaucaccgccagcauucugcucugguacgcccaaauccagccgcacuggauugcugccucuaucauucuggaauuuuuccuuaucgugcugcucaucccugagcccgaaaagcagagaacaccccaggauaaucaacugaccuauguugugauugcgauccugacagucguggccgcuacgauggccaacgagaugggcuuucucgagaaaaccaagaaggaccuugggcugggauccauuacaacccaggaaagcgaguccaauauccuggacauugaucuccggccugcuucugccuggacacuguacgcggucgccaccacguucgugaccccgaugcuucgccacagcaucgaaaacuccucuguuaaugugagccugacagcuauugccaaccaggcuaccgugcucaugggccuggggaaaggauggccccuguccaagauggacaucggcgucccucuccuugccaucggguguuacagccagguuaaucccauuacacugaccgcugcccugcuccugcuuguggcgcauuaugccaucauuggaccuggccugcaagcuaaagccacgagagaggcucagaagcgggccgccgcgggcaucaugaaaaaccccacaguggaugggauuaccgucaucgaccucgaaccuaucccguacgaucccaaguuugagaagcagcugggacaggugaugcugcucauucuuugcguuacacaagugcugaugaugcgcaccaccugggcucugugugaggcccucacacuggcuacgggcccuaucucuacccuuugggaagggaaucccggaagauucuggaacacaaccauugccgucuccauggccaauaucuuucggggcagcuaucuggcuggggccggacuccuguucucuauuaugaaaaacacaaccaauacgcgcagaggcacaggcaacaucggggagacccugggagaaaaguggaaaucccggcucaacgcgcuuggcaagagcgaguuucagaucuacaaaaagucugggauucaggagguggaccgcacccuggccaaagaaggaaucaagagaggcgagacagaucaccaugcugucagccggggguccgccaagcugagaugguucguggaacgcaauaugguuaccccugagggaaaaguggucgaccucggcugcggcagagggggauggucuuauuacuguggcgggcugaagaacgugcgggaaguuaaaggacuuacaaagggcgggcccggacacgaggagccgauuccuaugagcacguauggcuggaaucuggugcgccuccaauccggcgucgauguguuuuucacaccgcccgaaaaaugcgacacacugcugugugauaucggggagagcuccccuaaccccaccauugaagcuggacggacacucagagugcuuaaucugguugagaacuggcugaauaacaauacccaguucugcaucaagguccucaacccuuacaugccgucugugaucgaaaagauggaggcccugcagcgcaaauacggcggggcgcuugugcggaauccccugagcagaaacuccacgcaugagauguauugggucucuaaugccaccggaaacauuguuagcuccgugaauaugaucucucgcaugcucauuaaccgguuuacaaugaagcacaaaaaggcuaccuacgaaccugacguggaucugggcagcgggacaagaaacaucggaauugaguccgaaauccccaaucuggacauuaucggcaaacgcaucgagaagauuaagcaggaacacgagaccagcuggcauuaugaccaagaucacccuuacaaaacaugggccuaucauggcucuuacgagaccaagcagacgggguccgcuagcucuauggucaacggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagaucacagcugaguggcuguggaaagagcucggaaagaaaaagaccccuagaauguguacacgggaagaguucacccgcaaagucagauccaaugccgcgcugggcgccauuuuuacggaugaaaacaaguggaaaagcgcucgggaggccguggaagacgggagauucugggagcuuguggaucgggagcgcaaucugcaccucgaaggaaaaugcgagaccugugucuauaacaugaugggcaagagagagaagaagcugggcgaguuugggaaagcuaagggaucucgggccaucugguacauguggcugggcgcccgcuuccucgaauuugaggcgcugggguuccuuaaugaggaccacugguuuuccagaggaaacagccuguccggcguugaaggggagggccuccaucggcugggauacauucuucgcgaugugggcaagaaagaagggggagcuauguaugccgacgauacagccggcugggacaccagaaucacacuggaggaccucaagaaugaagagauggugaccaaccacaugaaaggggagcauaagaaacuggcugaagccaucuucaagcugacguaccagaauaaggucgugcggguucagcgccccacaccuagaggaaccgugauggauauuaucagccggcgcgaccaaagaggcucugggcaggucggcacauauggacucaacaccuuuacgaauauggaggcucagcugauucggcaaauggaaggcgaggggaucuucaaaagcauucagcaccuuaccgccacagaggaaaucgcggugcagaacuggcuggcccgcguuggaagagagcggcucuccagaauggcuaucucuggcgaugacugcguggucaagcccauugaugaccgcuucgccagcgcucugaccgcccuuaaugauauggggaaagugcggaaggacauccagcaaugggaaccguccagaggauggaacgauuggacacagguuccuuuuugcucucaucacuuccacgagcuggugaugaaagacggccgcguccucgugguccccugucggaaccaggaugaacugauugggagagcgcgcaucagccagggcgccggauggucccugaaggagaccgcuugccucggcaagucuuacgcccaaauguggacacugauguauuuucaucggagagaccuucgccuggcugccaaugcuauuuguagcgccgugcccucccacuggguuccuaccagccggacgacauggucuauccaugcgaaacacgaguggaugaccaccgaagauaugcucgccguguggaacagagucuggauucaggagaauccguggauggaagacaagacacccguggaguccugggaagaggugccuuaccuggggaaacgcgaggaccaguggugcggaagccuuaucggccugaccucucgggcuacaugggccaagaacauccagacggccauuaaucaaguuagaucccucaucgggaacgaagaguauaccgauuacaugcccagcaugaaacgguucagacgcgaagaggaagaggcuggagugcugugguga

SEQ ID NO: 19817 - RNA, 9876 nt, Artificial Sequence
  derived and/or modified CDS sequence (opt5) from DENV-2__EU482763__SS-prME
accgccggcgugaucgucaugcugauucccaccgcuauggccuuccaccucacgaccagaaauggggaaccucauaugaucguuggacggcaggaaaagggcaagagccugcuuuuuaagacagaggacggggugaauaugugcacccugauggcgauggaucucggagaacugugugaggacacaauuaccuacaagugcccccuucugcgccaaaaugaacccgaggauaucgacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggauugagaccuggauccugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacauuguccucgagcacggguccugugugacaaccauggccaagaauaagcccacacuggauuucgaacuuaucaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgucacaugcgccauguuuacgugcaaaaagaauauggaaggcaaaguugugcagccugagaaccucgaauacaccauugugaucacaccccacagcggggaggagcaugcggucggaaaugacaccggcaagcacggcaaagaaauuaagaucacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgauugugaucagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucauuggcguggagcccggacagcucaaacugaauugguucaagaagggcuccagcaucgggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucggggugauuaucaccuggaucggaaugaacagccgguccacaagccugucugugucccuuguucucgucggcguggugacccuguaucugggggccaugguccaggccgacagcggaugugugguuucuuggaagaauaaagaacucaagugcggcuccgggauuuucaucacagauaacgugcacacguggaccgagcaguacaaguuucaaccugaaagccccuccaaacuggcuucugccauucagaaggcucaugaggaaggcaucuguggaauuagaagcgucacacgccuugagaaucugauguggaaacagaucaccccggagcucaaccacauccuguccgaaaaugaggugaagcugacaauuaugaccggcgacauccgggggauuaugcaggccggaaaaagaucucuucgcccucaacccacggaacucaaguauagcuggaaaaccuggggcaaggcgaagaugcuguccacagagagccauaaccagaccuuccugaucgaugggccugaaacagccgagugccccaauaccaaccgggcuuggaacucucucgagguugaagacuacggauuuggcguguucacaaccaacauuuggcugaaacuuagagagaagcaggacgucuuuugugauuccaaacugaugagcgccgcuaucaaggacaaucgcgccgugcacgcggauaugggcuauuggaucgaaucugcccucaacgacacguggaaaauggagaaggcuuccuucauugagguuaagagcugccacuggccuaaaucucauacacuguggagcaauggggugcuggaauccgagaugaucauucccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucaucaccgaguggugcugucgcagcugcacacugccuccgcuuagauaccggggcgaggacggguguugguacggaauggaaauuagaccccugaaagagaaggaagagaaccucguuaauucccuggugaccgccggccaugggcagaucgauaacuucucucugggagugcuuggcauggcucucuuucuggaagagaugcugcgcacgcggauugggaccaagcacgcgauccuccuggucgccgugagcuucguuacacuuaucaccggaaauauguccuuuagagaccugggccgcgugauggucauggugggcgcuacaaugaccgaugacauugggaugggaguuacguaucucgcccugcuggccgcuuucaaagugagaccuacauuugccgcgggccuucugcuccggaagcugaccucuaaagagcucaugauggcuacaaucgggauugcccugcuuagccaguccaccauccccgaaaccauucuggagcucacagaugcccuggcucugggaaugaugguccuuaagaucgugcgcaacauggaaaaauaccaacuggccguuacgaucauggcgauuucuugcgugccuaaugcugucauccuccagaacgccuggaaggugagcuguaccauucuggccgcuguguccgucagcccccuccugcuuacaucuucccagcagaaggccgacuggaucccucuggcucucaccauuaaaggccugaaucccacagccaucuuccugaccacgcuuagcagaacaucuaagaaacgguccuggccgcugaacgaggcgaucauggccguugggauggugagcauucucgcuucuucccugcucaagaaugacaucccuaugaccggaccccugguggccggcggccuucugaccgucugcuaugugcugacagggcgcagcgcugaucucgaacuggagagagccgccgacguuaaaugggaggaucaagcugaaauuuccggaagcucuccuauccuuagcauuaccaucuccgaggacggcucuaugagcauuaagaacgaagaggaggaacagacacugacgauccucauccggaccgggcugcucgugauuuccggagucuuucccgugucuaucccgauuacagcggccgcuugguaccugugggagguuaaaaagcagcgcgccggcgugcuuugggaugucccuucucccccucccguggaaaaggccgagcuggaagacggggcuuauagaaucaaacagcgggggauucugggcuacucccaaaucggcgccggggucuauaaggagggaaccuuccacacaauguggcaugugacccgcggcgcgguucucaugcacagagggaaacggaucgagcccuccugggcugaugugaagaaagaccugauuagcuacggaggcggguggaaacuugaaggagaguggaaggaaggcgaggaaguccaggugcuggcccucgagccuggcaaaaauccgagagccguucagacgaagcccgggaucuuuaaaaccaacacaggaaccauuggcgcugugucccuggauuucagcccugggacaucuggaucccccaucgucgaccgcaagggcaaagugguggggcucuacggaaauggcguugucacccggagcggcgccuaugugucugcgauugcucagacagagaaguccaucgaagauaacccugagaucgaagacgauauuuuuagaaagaaacgccugacgaucauggaccuucaucccggggccggaaagaccaaacgguaccugccugccauugugagagaggcuaucaagcgcggccugcggacacucauucuggccccgaccagagucguggcugccgaaauggaggaggcgcuucgcgggcugcccauccgguaucaaaccacagccauuaaaacggaacacaccggaagagagaucguugaccucaugugucaugcuacauucaccaugcggcugcucagcccugugcgcguccccaacuacaaucugaucauuauggaugaagcccacuucacagacccugcuuccaucgccgccagaggcuauauuucuacccggguggagaugggggaggcugcgggcaucuuuaugacggccacacccccgggaagccgcgauccuuucccccaguccaacgcucccauuauggacgaagagagagaaaucccugagcggagcuggaacucuggccacgaauggguuaccgauuuuaaggggaagaccgugugguucguccccuccaucaaagccggaaacgacauugccgcuugccuuagaaagaauggcaaaaaggugauccagcugagccgcaaaacauuugauucugaguacguuaagacccgggccaacgacugggauuucguggucacaaccgacauuagcgagaugggggcgaauuuuaaggcugaaagagugaucgauccucgccgguguaugaaaccggugauucugacggacggagaggaaagagucauccucgccggccccaugccuguuacacauuccucugccgcucaacgccgggggagaaucggccgcaaccccaagaaugagaacgaccaguauauuuacaugggagaaccucuggagaaugaugaggacugcgcccacuggaaagaagcgaagaugcuucuggauaacaucaauacccccgagggcauuaucccgagcauguucgaaccugagagagaaaaaguggacgccauugauggggaguaccggcuccgcggagaggcuagaaagacauuuguggaccugaugcggcgcggcgaucugcccgucuggcucgccuauaaaguggcugccgaagggaucaacuacaccgacagaaagugguguuucgauggaauuaagaauaaccagauccuugaggaaaacauggagguugagaucuggacgaaagaaggcgagcggaagaaacugaagccuagauggcuggacgcucgcauuuauuccgauccccucgcccugaaagaauuuaaggaguucgcggccgggcggaagucucuuacccugaaucucaucacagaaaugggcagacugccuaccuucaugacacagaaagcucgcaacgcccuggacaaucucgcugugcuucauaccgccgaggccggaggccgggcuuacaaccacgcgcugagcgagcugcccgaaacacucgagacccugcuucugcucacgcugcuggccacagucaccgggggaauuuuucucuuccuuauguccggcaaggggaucggaaaaaugacccugggcaugugcugcauuaucacagcuagcauccugcucugguaugcccaaauucagccgcacuggaucgccgcuucuauuauccuggaauuuuuccuuauugugcugcucaucccugagcccgaaaagcagagaacaccccaggauaaucaacugacauacguugugaucgccauucugacggucguggcggccaccauggcuaacgagaugggcuuucucgagaaaacaaagaaggaccuugggcugggauccaucaccacacaggaaagcgaguccaauauucuggacaucgaucuccggccugccucugcuuggacccuguaugccgucgcgacgaccuucgugacaccgaugcuucgccauagcauugaaaacuccucuguuaaugugagccugaccgccaucgcuaaccaggccacagugcucaugggccuggggaaaggauggccccuguccaagauggacauuggcgucccucuccuugcuaucggguguuacagccagguuaaucccaucacccugacggccgcucugcuccugcuuguggcccacuacgcgauuaucggaccuggccugcaagccaaagcuacaagagaggcccagaagcgggcugccgccggcauuaugaaaaaccccaccguggaugggaucacagucauugaccucgaaccuaucccguaugaucccaaguuugagaagcagcugggacaggugaugcugcucauccuuugcguuacccaagugcugaugaugcgcaccacaugggcgcugugugaggcucucacgcuggccaccggcccuauuucuacacuuugggaagggaaucccggaagauucuggaacaccacaaucgcugucuccauggccaauauuuuucggggcagcuaccuggccggggcuggacuccuguucucuaucaugaaaaacaccacgaauacacgcagaggcaccggcaacauuggggagacccugggagaaaaguggaaaucccggcucaacgcccuuggcaagagcgaguuucagaucuauaaaaagucugggauccaggagguggaccgcacacuggcgaaagaaggaauuaagagaggcgagaccgaucaucacgccgucagccggggguccgcuaagcugagaugguucguggaacgcaauaugguuacaccugagggaaaaguggucgaccucggcugcggccggggaggauggucuuacuauuguggcgggcugaagaacgugagagaaguuaaaggacuuacgaagggcgggcccggacaugaggagccgaucccuaugagcaccuacggcuggaaucuggugcgccuccaauccggcgucgauguguuuuucacaccgcccgaaaaaugcgacacccugcugugugauauuggggagagcuccccuaaccccacaaucgaagccggacggacccucagagugcuuaaucugguugagaacuggcugaauaacaauacgcaguucugcauuaagguccucaacccuuauaugccgucugugaucgaaaagauggaggcucugcagcgcaaauacggcggggcccuugugcggaauccccugagcagaaacuccacccacgagauguacugggucucuaaugcgacaggaaacaucguuagcuccgugaauaugauuucucgcaugcucaucaaccgguuuaccaugaagcacaaaaaggccacauaugaaccugacguggaucugggcagcgggaccagaaacauuggaaucgaguccgaaauucccaaucuggacaucauuggcaaacgcaucgagaagaucaagcaggaacaugagacaagcuggcacuacgaccaagaucauccuuauaaaaccugggcuuaccacggcucuuaugagacgaagcagacaggguccgccagcucuauggucaacggagugguucggcuccuuaccaaacccugggacguggucccgauggugacccagauggcuaugacagauacgaccccuuucggccagcaaagaguuuuuaaggaaaaaguggacacacgcacccaggagcccaaggaagggacaaagaaacugaugaagauuaccgccgaguggcuguggaaagagcucggaaagaaaaagacaccuagaauguguacccgggaagaguucacgcgcaaagucagauccaaugcugcccugggcgcgaucuuuaccgaugaaaacaaguggaaaagcgcccgggaggcuguggaagacgggagauucugggagcuuguggaucgggagcgcaaucugcaccucgaaggaaaaugcgagacaugugucuacaacaugaugggcaagagagagaagaagcugggcgaguuugggaaagccaagggaucucgggcuauuugguauauguggcugggcgcccgcuuccucgaauuugaggcccugggguuccuuaaugaggaccauugguuuuccagaggaaacagccuguccggcguugaaggggagggccuccaccggcugggauacauccuucgcgaugugggcaagaaagaagggggagcgauguacgcugacgauaccgccggcugggacacaagaauuacccuggaggaccucaagaaugaagagauggugacgaaccauaugaaaggggagcacaagaaacuggccgaagcuaucuucaagcugacauaucagaauaaggucgugcggguucagcgccccaccccuagaggaacagugauggauaucauuagccggcgcgaccaaagaggcucugggcaggucggcaccuacggacucaacacguuuaccaauauggaggcccagcugauccggcaaauggaaggcgaggggauuuucaaaagcauccagcaucuuacagcuaccgaggaaauugccgugcagaacuggcuggcgcgcguuggaagagagcggcucuccagaauggccaucucuggcgaugacugcguggucaagcccaucgaugaccgcuucgcuagcgcccugacagcucuuaaugauauggggaaagugcggaaggacauucagcaaugggaaccguccagaggauggaacgauuggacccagguuccuuuuugcucucaccacuuccaugagcuggugaugaaagacggccgcguccucgugguccccugucggaaccaggaugaacugaucgggagagcccgcauuagccagggcgcgggauggucccugaaggagacagccugccucggcaagucuuaugcucaaauguggacccugauguacuuucaccggagagaccuucgccuggccgcuaaugccaucuguagcgcugugcccucccauuggguuccuacgagccggacaaccuggucuauucacgccaaacacgaguggaugaccacagaagauaugcucgcgguguggaacagagucuggauccaggagaauccguggauggaagacaagacccccguggaguccugggaagaggugccuuaucuggggaaacgcgaggaccaguggugcggaagccuuauuggccugacaucucgggccacgugggcuaagaacauccagaccgccaucaaucaaguuagaucccucauugggaacgaagaguacacagauuauaugcccagcaugaaacgguucagacgcgaagaggaagaggccggagugcugugguga

SEQ ID NO: 19818 - RNA, 9876 nt, Artificial Sequence
  derived and/or modified CDS sequence (opt5) from DENV-2__EU482444__SS-prME
accgccggcgugaucgucaugcugauucccacagcuauggccuuccaccucacgaccagaaauggggagccucauaugaucguuggacggcaggaaaagggcaagagccugcuuuuuaagacagaggacggggugaauaugugcacccugauggcgauggaucucggagaacugugugaggacacaauuaccuacaagugcccccuucugcgccaaaaugaacccgaggauaucgacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggauugagaccuggauccugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacauuguccucgagcacggguccugugugacaaccauggccaagaauaagcccacacuggauuucgaacuuaucaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaaggagggaucgucacaugcgccauguuuacgugcaaaaagaauauggaaggcaaaguugugcagccugagaaccucgaauacaccauugugaucacaccccacagcggggaggagcaugcggucggaaaugacaccggcaagcacggcaaagaaauuaagaucacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgauugugaucagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucauuggcguggagcccggacagcucaaacugaauugguucaagaagggcuccagcaucgggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucggggugauuaucaccuggaucggaaugaacagccgguccacaagccugucugugucccuuguucucgucggcguggugacccuguaucugggggccaugguccaggccgacagcggaugugugguuucuuggaagaauaaagaacucaagugcggcuccgggauuuucaucacagauaacgugcacacguggaccgagcaguacaaguuucaaccugaaagccccuccaaacuggcuucugccauucagaaggcucaugaggaaggcaucuguggaauuagaagcgucacacgccuugagaaucugauguggaaacagaucaccccggagcucaaccacauccuguccgaaaaugaggugaagcugacaauuaugaccggcgacauccgggggauuaugcaggccggaaaaagaucucuucgcccucaacccacggaacucaaguauagcuggaaaaccuggggcaaggcgaagaugcuguccacagagagccauaaccagaccuuccugaucgaugggccugaaacagccgagugccccaauaccaaccgggcuuggaacucucucgagguugaagacuacggauuuggcguguucacaaccaacauuuggcugaaacuuagagagaagcaggacgucuuuugugauuccaaacugaugagcgccgcuaucaaggacaaucgcgccgugcacgcggauaugggcuauuggaucgaaucugcccucaacgacacguggaaaauggagaaggcuuccuucauugagguuaagagcugccacuggccuaaaucucauacacuguggagcaauggggugcuggaauccgagaugaucauucccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucaucaccgaguggugcugucgcagcugcacacugccuccgcuuagauaccggggcgaggacggguguugguacggaauggaaauuagaccccugaaagagaaggaagagaaccucguuaauucccuggugaccgccggccaugggcagaucgauaacuucucucugggagugcuuggcauggcucucuuucuggaagagaugcugcgcacgcggauugggaccaagcacgcgauccuccuggucgccgugagcuucguuacacuuaucaccggaaauauguccuuuagagaccugggccgcgugauggucauggugggcgcuacaaugaccgaugacauugggaugggaguuacguaucucgcccugcuggccgcuuucaaagugagaccuacauuugccgcgggccuucugcuccggaagcugaccucuaaagagcucaugauggcuacaaucgggauugcccugcuuagccaguccaccauccccgaaaccauucuggagcucacagaugcccuggcucugggaaugaugguccuuaagaucgugcgcaacauggaaaaauaccaacuggccguuacgaucauggcgauuucuugcgugccuaaugcugucauccuccagaacgccuggaaggugagcuguaccauucuggccgcuguguccgucagcccccuccugcuuacaucuucccagcagaaggccgacuggaucccucuggcucucaccauuaaaggccugaaucccacagccaucuuccugaccacgcuuagcagaacaucuaagaaacgguccuggccgcugaacgaggcgaucauggccguugggauggugagcauucucgcuucuucccugcucaagaaugacaucccuaugaccggaccccugguggccggcggccuucugaccgucugcuaugugcugacagggcgcagcgcugaucucgaacuggagagagccgccgacguuaaaugggaggaucaagcugaaauuuccggaagcucuccuauccuuagcauuaccaucuccgaggacggcucuaugagcauuaagaacgaagaggaggaacagacacugacgauccucauccggaccgggcugcucgugauuuccggagucuuucccgugucuaucccgauuacagcggccgcuugguaccugugggagguuaaaaagcagcgcgccggcgugcuuugggaugucccuucucccccucccguggaaaaggccgagcuggaagacggggcuuauagaaucaaacagcgggggauucugggcuacucccaaaucggcgccggggucuauaaggagggaaccuuccacacaauguggcaugugacccgcggcgcgguucucaugcacagagggaaacggaucgagcccuccugggcugaugugaagaaagaccugauuagcuacggaggcggguggaaacuugaaggagaguggaaggaaggcgaggaaguccaggugcuggcccucgagccuggcaaaaauccgagagccguucagacgaagcccgggaucuuuaaaaccaacacaggaaccauuggcgcugugucccuggauuucagcccugggacaucuggaucccccaucgucgaccgcaagggcaaagugguggggcucuacggaaauggcguugucacccggagcggcgccuaugugucugcgauugcucagacagagaaguccaucgaagauaacccugagaucgaagacgauauuuuuagaaagaaacgccugacgaucauggaccuucaucccggggccggaaagaccaaacgguaccugccugccauugugagagaggcuaucaagcgcggccugcggacacucauucuggccccgaccagagucguggcugccgaaauggaggaggcgcuucgcgggcugcccauccgguaucaaaccacagccauuaaaacggaacacaccggaagagagaucguugaccucaugugucaugcuacauucaccaugcggcugcucagcccugugcgcguccccaacuacaaucugaucauuauggaugaagcccacuucacagacccugcuuccaucgccgccagaggcuauauuucuacccggguggagaugggggaggcugcgggcaucuuuaugacggccacacccccgggaagccgcgauccuuucccccaguccaacgcucccauuauggacgaagagagagaaaucccugagcggagcuggaacucuggccacgaauggguuaccgauuuuaaggggaagaccgugugguucguccccuccaucaaagccggaaacgacauugccgcuugccuuagaaagaauggcaaaaaggugauccagcugagccgcaaaacauuugauucugaguacguuaagacccgggccaacgacugggauuucguggucacaaccgacauuagcgagaugggggcgaauuuuaaggcugaaagagugaucgauccucgccgguguaugaaaccggugauucugacggacggagaggaaagagucauccucgccggccccaugccuguuacacauuccucugccgcucaacgccgggggagaaucggccgcaaccccaagaaugagaacgaccaguauauuuacaugggagaaccucuggagaaugaugaggacugcgcccacuggaaagaagcgaagaugcuucuggauaacaucaauacccccgagggcauuaucccgagcauguucgaaccugagagagaaaaaguggacgccauugauggggaguaccggcuccgcggagaggcuagaaagacauuuguggaccugaugcggcgcggcgaucugcccgucuggcucgccuauaaaguggcugccgaagggaucaacuacgcugacagaaagugguguuucgauggaauuaagaauaaccagauccuugaggaaaacauggagguugagaucuggaccaaagaaggcgagcggaagaaacugaagccuagauggcuggacgcccgcauuuauuccgauccccucgcgcugaaagaauuuaaggaguucgccgcugggcggaagucucuuacgcugaaucucaucaccgaaaugggcagacugccuacauucaugacccagaaagcccgcaacgcucuggacaaucucgccgugcuucauacagccgaggcuggaggccgggcguacaaccacgcccugagcgagcugcccgaaacccucgagacacugcuucugcucacccugcuggcuacggucacagggggaauuuuucucuuccuuauguccggcaaggggaucggaaaaaugacccugggcaugugcugcauuaucaccgccagcauccugcucugguaugcccaaauucagccgcacuggaucgcugccucuauuauccuggaauuuuuccuuauugugcugcucaucccugagcccgaaaagcagagaacaccccaggauaaucaacugaccuacguugugaucgcgauucugacagucguggccgcuacgauggccaacgagaugggcuuucucgagaaaaccaagaaggaccuugggcugggauccaucacaauucaggaaagcgaguccaauauccuggacauugaucuccggccugcuucugccuggacccuguaugcggucgccacaaccuucgugacgccgaugcuucgccauagcaucgaaaacuccucuguuaaugugagccugaccgcuauugccaaccaggcuacagugcucaugggccuggggaaaggauggccccuguccaagauggacaucggcgucccucuccuugccaucggguguuacagccagguuaaucccauuacccugacagcugcccugcuccugcuuguggcgcacuacgccaucauuggaccuggccugcaagcuaaagccaccagagaggcucagaagcgggccgccgcgggcaucaugaaaaaccccacgguggaugggauuacagucaucgaccucgaaccuaucccguaugaucccaaguuugagaagcagcugggacaggugaugcugcucauucuuugcguuacccaagugcugaugaugcgcacaaccugggcucugugugaggcccucacccuggcuacaggcccuaucucuacgcuuugggaagggaaucccggaagauucuggaacaccacaauugccgucuccauggccaauaucuuucggggcagcuaccuggcuggggccggacuccuguucucuauuaugaaaaacaccacaaauacccgcagaggcacgggcaacaucggggagacacugggagaaaaguggaaaucccggcucaacgcgcuuggcaagagcgaguuucagaucuauaaaaagucugggauucaggagguggaccgcacccuggccaaagaaggaaucaagagaggcgagaccgaucaucacgcugucagccggggguccgccaagcugagaugguucguggaacgcaauaugguuacaccugagggaaaaguggucgaccucggcugcggcagagggggauggucuuacuauuguggcgggcugaagaacgugcgggaaguuaaaggacuuaccaagggcgggcccggacaugaggagccgauuccuaugagcacauacggcuggaaucuggugcgccuccaauccggcgucgauguguuuuucacgccgcccgaaaaaugcgacacccugcugugugauaucggggagagcuccccuaaccccacaauugaagcuggacggacccucagagugcuuaaucugguugagaacuggcugaauaacaauacacaguucugcaucaagguccucaacccuuauaugccgucugugaucgaaaagauggaggcccugcagcgcaaauacggcggggcgcuugugcggaauccccugagcagaaacuccacccacgagauguacugggucucuaaugccacgggaaacauuguuagcuccgugaauaugaucucucgcaugcucauuaaccgguuuaccaugaagcacaaaaaggcuacauaugaaccugacguggaucugggcagcgggaccagaaacaucggaauugaguccgaaauccccaaucuggacauuaucggcaaacgcaucgagaagauuaagcaggaacaugagacaagcuggcacuacgaccaagaucauccuuauaaaaccugggccuaccacggcucuuaugagacaaagcagaccggguccgcuagcucuauggucaacggagugguucggcuccuuacgaaacccugggacguggucccgauggugacacagauggccaugaccgauaccacaccuuucggccagcaaagaguuuuuaaggaaaaaguggacacgcgcacccaggagcccaaggaagggacaaagaaacugaugaagaucaccgcugaguggcuguggaaagagcucggaaagaaaaagacaccuagaauguguacccgggaagaguucacacgcaaagucagauccaaugccgcgcugggcgccauuuuuaccgaugaaaacaaguggaaaagcgcucgggaggccguggaagacgggagauucugggagcuuguggaucgggagcgcaaucugcaccucgaaggaaaaugcgagacgugugucuacaacaugaugggcaagagagagaagaagcugggcgaguuugggaaagcuaagggaucucgggccaucugguauauguggcugggcgcccgcuuccucgaauuugaggcgcugggguuccuuaaugaggaccauugguuuuccagaggaaacagccuguccggcguugaaggggagggccuccaccggcugggauacauucuucgcgaugugggcaagaaagaagggggagugauguacgcugacgauaccgccggcugggacacaagaaucacccuggaggaccucaagaaugaagaacuggucacaaaccauaugaaaggggagcacaagaaacuggccgaagcuaucuucaagcucaccuaucagaauaaggugguucgggugcagcgccccacgccuagaggaacagucauggauauuaucagccggcgcgaccaaagaggcucuggacaggugggcaccuacggacugaacacauuuaccaauauggaggcccagcuuauucggcaaauggaaggcgaggggaucuucaaaagcauucagcaucugacggcuaccgaggaaaucgccguucagaacuggcucgcgcgcgugggaagagagcggcuguccagaauggccaucucuggcgaugacugcgucgugaagcccauugaugaccgcuucgcuagcgcccuuacagcucugaaugauauggggaaaguucggaaggacauccagcaaugggaaccguccagaggauggaacgauuggacccaggugccuuuuugcucucaccacuuccaugagcucgucaugaaagacggccgcgugcuggucgugcccugucggaaccaggaugaacugauugggagagcccgcaucagccagggcgcgggauggucccucaaggagacagccugccugggcaagucuuaugcucaaauguggacccuuauguacuuucaccggagagaccugcgccucgccgcuaaugccauuuguagcgcuguucccucccauugggugccuacaagccggaccacguggucuauccacgccaaacacgaguggaugacaaccgaagauaugcuggcggucuggaacagaguguggauucaggagaauccguggauggaagacaagacccccguggaguccugggaagagguuccuuaucuugggaaacgcgaggaccaguggugcggaagccugaucggccucacaucucgggccaccugggcuaagaacauccagacagccauuaaucaagugagaucccugaucgggaacgaagaguacacggauuauaugcccagcaugaaacgguucagacgcgaagaggaagaggccggaguccugugguga

SEQ ID NO: 19819 - RNA, 9876 nt, Artificial Sequence
  derived and/or modified CDS sequence (opt5) from DENV-2__EU482684__SS-prME
acagccggcgugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccaccauccucgcuuacaccauuggaacaacgcacuuucagagagcccugaucuucauucuucugaccgcugucgccccuagcaugacaaugcggugcaucggcauuuccaaccgcgauuuuguggaagggguuucuggaggcagcuggguggacaucguccucgagcacggguccugugugaccacaauggcgaagaauaagcccacccuggauuucgaacuuaucaaaacggaggccaagcagccugcuacacugagaaaauauugcauugaagccaagcucaccaacaccacaaccgagagccgguguccgacacaaggagagcccucucugaaugaagaacaggacaaacgcuuuaucugcaagcauuccaugguggauagaggcuggggcaacggguguggacuguucggcaaaggcgggauugucacgugcgcuauguuuaccugcaaaaagaauauggaagggaaaguugugcagccugagaaccucgaauacacaaucgugauuacaccccacagcggggaggagcaugccgucggaaaugacacaggcaagcacggcaaagaaaucaagaucaccccucagucuuccauuacggaggcggaacugaccggguauggaacagugaccauggaguguagcccccggacaggccuugauuucaacgaaaugguucugcuccaaauggaggacaaagccuggcuggugcaccgccagugguuucuugaucugccgcucccuuggcugcccggggcugacacccagggaucuaauuggauccagaaggagacgcuggucacauucaagaacccucaugccaaaaagcaagacgugguugugcucggcucccaggaaggggcuaugcacaccgcccugacaggcgccaccgagauucagaugagcuccggaaaucuucuguuuaccggccaucucaaaugcagacugcggauggauaaacuucaacugaaagggaugucuuacagcauguguacaggaaaguucaagaucgucaaagaaauugcugagacgcagcacggcaccaucgugaucagaguccaguaugagggggacggaucccccugcaagauucccuucgaaaucacagaucucgagaaacgccaugugcugggccggcugauuaccguuaacccuaucgugacagaaaaggacagcccggucaacauugaggcggaacccccuuuuggggauucuuacaucauuaucggcguggagcccggacagcucaaacugaauugguucaagaagggcuccagcaucgggcaaauguuugagaccacgaugagaggagccaaacgcauggcuauucuuggcgacacagccugggauuucgggucucugggaggcguuuuuaccagcaucgggaaggcccuccaccagguguucggcgcuauuuacggagccgcguuuuccggcgucucuuggaccaugaaaauccugauuggggugaucaucacauggauuggaaugaacagccgguccaccagccugucugugucccuuguucucgucggcguggugacacuguaucugggggcugucgugcaggccgacagcggauguguugugucuuggaagaauaaagaacucaagugcggcuccgggaucuucauuacggauaacguccacaccuggacagagcaguacaaguuucaaccugaaagccccuccaaacuggccucugcuauccagaaggcccaugaggaaggcauuuguggaaucagaagcgugacccgccuugagaaucugauguggaaacagaucacaccggagcucaaccacauucuguccgaaaaugagguuaagcugaccaucaugacgggcgacauuaaagggaucaugcaggcuggaaagcggucucuuagaccucaacccaccgaacucaaauauagcuggaagacauggggcaaggccaaaaugcuguccaccgagagccauaaccagacauuccugauugaugggccugaaaccgcggagugccccaauacaaaccgcgccuggaacucucucgagguggaagacuacggauuuggcgucuucaccacgaacaucuggcugaaacuucgggagaaacaggacguguuuugugauuccaagcugaugagcgcugccaucaaagacaauagagcuguucacgccgauaugggcuauuggauugaaucugcgcucaacgacacauggaagauggagaaggccuccuucaucgaggugaaaagcugccacuggccuaagucucauacccuguggagcaaugggguccuggaauccgagaugauuauccccaaaaacuucgcuggaccggugagccagcacaacuaccgcccuggcuaucauacccaaacagccgggcccuggcaccuuggaaagcucgaaauggauuuugacuucugugagggcaccacgguggucguuacagaagauugcgggaaucggggacccucucugagaaccacaaccgcuuccggcaaacugauuacagaguggugcugucggagcugcacccucccuccgcugcgcuacagaggcgaggacggguguugguacggaauggaaauccggccccuuaaggagaaggaagagaaccuggugaauagccucgugacggccggccaugggcagauugauaacuuuucucugggaguccugggcauggcccuuuuccucgaagagaugcugagaacccgcaucgggacaaaacacgcuauccugcucguggcgguuagcuuugugacccugauuacaggaaauauguccuuccgggaccuuggcagagucauggugaugguuggcgccaccaugacggaugacaucgggaugggagugacauaucuggcucuccuggccgccuuuaagguccgcccuaccuucgcugccggccugcuucugagaaaacucacaucuaaggagcugaugauggcgaccauugggaucgcucuccugagccaguccaccauucccgaaacaauccuugagcugacggaugcccucgcccugggaaugauggugcugaaaaucguucggaacauggaaaaguaccaacuugcugugaccauuauggccaucucuugcgucccuaaugcggugauucugcagaacgcuuggaaggugagcuguacaauccucgccgccgucuccguuagcccccugcuccugaccucuucccagcagaaagcugacuggauuccucuugcccugacaaucaagggccucaaucccaccgcuaucuuucugacgacacugagccgcaccucuaaaaagagauccuggccgcuuaacgaggccauuauggcgguggggauggugagcauccuggccucuucccuccugaaaaaugacauuccuaugaccggaccccucgucgcuggcggccugcuuacagugugcuauguucugaccgggcggagcgccgaucuggaacucgagcgcgcugccgacgugaagugggaggaucaagccgaaaucuccggaagcucuccuauucugagcaucacaauuuccgaggacggcucuaugagcaucaaaaacgaagaggaggaacagacgcuuaccauccugauuagaacagggcuccuggucaucuccggaguguuccccguuucuauuccgaucaccgcugcggccugguaccucugggaggugaagaagcagcgggcuggcguccugugggaugugccuucucccccucccgucgaaaaagccgagcuugaagacggggccuaucgcauuaagcagagaggaauccugggcuacucccaaaucggcgcugggguguauaaagagggaacauuucacaccauguggcauguuacgcggggcgccgugcugaugcaccgcgggaagagaauugagcccuccugggcggaugucaaaaaggaccucaucagcuacggaggcggguggaagcuggaaggagaguggaaagaaggcgaggaagugcagguucuugcucuggagccuggcaagaauccgcgggccgugcagaccaaacccgggauuuucaagacaaacaccggaacaaucggcgccgucucccucgauuuuagcccugggaccucuggaucccccauuguggacagaaaaggcaaggugguugggcuguacggaaauggcgucgugacacgcagcggcgcuuaugugucugccaucgcgcagacggagaaguccaucgaagauaacccugagauugaagacgauaucuuccggaaaaagagacucaccauuauggaccugcaucccggggcuggaaaaacaaagcgcuaccuuccugccaucguccgggaggccauuaaaagaggccugcgcacccugauccucgcuccgacccgggugguugccgcugaaauggaggaggcccugagagggcuucccauucgcuaucaaaccccugcgaucaagacggaacacaccggacgggagaucguggaccugaugugucaugccacauucaccaugagacuccugagccccguccgggugccuaacuacaaucucauuaucauggaugaagcucacuuuacagaccccgccuccauugcugcccgcggcuauaucucuaccagaguugagaugggggaggccgcuggcauuuucaugacggcgacaccgccuggaagccgggaucccuuuccccaguccaacgccccuaucauggacgaagaaagagaaauccccgagagaagcuggaacucuggccacgaaugggugaccgauuucaaggggaaaaccgucugguuugugccuuccauuaaggcuggaaacgacaucgccgccugccugcggaaaaauggcaagaaaguuauucagcuuagcagaaagacauucgauucugaguacgugaagacccgcgcuaacgacugggauuuugucgugacaaccgacaucagcgagaugggggccaauuucaaagcggaacgggugauugauccgagacgcuguaugaagcccgucauccugacggacggagaggaacggguuauccuggcuggcccuaugcccgugacacauuccucugccgcccaaagacgcgggcggauuggcagaaacccuaaaaaugagaacgaccaguauaucuacaugggagaaccccucgagaaugaugaggacugcgcucacuggaaggaagccaaaaugcugcuugauaacauuaauaccccggagggcaucauuccuagcauguuugaacccgagcgcgaaaagguggacgcgaucgauggggaguacagacugcggggagaggcccgcaaaacauucgucgaccucaugagacggggcgaucugccuguguggcuggcuuauaagguugccgcugaagggauuaacuacgccgaccgcaagugguguuuugauggaaucaaaaauaaccagauccucgaggaaaacauggagguggagauuuggaccaaggaaggcgagcgcaagaaacuuaaaccccgguggcuggacgcuagaaucuauuccgauccucuggcccucaaggaguucaaggaguucgcggccgggcgcaaaucucugacgcuuaaucugauuaccgaaaugggccggcuccccacauuuaugacccagaaggcuagaaacgcccuggacaaucuggcuguccuccauacagccgaggccggaggccgcgcuuacaaccacgcgcuuagcgagcugccggaaacccuggagacacuccugcuucugacccuccuggccacggugacagggggaaucuuccuguuucucauguccggcaaagggauuggaaagaugacccuuggcaugugcugcaucaucaccgcuagcauucugcugugguaugcccaaauccagccucacuggauugccgcuucuaucauucucgaguucuuucugaucguucuucugauccccgagcccgaaaaacagcggacaccucaggauaaucaacucaccuacguggucauugccauccugacaguggucgcggccacgauggcuaacgagaugggcuuccuggagaagaccaagaaagaccucgggcuuggauccauuacaacccaggaaagcgaguccaauauccuggacauugaucugagaccggccucugcuuggacacucuaugccguggcgaccacguuuguuacccccaugcugcggcauagcaucgaaaacuccucugugaaugugagccuuacagccauugcuaaccaggccaccguccugaugggccucgggaagggauggccucuguccaaaauggacaucggcguuccccugcucgcuaucggguguuacagccaggugaauccuauuacacuuaccgccgcucugcugcuccugguggcccacuacgcgaucauuggacccggccuucaagccaaggcuacgcgcgaggcccagaaaagagcugccgccggcaucaugaagaacccuacagucgaugggauuaccgugaucgaccuggaaccgauccccuaugauccuaaguucgagaaacagcucggacagguuaugcugcugauucucugcgugacacaaguccuuaugaugcggaccaccugggcgcugugugaggcucugacacucgccacgggccccaucucuacccugugggaagggaauccuggacgcuuuuggaacacaaccauugcuguguccauggccaauaucuucagaggcagcuaccuugccggggcuggacugcucuuuucuauuaugaagaacacaaccuccacgcggcgcggcacaggcaauaucggggagacccugggagaaaaauggaaaagcagacugaacgcccucggcaaaucugaguuccagaucuauaagaaaagcgggauucaggaggucgaccggacccuugcgaaggaaggaaucaagcgcggcgagacagaucaucacgccguguccagagggucugcuaaacugcggugguuuguugaaagaaacauggugacccccgagggaaaggucguggaccugggcugcggccgcgggggauggagcuacuauuguggcgggcucaaaaauguucgggaagugaagggacugacaaaaggcgggccgggacaugaggagccuauucccauguccacguacggcuggaaccuugucagacugcaaagcggcguggauguguucuucacacccccugaaaagugcgacacccuccugugugauaucggggaguccucucccaauccuaccauugaagccggacgcacacugcggguucucaaccuugucgagaauuggcugaacaauaacacccaguuuugcaucaaggugcugaauccguauaugcccagcgugaucgagaagauggaggcucuccagagacaguacggcggggcccugguccgcaacccucuuuccagaaauucuacgcacgagauguacuggguuagcaacgcgaccggaaauauuguguccucugugaacaugaucagcagaaugcugauuaaucgcuucacaaugaagcacaaaaaggccaccuaugaacccgacgucgaucucggcuccgggacacggaacaucggaauugagagcgaaaucccuaaccuggacauuaucggcaaaagaaucgagaagauuaagcaagaacaugagaucucuuggcacuacgaccaggaucaucccuauaaaaccugggcuuaccacggcuccuaugagacaaagcagaccgggagcgccucuuccauggugaauggaguugugcgccugcucacgaaaccgugggacgucgugccuaugguuacacagauggcuaugaccgauaccacacccuuuggccaacagcggguguucaaggaaaaagucgacacgagaacccaggagccuaaggaagggacaaagaaacuuaugaagauuaccgccgaguggcuguggaaagagcugggaaagaaaaagacaccccgcauguguaccagagaagaguuuaccaagaaggugcggagcaacgcugcccucggcgcgaucuucaccgaugaaaauaaguggaaaucugcccgcgaggcuguggaagacgggagauuuugggagcuggucgaucgggagagaaaccuucaccuggaaggaaagugcgagacguguguuuacaauaugaugggcaaacgggaaaagaaacucggcgaguucgggaaggccaagggaucccgcgcuauuugguauauguggcugggcgccagauuucuggaguucgaggcccucggguuucugaacgaggaccauugguucagccggggaaauucccuuagcggcguggaaggggagggccugcaccgccucggauacauccugagagaugugggcaaaaaggaagggggagcgauguacgcugacgauaccgccggcugggacacacggaucacccuugaggaccugaaaaacgaagagauggucacaaaucauaugaagggggagcacaaaaagcucgccgaagcuauuuuuaagcugaccuaucagaacaaagugguucgcgugcaaagaccuacgccccggggaacagucauggauaucauuucucgcagagaccagcggggcagcggacaggugggcaccuacggacugaauacauucaccaacauggaggcccaacucauccgccagauggaaggcgaggggauuuucaaguccauccagcaucugacggcuaccgaggaaaucgccguucagaauuggcuugcgagagugggacgggagcgccugucuagaauggccauuagcggcgaugacugcgucgugaaaccgaucgaugaccgguuugcuuccgcccucacagcucugaacgauauggggaagguuagaaaagacauucaacagugggaaccuucucgcggauggaaugauuggacccaggugcccuucugcagccaccacuuucaugagcuugucaugaaggacggccgggugcuggucgugcccuguagaaaccaggaugaacucaucgggcgcgcccggauuucccaaggcgcgggauggucucugaaggagacagccugccugggcaaaagcuaugcucagauguggacccucauguacuuccacagacgcgaccugcggcuugccgcuaacgccaucuguuccgcuguuccuagccauugggugccgacaucuagaaccacgugguccauucacgccaagcacgaguggaugacaaccgaagauaugcuggcggucuggaaucgcguguggauccaggagaaccccuggauggaagacaaaaccccuguggagagcugggaagagguucccuaucucgggaagcgggaggaccaguggugcggaucucugaucggccuuacauccagagccaccugggcuaaaaauauucaaacagccaucaaccaggugcgcagccugauugggaaugaagaguacacggauuauaugccuuccaugaagcgguuuagacgggaagaggaagaggccggaguccucugguga

SEQ ID NO: 19820 - RNA, 9876 nt, Artificial Sequence
  derived and/or modified CDS sequence (opt5) from DENV-2__EU482685__SS-prME
accgccggcgugaucgucaugcugauucccaccgcuauggccuuccaccucacgaccagaaauggggagccucauaugaucguuggacggcaggaaaagggcaagagccugcuuuuuaagaccgaggacggggugaauaugugcacccugauggcgauugaucucggagaacugugugaggacacgaucaccuacaagugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggcaacgggcagauugauaauuuuucucugggaguccugggcauggcucuuuuccucgaagagaugcugagaacgcgcaucgggaccaaacaugcgauccugcucguggccguuagcuuugugacacugauuaccggaaacauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaauauggaaaaguaccaacuugccgugacgauuauggcgaucucuugcgucccuaacgcugugauucugcagaaugccuggaaggugagcuguaccauccucgccgcugucuccguuagcccccugcuccugacaucuucccagcagaaagccgacuggauuccucuugcucugaccaucaagggccucaaccccacagccaucuuucugaccacgcugagccgcacaucuaaaaagagauccuggccgcuuaaugaggcgauuauggccguggggauggugagcauccuggcuucuucccuccugaaaaacgacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaaugaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcacguuacccggggcgcggugcugaugcaucgcgggaagagaauugagcccuccugggcugaugucaaaaaggaccucaucagcuacggaggcggguggaagcuggaaggagaguggaaagaaggcgaggaagugcagguucuugcccuggagccuggcaagaacccgcgggccgugcagacgaaacccgggauuuucaagaccaauacaggaaccaucggcgcugucucccucgauuuuagcccugggacaucuggaucccccauuguggacagaaaaggcaaggugguugggcuguacggaaacggcgucgugacccgcagcggcgccuaugugucugcgaucgcucagacagagaaguccaucgaagauaacccugagauugaagacgauaucuuccggaaaaagagacucacgauuauggaccugcaccccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacauacgggacgggagaucguggaccugaugugucacgcuaccuucacaaugagacuccugagccccguccgggugccuaauuacaaccucauuaucauggaugaagcccauuuuaccgaccccgcuuccauugccgcccgcggcuauaucucuacaagaguugagaugggggaggcugcgggcauuuucaugaccgccacgccgccuggaagccgggaucccuuuccccaguccaaugcuccuaucauggacgaagaaagagaaauccccgagagaagcuggaacucuggccacgaaugggugacagauuucaaggggaaaaccgucugguuugugccuuccauuaaggccggaaaugacaucgccgcuugccugcggaaaaacggcaagaaaguuauucagcuuagcagaaagaccuucgauucugaguacgugaagacacgcgccaaugacugggauuuugucgugaccacagacaucagcgagaugggggcgaacuucaaagcugaacgggugauugauccgagacgcuguaugaagcccgucauccugaccgacggagaggaacggguuauccuggccggcccuaugcccgugacgcacuccucugccgcucaaagacgcgggcggauuggcagaaauccuaaaaacgagaaugaccaguauaucuacaugggagaaccccucgagaacgaugaggacugcgcccauuggaaggaagcgaaaaugcugcuugauaauauuaacacaccggagggcaucauuccuagcauguuugaacccgagcgcgaaaagguggacgccaucgauggggaguacagacugcggggagaggcucgcaaaaccuucgucgaccucaugagacggggcgaucugccuguguggcuggccuauaagguugcugccgaagggauuaauuacgcugaccgcaagugguguuuugauggaaucaaaaacaaccagauccucgaggaaaauauggagguggagauuuggacaaaggaaggcgagcgcaagaaacuuaaaccccgguggcuggacgccagaaucuauuccgauccucuggcgcucaaggaguucaaggaguucgccgcugggcgcaaaucucugacccuuaaccugauuacggaaaugggccggcuccccaccuuuaugacacagaaggccagaaaugcucuggacaaccuggccguccuccacaccgccgaggcuggaggccgcgcguacaaucaugcccuuagcgagcugccggaaacacuggagacccuccugcuucugacacuccuggcuaccgugacagggggaaucuuccuguuucucauguccggcaaagggauuggaaagaugacacuuggcaugugcugcaucaucaccgccagcauucugcugugguaugcccaaauccagccucacuggauugcugccucuaucauucucgaguucuuucugaucguucuucugauccccgagcccgaaaaacagcggaccccucaggauaaccaacucacauacguggucauugcgauccugaccguggucgccgcuacaauggccaaugagaugggcuuccuggagaagacgaagaaagaccucgggcuuggauccauuaccacacaggaaagcgaguccaacauccuggacauugaucugagaccggcuucugccuggacccucuaugcgguggccacaaccuuuguuacgcccaugcugcggcacagcaucgaaaauuccucugugaacgugagccuuaccgcuauugccaaucaggcuacaguccugaugggccucgggaagggauggccucuguccaaaauggacaucggcguuccccugcucgccaucggguguuacagccaggugaacccuauuacccuuacagcugcccugcugcuccugguggcgcauuacgccaucauuggacccggccuucaagcuaaggccacccgcgaggcucagaaaagagccgccgcgggcaucaugaagaauccuacggucgaugggauuacagugaucgaccuggaaccgauccccuaugauccuaaguucgagaaacagcucggacagguuaugcugcugauucucugcgugacccaaguccuuaugaugcggacaaccugggcucugugugaggcccugacccucgcuacaggccccaucucuacgcugugggaagggaacccuggacgcuuuuggaauaccacaauugccguguccauggccaacaucuucagaggcagcuaccuugcuggggccggacugcucuuuucuauuaugaagaauaccacauccacccggcgcggcacgggcaacaucggggagacacugggagaaaaauggaaaagcagacugaacgcgcucggcaaaucugaguuccagaucuauaagaaaagcgggauucaggaggucgaccggacccuugccaaggaaggaaucaagcgcggcgagaccgaucaccaugcuguguccagagggucugccaaacugcggugguuuguugaaagaaauauggugacacccgagggaaaggucguggaccugggcugcggccgcgggggauggagcuacuauuguggcgggcucaaaaacguucggcaagugaagggacugaccaaaggcgggccgggacacgaagaaccuauucccauguccacauacggcuggaaucuugucagacugcagagcggcguggauguguucuucacgcccccugagaagugcgacacccuccugugugauaucggggaauccucucccaacccuacaauugaggcuggacgcacccugcggguucucaaucuugucgaaaacuggcugaauaacaauacacaguuuugcaucaaggugcugaacccguauaugcccagcgugaucgagaaaauggaagcccuccagagacaauacggcggggcgcugguccgcaauccucuuucccggaacucuacccaugagauguacuggguuagcaaugccacgggaaacauuguguccucugugaauaugaucagcagaaugcugauuaaccgcuucaccaugaagcacaaaaaggcuacauaugagcccgacgucgaucucggcuccgggacccggaacaucggaauugaaagcgagaucccuaaucuggacauuaucggcaaaagaaucgaaaagauuaagcaggagcacgaaaucucuuggcauuacgaccaggaucaccccuauaaaacaugggccuaccauggcuccuaugagaccaagcagacagggagcgcuucuuccauggugaacggaguugugcgccugcucaccaaaccgugggacgucgugccuaugguuacgcaaauggccaugacagauaccacccccuuuggccagcagcggguguucaaggagaaagucgacacaagaacgcaggaaccuaaggaggggaccaagaaacuuaugaagauuacagcugaauggcuguggaaagagcugggaaagaaaaagacaccccgcauguguacaagagaggaauuuaccaaaaaggugcggagcaaugccgcgcucggcgccaucuucacagaugagaacaaguggaaaucugcucgcgaagccguggaggacgggagauuuugggaacuggucgaucgggagagaaaucuucaccuggagggaaagugcgaaaccuguguuuacaacaugaugggcaaacgggagaagaaacucggcgaguucgggaaggcuaagggaucccgcgccauuugguauauguggcugggcgccagauuucuggaguucgaagcgcucggguuucugaaugaggaccacugguucagccggggaaacucccuuagcggcguggagggggaaggccugcaucgccucggauacauccugagagaugugggcaaaaaggaagggggagcuauguacgccgacgauacggccggcugggacacccggaucacacuugaagaccugaaaaaugaggaaauggucaccaaccacaugaagggggagcauaaaaagcucgcugaggccauuuuuaagcugacauaucaaaauaaagugguucgcgugcagagaccuacaccccggggaacggucauggauaucauuucucgcagagaccagcggggcagcgggcaagugggcacauacggacugaacaccuucacaaauauggaagcucagcucauccgccagauggagggcgaagggauuuucaaguccauccagcaccugaccgccacggaggagaucgcgguucaaaacuggcuugccagagugggacgggaacgccugucuagaauggcuauuagcggcgaugacugcgucgugaaaccgaucgaugaccgguuugccuccgcucucaccgcccugaaugauauggggaagguuagaaaagacauucagcagugggagccuucucgcggauggaacgauuggacacaggugcccuucugcagccaucacuuucacgaacuugucaugaaggacggccgggugcuggucgugcccuguagaaaccaagaugagcucaucgggcgcgcgcggauuucccagggcgccggauggucucugaaggaaaccgcuugccugggcaaaagcuaugcccagauguggacacucauguacuuccauagacgcgaccugcggcuugcugccaaugcuaucuguuccgccguuccuagccacugggugccgaccucuagaacaaccugguccauucaugcgaagcacgaguggaugacgacagaggauaugcuggccgucuggaaccgcguguggauccaggaaaaucccuggauggaggacaaaaccccuguggaaagcugggaggaaguucccuaucucgggaagcgggaggaccaauggugcggaucucugaucggccuuaccuccagagcuacaugggccaaaaacauucagaccgccaucaaucaggugcgcagccugauugggaacgaggaauacacagauuauaugccuuccaugaagcgguuuagacgggaggaagaggaagcuggaguccucugguga

SEQ ID NO: 19821 - RNA, 9876 nt, Artificial Sequence
  derived and/or modified CDS sequence (opt5) from DENV-2__EU482687__SS-prME
accgccggcgugaucgucaugcugauucccaccgcuauggccuuccaccucacgacccggaauggggaaccucauaugaucguuggacggcaggaaaagggcaagagccugcuuuuuaagaccgaagacggggugaauaugugcacccugauggcgauugaucucggagaacugugugaagacacgaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuguccucgccuacaccaucggaaccacacacuuucagagagcucugauuuucgugcuucugacggccguugcgccuagcaugaccaugcggugcaucggcauuuccaaccgcgauuuuguggaaggggucucuggaggcagcuggguggacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuaucugcaagcauuccaugguugauagaggcuggggcaacggguguggacuguucggcaaaggcgggauugugacaugcgccauguuuacgugcaaaaagaauauggaagggaaagugguccagccugagaaccucgaauacaccaucgugauuacaccccacagcggggaggagcaugcgguuggaaaugacaccggcaagcacggcaaagaaaucaagauuacaccucagucuuccaucaccgaggccgaacugacgggguauggaaccgugacaauggaguguagcccccggaccggccuugauuucaacgaaaugguccugcuccaaauggaggacaaggcuuggcuggugcaccgccagugguuucuugaucugccgcucccuuggcugcccggggccgacacacagggaucuaauuggauccagaaggagacccugguuacguucaagaacccucaugcuaaaaagcaagacguggucgugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugauuagaguucaguaugagggggacggaucccccugcaagauccccuucgaaaucaccgaucucgagaaacgccaugugcugggccggcugauuacagucaacccuaucgugaccgaaaaggacagcccgguuaacauugaggccgaacccccuuuuggggauucuuacaucauuaucggcguggagcccggacagcucaaacugaauugguucaagaagggcuccagcauugggcaaauguuugagacaaccaugagaggagcuaaacgcauggccauccuuggcgacacggccugggauuucgggucucugggaggcgucuuuacaagcaucgggaaggcucuccaccagguguucggcgccauuuacggagcggcuuuuuccggcgugucuuggaccaugaaaauccugauugggguuaucauuaccuggaucggaaugaacagccgguccacaagccugucugucucccuugugcucgugggcgucgugacccuguaucugggggccguugugcaggccgacagcggaugugucgugucuuggaagaauaaagaacucaagugcggcuccgggaucuucauuacagauaacguucacacguggaccgagcaguacaaguuucaaccugaaagccccuccaaacuggcuucugccauccagaaggcucaugaggaaggcauuuguggaaucagaagcgugacacgccuugagaaucugauguggaaacagauuaccccggagcucaaccacauccuguccgaaaaugaggucaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucaucgaggugaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugacuucugugagggcacaaccguuguggugacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggucaauucccucgugaccgccggccaugggcagauugauaacuuuucucugggaguucugggcauggcucuuuuccucgaagagaugcugagaacgcgcaucgggaccaaacacgcgauucugcucguggccgucagcuuugugacacugaucaccggaaauauguccuuccgggaccuuggcagaguuauggugauggucggcgcuacaaugaccgaugacaucgggaugggagugacguaucuggcccuccuggccgcuuuuaagguucgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaauuguccggaacauggaaaaguaccaacuugccgugacgaucauggcgaucucuugcgugccuaaugcugucauucugcagaacgccuggaagguuagcuguaccauccucgccgcuguguccgugagcccccugcuccugacaucuucccagcagaaagccgacuggauuccucuugcucugaccaucaagggccucaaucccacagccauuuuucugaccacgcugagccgcacaucuaaaaagagauccuggccgcuuaacgaggcgaucauggccgucgggauggugagcauccuggcuucuucccuccugaaaaaugacauuccuaugaccggaccccucguugccggcggccugcuuaccgugugcuauguccugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauucugaucagaaccgggcuccugguuaucuccggaguguuccccgucucuauuccgaucacagcggccgcuugguaccucugggaggugaagaagcagcgggccggcguccugugggaugugccuucucccccucccguugaaaaagccgagcuugaagacggggcuuaucgcauuaagcagagaggaauccugggcuacucccaaauuggcgccgggguguauaaagagggaaccuuucacacaauguggcaugucacccggggcgcggugcugaugcaccgcgggaagagaaucgagcccuccugggcugauguuaaaaaggaccucaucagcuacggaggcggguggaagcuggaaggagaguggaaagaaggcgaggaagugcagguccuugcccuggagccuggcaagaauccgcgggccgugcagacgaaacccgggauuuucaagaccaacacaggaaccaucggcgcugugucccucgauuuuagcccugggacaucuggaucccccauuguugacagaaaaggcaaggucguggggcuguacggaaauggcguggucacccgcagcggcgccuaugugucugcgaucgcucagacagagaaguccauugaagauaacccugagaucgaagacgauaucuuccggaaaaagagacucacgauuauggaccugcaucccggggccggaaaaaccaagcgcuaccuuccugccaucguucgggaggcuauuaaaagaggccugcgcacacugauccucgccccgacccggguggucgcugccgaaauggaggaggcgcugagagggcuucccauucgcuaucaaaccccugccaucaagacagaacacacgggacgggagauuguggaccugaugugucaugcuaccuucacaaugagacuccugagccccguucgggugccuaacuacaaucucaucaucauggaugaagcccacuuuaccgaccccgcuuccauugccgcccgcggcuauaucucuacaagagucgagaugggggaggcugcgggcauuuucaugaccgccacgccgccuggaagccgggaucccuuuccccaguccaacgcuccuaucauggacgaagaaagagaaauucccgagagaagcuggaacucuggccacgaaugggugacagauuucaaggggaaaaccguuugguuugugccuuccaucaaggccggaaacgacaucgccgcuugccugcggaaaaauggcaagaaagucauucagcuuagcagaaagaccuucgauucugaguacgugaagacacgcgccaacgacugggauuuuguggucaccacagacaucagcgagaugggggcgaauuucaaagcugaacggguuauugauccgagacgcuguaugaagcccgugauccugaccgacggagaggaacgggugauucuggccggcccuaugcccgucacgcauuccucugccgcucaaagacgcgggcggaucggcagaaacccuaaaaaugagaacgaccaguauaucuacaugggagaaccccucgagaaugaugaggacugcgcccacuggaaggaagcgaaaaugcugcuugauaacauuaauacaccggagggcaucauuccuagcauguuugaacccgagcgcgaaaagguggacgccaucgauggggaguacagacugcggggagaggcucgcaaaaccuucguugaccucaugagacggggcgaucugccuguguggcuggccuauaaggucgcugccgaagggauuaacuacgcugaccgcaagugguguuuugauggaaucaaaaauaaccagauucucgaggaaaacauggagguggagaucuggacaaaggaaggcgagcgcaagaaacuuaaaccccgguggcuggacgccagaaucuauuccgauccucuggcgcucaaggaguucaaggaguucgccgcugggcgcaaaucucugacccuuaaucugauuacggaaaugggccggcuccccaccuuuaugacacagaaggccagaaacgcucuggacaaucuggccguucuccauaccgccgaggcuggaggccgcgcguacaaccacgcccuuagcgagcugccggaaacacuggagacccuccugcuucugacacuccuggcuaccgugacagggggaaucuuccuguuucucauguccggcaaagggauuggaaagaugacacuuggcaugugcugcaucauuaccgccagcauccugcugugguaugcccaaauccagccucacuggauugcugccucuaucauucucgaguucuuucugaucguccuucugauucccgagcccgaaaaacagcggaccccucaggauaaucaacucacauacguggucaucgcgauccugaccgugguugccgcuacaauggccaacgagaugggcuuccuggagaagacgaagaaagaccucgggcuuggauccauuaccacacaggaaagcgaguccaauauccuggacauugaucugagaccggcuucugccuggacccucuaugcgguggccacaaccuuugugacgcccaugcugcggcauagcaucgaaaacuccucugucaauguuagccuuaccgcuauugccaaccaggcuacagugcugaugggccucgggaagggauggccucuguccaaaauggacaucggcgugccccugcucgccauuggguguuacagccaggucaauccuaucacccuuacagcugcccugcugcuccugguggcgcacuacgccaucauuggacccggccuucaagcuaaggccacccgcgaggcucagaaaagagccgccgcgggcaucaugaagaacccuacgguugaugggauuacagugaucgaccuggaaccgauucccuaugauccuaaguucgagaaacagcucggacaggucaugcugcugauccucugcgugacccaaguccuuaugaugcggacaaccugggcucugugugaggcccugacccucgcuacaggccccaucucuacgcugugggaagggaauccuggacgcuuuuggaacaccacaauugccguguccauggccaauaucuucagaggcagcuaccuugcuggggccggacugcucuuuucuauuaugaagaacaccacauccacccggcgcggcacgggcaauaucggggagacacugggagaaaaauggaaaagcagacugaacgcgcucggcaaaucugaguuccagauuuauaagaaaagcgggauccaggagguugaccggacccuugccaaggaaggaaucaagcgcggcgagaccgaucaucacgcuguguccagagggucugccaaacugcggugguuugucgaaagaaacauggugacacccgagggaaagguuguggaccugggcugcggccgcgggggauggagcuacuauuguggcgggcucaaaaauguccgggaagugaagggacugaccaaaggcgggccgggacaugaggagccuauucccauguccacauacggcuggaaccuugugagacugcaaagcggcguugaugucuucuucacgcccccugaaaagugcgacacccuccugugugauaucggggaguccucucccaauccuacaauugaagcuggacgcacccugcgggugcucaaccuuguggagaauuggcugaacaauaacacacaguuuugcaucaagguccugaauccguauaugcccagcguuauugagaagauggaggcccuccagagacaguacggcggggcgcuggugcgcaacccucuuuccagaaauucuacccacgagauguacugggugagcaacgccacgggaaauaucgucuccucugugaacaugaucagcagaaugcugauuaaucgcuucaccaugaagcacaaaaaggcuacauaugaacccgacguugaucucggcuccgggacccggaacaucggaauugagagcgaaaucccuaaccuggacauuaucggcaaaagaauugagaagaugaagcaagaacaugagaucucuuggcacuacgaccaggaucaucccuauaaaacaugggccuaccacggcuccuaugagaccaagcagacagggagcgcuucuuccauggugaauggagucgugcgccugcucaccaaaccgugggacguugugccuauggucacgcagauggccaugacagauaccacccccuuuggccaacagcggguguucaaggaaaaaguggacacaagaacgcaggagccuaaggaagggaccaagaaacuuaugaagaucacagcugaguggcuguggaaagagcugggaaagaaaaagacaccccgcauguguacaagagaagaguuuacccggaaaguccgcagcaacgccgcgcucggcgccauuuucacagaugaaaauaaguggaagucugcuagagaggccguugaagacgggcgguuuugggagcugguggauagagagcggaaccuucaccuggaaggaaaaugcgagaccuguguguacaauaugaugggcaagcgcgagaagaagcucggcgaguucgggaaagcuaagggauccagagccaucugguauauguggcugggcgcccgguuucuggaguucgaggcgcucggguuucugaacgaggaccauugguucagccgcggaaauucccuuagcggcgucgaaggggagggccugcacagacucggauacauucugcgggaugugggcaagaaagaagggggagcuauguacgccgacgauacggccggcugggacacccgcaucacacuugaggaccugaagaacgaagagaugguuaccaaucauaugaaaggggagcacaagaaacucgcugaagccauuuuuaagcugacauaucagaacaagguggucagagugcaacggccuacaccccgcggaacgguuauggauaucaucucuagacgggaccagcgcggcagcggacaggugggcacauacggacugaauaccuucacaaacauggaggcucaacucauuagacagauggaaggcgaggggaucuucaaauccauucagcaucugaccgccacggaggaaaucgcgguccagaauuggcuugcccgggugggacgcgagagacugucucggauggcuauuagcggcgaugacugcguugugaagccgaucgaugacagauuugccuccgcucucaccgcccugaacgauauggggaaaguccgcaaggacauccaacagugggaaccuucucggggauggaaugauuggacacaggugcccuucugcagccaccacuuucaugagcuugucaugaaagacggcagagugcugguugugcccugucgcaaccaggaugaacucauugggcgggcgagaaucucccaaggcgccggauggucucugaaggagaccgcuugccugggcaagagcuaugcccagauguggacacucauguacuuccaccgccgggaccugagacuugcugccaacgcuauuuguuccgccgucccuagccauugggugccgaccucucgcacaaccugguccauccacgcgaaacacgaguggaugacgacagaagauaugcuggccguguggaaucggguuuggauucaggagaaccccuggauggaagacaagaccccuguggagagcugggaagagguccccuaucucgggaaaagagaggaccaguggugcggaucucugaucggccuuaccucccgcgcuacaugggccaagaauauucaagccgcuaucaaccaggugcggagccugaucgggaaugaagaguacaccgauuauaugccuuccaugaaaagauuucggagagaagaggaagaggccggaguucucugguga

SEQ ID NO: 19822 - RNA, 9876 nt, Artificial Sequence
  derived and/or modified CDS sequence (opt5) from DENV-2__EU482688__SS-prME
accgccggcgugaucgucaugcugauucccaccgcuauggccuuccaccucacgaccagaaauggggaaccucauaugaucguuggacggcaggaaaagggcaagagccugcuuuuuaagacggaagacggggugaauaugugcacccugauggcgauugaucucggagaacugugugaagacacaaucaccuacaaaugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugauugaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucggggugaucauuaccuggaucggaaugaacagccgguccaccagccugucugugucccuuguucucgucggcguggugacacuguaucugggggccaugguccaggccgacagcggaugugugguuucuuggaagaauaaagaacucaagugcggcuccgggauuuucaucaccgauaacgugcacacauggacggagcaguacaaguuucaaccugaaagccccuccaaacuggcuucugccauucagaaggcucaugaggaaggcaucuguggaaucagaagcgucacccgccuugagaaucugauguggaaacagauuacaccggagcucaaccacauccuguccgaaaaugaggugaagcugaccauuaugacaggcgacauccgggggauuaugcaggccggaaaaagaucucuucgcccucaacccaccgaacucaaguauagcuggaaaacguggggcaaggcgaagaugcuguccaccgagagccauaaccagacauuccugaucgaugggccugaaaccgccgagugccccaauacaaaccgggcuuggaacucucucgagguugaagacuacggauuuggcguguucaccacaaacaucuggcugaaacuuagagagaagcaggacgucuuuugugauuccaaacugaugagcgccgcuauuaaggacaaucgcgccgugcacgcggauaugggcuauuggaucgaaucugcccucaacgacaccuggaaaauggagaaggcuuccuucauugagguuaagagcugccacuggccuaaaucucauacgcuguggagcaauggggugcuggaauccgagaugaucauucccaagaacuucgccggaccggucagccagcacaacuaccggccuggcuaucauacacaaaccgcugggcccuggcaccuuggaaaacucgaaauggauuuugaccugugugagggcaccacagugguggucaccgaagauugcgggaauagaggacccucucugcggacgacaaccgccuccggcaagcucaucacagaguggugcugucgcagcugcacccugccuccgcuuagauaccggggcgaggacggguguugguacggaauggaaauuagaccccugaaagagaaggaagagaaccucguuaauucccuggugacagccggccaugggcagaucgauaacuucucucugggagugcuuggcauggcucucuuucuggaagagaugcugcgcacccggaucgggacgaagcacgcgauucuccuggucgccgugagccuuguuacccugaucacaggaaauauguccuucagagaccucggccgcgugauggucauggugggcgcuaccaugacagaugacauugggaugggaguuaccuaucuggcccugcuugccgcuuuuaaagugagaccuacguucgccgcgggccugcuccugcggaagcucacaucuaaagagcugaugauggcuaccaucgggauugcccuucugagccaguccacaauccccgaaaccauccucgagcugaccgaugcccuggcucuuggaaugaugguccugaagauugugcgcaacauggaaaaauaccaacucgccguuacaaucauggcgauuucuugcgugccuaaugcugucauccugcagaacgccuggaaggugagcuguacgauucucgccgcuguguccgucagcccccugcuucugaccucuucccagcagaaggccgacuggaucccucucgcucugacaaucaaaggccugaaucccaccgccauuuuucuuacaacccugagcagaacgucuaagaaacgguccuggccgcucaacgaggcgaucauggccguugggauggugagcauucuggcuucuucccuccugaagaaugacaucccuaugacaggaccccuuguggccggcggccugcugaccgucugcuaugugcucaccgggcgcagcgcugaucuggaacuugagagagccgccgacguuaaaugggaggaucaagcugaaauuuccggaagcucuccuauccugagcauuacaaucuccgaggacggcucuaugagcaucaagaacgaagaggaggaacagacccucacaauucugauccggacggggcuccuggugauuuccggagucuuccccgugucuaucccgauuaccgcggccgcuugguaccuuugggagguuaaaaagcagcgcgccggcgugcugugggaugucccuucucccccucccguggaaaaggccgagcuggaagacggggcuuauagaaucaaacagcggggaauccucggcuacucccaaauuggcgccggggucuauaaggagggaacauuucacaccauguggcaugugacacgcggcgcgguucugaugcacagagggaaacggaucgagcccuccugggcugaugugaagaaagaccuuauuagcuacggaggcggguggaagcuggaaggagaguggaaggaaggcgaggaaguccaggugcucgcccuggagccuggcaaaaauccgagagccguucagaccaagcccgggaucuucaaaacgaacaccggaacaauuggcgcugugucccucgauuuuagcccugggaccucuggaucccccaucgucgaccgcaagggcaaagugguggggcuguacggaaauggcguugucacacggagcggcgccuaugugucugcgaucgcucagaccgagaaguccauugaagauaacccugagaucgaagacgauauuuucagaaagaaacgccuuacaaucauggaccugcaucccggggccggaaagacgaaacgguaccugccugccauugugagagaggcuaucaagcgcggccuccggacccugauucuugccccgacaagagucguggcugccgaaauggaggaggcgcugcgcgggcuccccauccgguaucaaaccaccgccaucaaaacagaacacacgggaagagagauuguugaccugaugugucaugcuaccuuuacaaugcggcuccugagcccugugcgcguccccaacuacaaucuuaucauuauggaugaagcccacuucaccgacccugcuuccaucgccgccagaggcuauauuucuacacggguggagaugggggaggcugcgggcaucuucaugaccgccacgcccccgggaagccgcgauccuuuuccccaguccaacgcucccaucauggacgaagagagagaaauuccugagcggagcuggaacucuggccacgaauggguuacagauuucaaggggaagaccgugugguuuguccccuccaucaaagccggaaacgacauugccgcuugccugagaaagaauggcaaaaaggugauccagcugagccgcaaaaccuucgauucugaguacguuaagacacgggccaacgacugggauuuuguggucaccacagacauuagcgagaugggggcgaauuucaaggcugaaagagugaucgauccucgccgguguaugaaaccggugauccucaccgacggagaggaaagagucauucuggccggccccaugccuguuacgcauuccucugccgcucaacgccgggggagaaucggccgcaaccccaagaaugagaacgaccaguauauuuacaugggagaaccucuugagaaugaugaggacugcgcccacuggaaagaagcgaagaugcugcucgauaacaucaauacacccgagggcauuaucccgagcauguuugaaccugagagagaaaaaguggacgccauugauggggaguaccggcugcgcggagaggcuagaaagaccuucguggaccugaugcggcgcggcgaucuccccgucuggcuugccuauaaaguggcugccgaagggaucaacuacgcugacagaaagugguguuuugauggaaucaagaauaaccagauucuggaggaaaacauggagguugagaucuggacaaaagaaggcgagcggaagaaacugaagccuagauggcucgacgcccgcauuuauuccgauccccuggcgcuuaaagaguucaaggaguuugccgcugggcggaagucucugacccucaaucugaucacggaaaugggcagacugccuaccuucaugacacagaaagcccgcaacgcucucgacaaucuugccgugcugcauaccgccgaggcuggaggccgggcguacaaccacgcccugagcgagcuccccgaaacacuggagacccuucugcuccugacacugcucgcuaccgucacagggggaauuuuccuuuuucugauguccggcaaggggaucggaaaaaugacacugggcaugugcugcaucauuaccgccagcauccuccugugguaugcccaaauucagccgcacuggaucgcugccucuauuauccuugaguucuuucugaucgugcuccugauuccugagcccgaaaagcagagaacaccccaggauaaucaacugacauacguugugaucgcgauucucaccgucguggccgcuacaauggccaacgagaugggcuuccuugagaaaacgaagaaggaccuggggcugggauccaucaccacacaggaaagcgaguccaauauucucgacaucgaucugcggccugcuucugccuggacccuuuaugcggucgccacaaccuuugugacgccgaugcugcgccauagcauugaaaacuccucuguuaaugugagccucaccgcuaucgccaaccaggcuacagugcugaugggccuggggaaaggauggccccucuccaagauggacaucggcgucccucuucuggccauuggguguuacagccagguuaaucccaucacccugacagcugcccuccugcuucugguggcgcacuacgccauuaucggaccuggccuccaagcuaaagccaccagagaggcucagaagcgggccgccgcgggcauuaugaaaaaccccacgguggaugggaucacagucaucgaccuggaaccuauuccguaugaucccaaguucgagaagcagcugggacaggugaugcuccuuauccugugcguuacccaagugcugaugaugcgcacaaccugggcucucugugaggcccugacccuugcuacaggcccuauuucuacgcugugggaagggaaucccggaagauuuuggaacaccacaaucgccgucuccauggccaauauuuuccggggcagcuaccucgcuggggccggacugcuguuuucuaucaugaaaaacaccacaaauacccgcagaggcacgggcaacaucggggagacacucggagaaaaguggaaaucccggcuuaacgcgcugggcaagagcgaguuccagauuuauaaaaagucugggauccaggagguggaccgcacccuggccaaagaaggaauuaagagaggcgagaccgaucaucacgcugucagccggggguccgccaagcucagaugguuuguggaacgcaauaugguuacaccugagggaaaaguggucgaccugggcugcggcagagggggauggucuuacuauuguggcgggcuuaagaacgugcgggaaguuaaaggacugaccaagggcgggcccggacaugaggagccgaucccuaugagcacauacggcuggaaucucgugcgccugcaauccggcauugaugucuucuuuacgccgcccgaaaaaugcgacacccugcucugugauaucggggagagcuccccuaaccccacaaucgaagcuggacggacccuuagagugcugaaucugguggagaacuggcucaauaacaauacacaguucugcauuaagguucugaacccuuauaugccgucugucaucgaaaagauggaggcccuucagcgcaaauacggcggggcgcuggugcggaauccccucagcagaaacuccacccacgagauguacugggugucuaaugccacgggaaacauugucagcuccguuaauaugaucucucgcaugcugauuaaccgguucaccaugaagcacaaaaaggcuacauaugaaccugacguggaucugggcagcgggaccagaaacaucggaauugaguccgaaauccccaaucucgacaucauuggcaaacgcaucgagaagauuaagcaggaacaugagacaagcuggcacuacgaccaagaucauccuuauaaaaccugggccuaccacggcucuuaugagacaaagcagaccggguccgcuagcucuauggugaacggagucgugcggcuucugacgaaacccugggacguugugccgauggucacacagauggccaugaccgauaccacaccuuuuggccagcaaagaguguucaaggaaaaaguugacacgcgcacccaggagcccaaggaagggacaaagaaacugaugaagaucaccgcugaguggcucuggaaagagcugggaaagaaaaagacaccuagaauguguacccgggaagaguuuacacgcaaagugagauccaaugccgcgcuuggcgccauuuucaccgaugaaaacaaguggaaaagcgcucgggaggccgucgaagacgggagauuuugggagcugguggaucgggagcgcaaucuccaccuggaaggaaaaugcgagacguguguguacaacaugaugggcaagagagagaagaagcugggcgaguucgggaaagcuaagggaucucgggccaucugguauauguggcucggcgcccgcuuucuggaguucgaggcgcuuggguuucugaaugaggaccauugguucuccagaggaaacagccucuccggcgucgaaggggagggccugcaccggcuuggauacauccugcgcgauguuggcaagaaagaagggggagcuauguacgccgacgauaccgccggcugggacacaagaauuacccucgaggaccugaagaaugaagagauggugacaaaccauaugaaaggggagcacaagaaacuggcugaagccaucuuuaagcucaccuaucagaauaaggugguccgggugcagcgccccacgccuagaggaacaguuauggauauuaucagccggcgcgaccaaagaggcucuggacaggugggcaccuacggacugaacacauucaccaauauggaggcucagcuuauucggcaaauggaaggcgaggggaucuuuaaaagcauccagcaucugacggccaccgaggaaauugcgguccagaacuggcucgcccgcgugggaagagagcggcuguccagaauggcuaucucuggcgaugacugcguugugaagcccauugaugaccgcuucgccagcgcucuuacagcccugaaugauauggggaaaguccggaaggacauccagcaaugggaaccguccagaggauggaacgauuggacccaggugccuuucugcucucaccacuuucaugagcucguuaugaaagacggccgcgugcuggucgugcccugucggaaccaggaugaacugauugggagagcgcgcaucagccagggcgccggauggucccucaaggagacagcuugccugggcaagucuuaugcccaaauguggacccuuauguacuuccaccggagagaccugcgccucgcugccaaugcuauuuguagcgccguccccucccauugggugccuacaagccggaccacguggucuauccacgcgaaacacgaguggaugacaaccgaagauaugcuggccguuuggaacagaguguggauccaggagaauccguggauggaagacaagacccccgucgaguccugggaagaggugccuuaucuugggaaacgcgaggaccaguggugcggaagcaugauuggccugacaucucgggcuaccugggccaagaacauccagacagccauuaaucaagugagaucccucaucgggaacgaagaguacacggauuauaugcccagcaugaaacgguuuagacgcgaagaggaagaggcuggaguucugugguga

SEQ ID NO: 19823 - RNA, 9876 nt, Artificial Sequence
  derived and/or modified CDS sequence (opt5) from DENV-2__EU482691__SS-prME
accgccggagugaucgucaugcugauucccacggcuauggccuuccaccucacgaccagaaauggggaaccucauaugaucguuggacggcaggaaaagggcaagagccugcuuuuuaagacagaagacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaucaaccgcgcuuggaacucucucgagguggaagacuacggauuuggcgucuucaccacaaacaucuggcugaaacuucgggagaaacaggacguguuuugugauuccaagcugaugagcgccgcuauuaaagacaauagagccguucacgcggauaugggcuauuggaucgaaucugcccucaacgacaccuggaagauggagaaggcuuccuucauugaggugaaaagcugccacuggccuaagucucauacgcuguggagcaaugggguccuggaauccgagaugaucauucccaaaaacuucgccggaccggugagccagcacaacuaccgcccuggcuaucauacacaaaccgcugggcccuggcaccuuggaaagcucgaaauggauuuugacuucugugagggcaccacaguggucguuaccgaagauugcgggaaucggggacccucucugagaacgacaaccgccuccggcaaacugaucacagaguggugcugucggagcugcacccucccuccgcugcgcuacagaggcgaggacggguguugguacggaauggaaauucggccccuuaaggagaaggaagagaaccuggugaauagccucgugacagccggccaugggcagaucgauaacuuuucucugggaguccugggcauggcucuuuuccucgaagagaugcugagaacccgcaucgggacgaaacacgcgauucugcucguggccguuagcuuugugacccugaucacaggaaauauguccuuccgggaccuuggcagagucauggugaugguuggcgcuaccaugacagaugacauugggaugggagugaccuaucuggcccuccuggccgcuuuuaagguccgcccuacguucgccgcgggccugcuucugagaaaacucacaucuaaggagcugaugauggcuaccaucgggauugcccuccugagccaguccacaauccccgaaaccauccuugagcugaccgaugcccucgcucugggaaugauggugcugaaaauuguucggaacauggaaaaguaccaacuugccgugacaaucauggcgauuucuugcgucccuaaugcugugauccugcagaacgccuggaaggugagcuguacgauucucgccgcugucuccguuagcccccugcuccugaccucuucccagcagaaagccgacuggaucccucuugcucugacaaucaagggccucaaucccaccgccauuuuucugacaacccugagccgcacgucuaaaaagagauccuggccgcuuaacgaggcgaucauggccguggggauggugagcauucuggcuucuucccuccugaaaaaugacaucccuaugacaggaccccucgucgccggcggccugcuuaccgugugcuauguucugaccgggcggagcgcugaucuggaacucgagcgcgccgccgacgugagaugggaggaucaagcugaaauuuccggaagcucuccuauccugagcauuacaaucuccgaggacggcucuaugagcaucaagaacgaagaggaggaacagacccuuacaauucugauccggacggggcuccuggucauuuccggaguguuccccguuucuaucccgauuaccgcggccgcuugguaccucugggaggugaaaaagcagcgcgccggcguccugugggaugugccuucucccccucccgucgaaaaggccgagcuugaagacggggcuuauagaaucaaacagcggggaauccugggcuacucccaaauuggcgccgggguguauaaggagggaacauuucacaccauguggcauguuacacgcggcgcggugcugaugcacagagggaaacggaucgagcccuccugggcugaugucaagaaagaccucauuagcuacggaggcggguggaagcuggaaggagaguggaaggaaggcgaggaagugcagguucuugcccuggagccuggcaaaaauccgagagccgugcagaccaagcccgggaucuucaaaacgaacaccggaacaauuggcgcugucucccucgauuuuagcccugggaccucuggaucccccaucguggaccgcaagggcaaagugguugggcuguacggaaauggcgucgugacacggagcggcgccuaugugucugcgaucgcucagaccgagaaguccauugaagauaacccugagaucgaagacgauauuuucagaaagaaacgccucacaaucauggaccugcaucccggggccggaaagacgaaacgguaccuuccugccauugucagagaggcuaucaagcgcggccugcggacccugauucucgccccgacaagagugguugcugccgaaauggaggaggcgcugcgcgggcuucccauccgguaucaaaccccugccaucaaaaccgaacacacaggaagagagauuguggaccugaugugucaugcuacguucaccaugcggcuccugagccccguccgcgugccuaacuacaaucucaucauuauggaugaagcccacuuuacagaccccgcuuccaucgccgccagaggcuauauuucuacccggguugagaugggggaggcugcgggcaucuucaugacagccaccccgccuggaagccgcgaucccuuuccccaguccaacgcuccuaucauggacgaagagagagaaauucccgagcggagcuggaacucuggccacgaaugggugacggauuucaaggggaagacagucugguuugugccuuccaucaaagccggaaacgacauugccgcuugccugagaaagaauggcaaaaagguuauccagcuuagccgcaaaaccuucgauucugaguacgugaagacccgggccaacgacugggauuuugucgugacaaccgacauuagcgagaugggggcgaauuucaaggcugaaagagugaucgauccgcgccgguguaugaaacccgucauccugacagacggagaggaaagaguuauucuggccggcccuaugcccgugacccauuccucugccgcucaacgccgggggagaaucggccgcaacccuaagaaugagaacgaccaguauauuuacaugggagaaccccucgagaaugaugaggacugcgcccacuggaaagaagcgaagaugcugcuugauaacaucaauacgccggagggcauuaucccuagcauguuugaacccgagagagaaaaaguggacgccauugauggggaguaccggcugcgcggagaggcuagaaagacauucgucgaccucaugcggcgcggcgaucugccuguguggcuggccuauaaaguugcugccgaagggaucaacuacaccgacagaaagugguguuuugauggaaucaagaauaaccagauucucgaggaaaacauggagguggagaucuggacaaaagaaggcgagcggaagaaacuuaagcccagauggcuggacgcucgcauuuauuccgauccucuggcccucaaagaguucaaggaguucgcggccgggcggaagucucugacccuuaaucugaucacggaaaugggcagacuccccaccuuuaugacacagaaagcucgcaacgcccuggacaaucuggcuguccuccauaccgccgaggccggaggccgggcuuacaaccacgcgcuuagcgagcugccggaaacacuggagacccuccugcuucugacacuccuggccaccgugacagggggaauuuuccuguuucucauguccggcaaggggaucggaaaaaugacacuuggcaugugcugcaucauuaccgcuagcauccugcugugguaugcccaaauucagccucacuggaucgccgcuucuauuauccucgaguucuuucugaucguucuucugauucccgagcccgaaaagcagagaaccccucaggauaaucaacucacauacguggucaucgccauucugaccguggucgcggccacaauggcuaacgagaugggcuuccuggagaaaacgaagaaggaccucgggcuuggauccaucaccacacaggaaagcgaguccaauauucuggacaucgaucugcggccggccucugcuuggacccucuaugccguggcgacaaccuuuguuacgcccaugcugcgccauagcauugaaaacuccucugugaaugugagccuuaccgccaucgcuaaccaggccacaguccugaugggccucgggaaaggauggccucuguccaagauggacaucggcguuccccugcucgcuauuggguguuacagccaggugaauccuaucacccuuacagccgcucugcugcuccugguggcccacuacgcgauuaucggacccggccuucaagccaaagcuaccagagaggcccagaagcgggcugccgccggcauuaugaaaaacccuacggucgaugggaucacagugaucgaccuggaaccgauucccuaugauccuaaguucgagaagcagcucggacagguuaugcugcugauccucugcgugacccaaguccuuaugaugcgcacaaccugggcgcugugugaggcucugacccucgccacaggccccauuucuacgcugugggaagggaauccuggaagauuuuggaacaccacaaucgcuguguccauggccaauauuuuccggggcagcuaccuugccggggcuggacugcucuuuucuaucaugaaaaacaccacauccacccgcagaggcacgggcaauaucggggagacacugggagaaaaguggaaaagccggcugaacgcccucggcaagucugaguuccagauuuauaaaaagagcgggauccaggaggucgaccgcacccuugcgaaagaaggaauuaagagaggcgagaccgaucaucacgccgugucccgggggucugcuaagcugagaugguuuguugaacgcaacauggugacacccgagggaaaagucguggaccugggcugcggcagagggggauggagcuacuauuguggcgggcucaagaauguucgggaagugaaaggacugaccaagggcgggccgggacaugaggagccuauccccauguccacauacggcuggaaccuuguccgccugcaaagcggcguggauguguucuucacgcccccugaaaaaugcgacacccuccugugugauauuggggaguccucucccaauccuacaaucgaagccggacggacccugagaguucucaaccuugucgagaauuggcugaacaauaacacacaguuuugcgugaaggugcugaauccguauaugcccagcgucaucgaaaagauggaggcucuccagcgccaguacggcggggcccugguucggaacccucuuuccagaaauucuacccacgagauguacugggugagcaacgcgacgggaaauauuguguccucugucaacaugaucagccgcaugcugauuaaucgguucaccaugaaacacaagaaagccacauaugaacccgacguggaucucggcuccgggaccagaaacaucggaauugagagcgaaaucccuaaccuggacauuaucggcaagcgcaucgagaaaauuaagcaagaacaugagaucucuuggcacuacgaccaggaucaucccuauaagacaugggcuuaccacggcuccuaugagaccaaacagacagggagcgccucuuccaugguuaauggagugguccggcugcucaccaagccgugggacgugguuccuauggugacgcagauggcuaugacagauaccacccccuuuggccaacagagagucuucaaagaaaagguggacacacgcacgcaggagccuaaagaagggaccaagaaacuuaugaaaauuacagccgaguggcuguggaaggagcugggcaagaagaaaacccccagaauguguacacgggaagaguuuacccgcaaggugagaagcaacgcugcccucggcgcgaucuucacagaugaaaauaaauggaagucugcccgggaggcugucgaagacgggagauuuugggagcugguugaucgggagcgcaaccuucaccuggaaggaaagugcgagaccuguguguacaauaugaugggcaaaagagaaaagaaacucggcgaguucgggaaggccaaaggaucccgggcuauuugguauauguggcugggcgcccgcuuucuggaguucgaggcccucggguuucugaacgaggaccauugguucagcagaggaaauucccuuagcggcguggaaggggagggccugcaccggcucggauacauccugcgcgaugucggcaagaaggaagggggagcgauguacgcugacgauacggccggcugggacaccagaaucacacuugaggaccugaaaaacgaagagauggugaccaaucauaugaagggggagcacaaaaagcucgccgaagcuauuuuuaaacugacauaucagaacaagguugugcggguccaacgcccuacccccagaggaacggugauggauaucauuucucggcgcgaccagagaggcagcgggcagguuggcacauacggacugaauaccuucacaaacauggaggcccaacucauccggcagauggaaggcgaggggauuuucaaguccauccagcaucugaccgcuacggaggaaaucgccgugcagaauuggcuugcgcgcgucggaagagagcggcugucuagaauggccauuagcggcgaugacugcgugguuaaaccgaucgaugaccgcuuugcuuccgcccucaccgcucugaacgauauggggaaggugcggaaagacauucaacagugggaaccuucuagaggauggaaugauuggacacagguccccuucugcagccaccacuuucaugagcuugugaugaaggacggccgcguccuggugguucccugucggaaccaggaugaacucaucgggagagcccgcauuucccaaggcgcgggauggucucugaaagagaccgccugccugggcaagagcuaugcucagauguggacacucauguacuuccaccggagagaccugcgccuugccgcuaacgccaucuguuccgcugugccuagccauugggucccgaccucucggacaaccugguccauucacgccaagcacgaguggaugacgacagaagauaugcuggcgguguggaauagaguguggauccaggagaaccccuggauggaagacaaaaccccuguugagagcugggaagaggugcccuaucucgggaagcgcgaggaccaguggugcggaucucugaucggccuuaccucccgggccacaugggcuaaaaauauucaaaccgccaucaaccaggucagaagccugauugggaaugaagaguacacagauuauaugccuuccaugaagcgguuuagacgcgaagaggaagaggccggagugcucugguga

SEQ ID NO: 19824 - RNA, 9876 nt, Artificial Sequence
  derived and/or modified CDS sequence (opt5) from DENV-2__EU482693__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugaccugugugagggcacaaccguggucguuacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucgugaauagccuggugaccgccggccaugggcagauugauaacuucucucugggaguccuuggcauggcucucuuucuggaagagaugcugagaacgcgcaucgggaccaaacacgcgacacuccugguggccguuagcuucgugacccuuaucacaggaaauauguccuuucgggaccugggcagagucauggugaugguuggcgcuaccaugacggaugacauugggaugggagugacauaucucgcccugcuggccgcuuucaagguccgcccuaccuuugccgcgggccuucugcucagaaaacugacaucuaaggagcucaugauggcuaccaucgggauugcccugcuuagccaguccaccauccccgaaacaauucuggagcucacggaugcccuggcucugggaaugauggugcuuaaaaucguucggaacauggaaaaguaccaacuggccgugaccaucauggcgauuucuugcgucccuaaugcugugauccuccagaacgccuggaaggugagcuguacaauucuggccgcugucuccguuagcccccuccugcuuaccucuucccagcagaaagccgacuggaucccucuggcucucacaauuaagggccugaaucccaccgccaucuuccugacgacacuuagccgcaccucuaaaaagagauccuggccgcugaacgaggcgaucauggccguggggauggugagcauucucgcuucuucccugcucaaaaaugacaucccuaugaccggaccccuggucgccggcggccuucugacagugugcuauguucugaccgggcggagcgcugaucucgaacuggagcgcgccgccgacgugaagugggaggaucaagcugaaauuuccggaagcucuccuauccuuagcauuacaaucuccgaggacggcucuaugagcauuaaaaacgaagaggaggaacagacgcugaccauccucaucagaacagggcugcucgucauuuccggaguguuucccguuucuaucccgauuaccgcggccgcuugguaccugugggaggugaagaagcagcgggccggcguccuuugggaugugccuucucccccucccgucgaaaaagccgagcuggaagacggggcuuaucgcaucaagcagagaggcauucugggauacucccaaaucggcgccgggguguauaaagagggaacauuccacaccauguggcauguuacgcggggcgcggugcucaugcaccgcgggaagagaaucgagcccuccugggcugaugucaaaaaggaccugauuagcuacggaggcggguggaaacuugaaggagaguggaaagaaggcgaggaagugcagguucuggcccucgagccuggcaagaauccgcgggccgugcagaccaaacccgggaucuuuaagacaaacaccggaacaauuggcgcugucucccuggauuucagcccugggaccucuggaucccccaucguggacagaaaaggcaaggugguugggcucuacggaaauggcgucgugacacgcagcggcgccuaugugucugcgauugcucagacggagaaguccaucgaagauaacccugagaucgaagacgauauuuuucggaaaaagagacugaccaucauggaccuucaucccggggccggaaaaacaaagcgcuaccugccugccauuguccgggaggcuaucaaaagaggccugcgcacccucauucuggccccgacccgggugguugcugccgaaauggaggaggcgcuuagagggcugcccauccgcuaucaaaccccugccauuaagacggaacacaccggacgggagaucguggaccucaugugucaugcuacauucaccaugagacugcucagccccguccgggugccuaacuacaaucugaucauuauggaugaagcccacuucacagaccccgcuuccaucgccgcccgcggcuauauuucuaccagaguugagaugggggaggcugcgggcaucuuuaugacggccacaccgccuggaagccgggaucccuucccccaguccaacgcuccuauuauggacgaagagagagaaauccccgagagaagcuggaacucuggccacgaaugggugaccgauuuuaaggggaaaaccgucugguucgugccuuccaucaaggccggaaacgacauugccgcuugccuucggaaaaauggcaagaaaguuauccagcugagcagaaagacauuugauucugaguacgugaagacccgcgccaacgacugggauuucgucgugacaaccgacauuagcgagaugggggcgaauuuuaaagcugaacgggugaucgauccgagacgcuguaugaagcccgucauucugacggacggagaggaacggguuauccucgccggcccuaugcccgugacacauuccucugccgcucaaagacgcgggcggaucggcagaaacccuaaaaaugagaacgaccaguauauuuacaugggagaaccccuggagaaugaugaggacugcgcccacuggaaggaagcgaaaaugcuucuggauaacaucaauaccccggagggcauuaucccuagcauguucgaacccgagcgcgaaaagguggacgccauugauggggaguacagacuccggggagaggcucgcaaaacauuugucgaccugaugagacggggcgaucugccuguguggcucgccuauaagguugcugccgaagggaucaacuacgcugaccgcaagugguguuucgauggaauuaaaaauaaccagauccuugaggaaaacauggagguggagaucuggaccaaggaaggcgagcgcaagaagcugaaaccccgguggcuggacgccagaauuuauuccgauccucucgcgcugaaggaauuuaaggaguucgccgcugggcgcaaaucucuuacgcugaaucucaucaccgaaaugggccggcugcccacauucaugacccagaaggccagaaacgcucuggacaaucucgccguccuucauacagccgaggcuggaggccgcgcguacaaccacgcccugagcgagcugccggaaacccucgagacacugcuucugcucacccugcuggcuacggugacagggggaauuuuucucuuccuuauguccggcaaagggaucggaaagaugacccugggcaugugcugcauuaucaccgccagcauccugcucugguaugcccaaauucagccucacuggaucgcugccucuauuauccuggaauuuuuccuuauuguucugcucauccccgagcccgaaaaacagcggacaccucaggauaaucaacugaccuacguggucaucgcgauucugacaguggucgccgcuacgauggccaacgagaugggcuuucucgagaagaccaagaaagaccuugggcugggauccaucacaacccaggaaagcgaguccaauauucuggacaucgaucucagaccggcuucugccuggacacuguaugcgguggccaccacguucguuacccccaugcuucggcauagcauugaaaacuccucugugaaugugagccugacagcuaucgccaaccaggcuaccguccucaugggccuggggaagggauggccucuguccaaaauggacauuggcguuccccuccuugccaucggguguuacagccaggugaauccuaucacacugaccgcugcccugcuccugcuuguggcgcacuacgccauuaucggacccggccugcaagcuaaggccacgcgcgaggcucagaaaagagccgccgcgggcauuaugaagaacccuacagucgaugggaucaccgugauugaccucgaaccgauccccuaugauccuaaguuugagaaacagcugggacagguuaugcugcucauccuuugcgugacacaaguccugaugaugcggaccaccugggcucugugugaggcccucacacuggcuacgggccccauuucuacccuuugggaagggaauccuggacgcuucuggaacacaaccaucgccguguccauggccaauauuuuuagaggcagcuaccuggcuggggccggacuccuguucucuaucaugaagaacacaaccuccacgcggcgcggcacaggcaauauuggggagacccugggagaaaaauggaaaagcagacucaacgcgcuuggcaaaucugaguuucagaucuauaagaaaagcgggauccaggaggucgaccggacccuggccaaggaaggaauuaagcgcggcgagacagaucaucacgcuguguccagagggucugccaaacugcggugguucguugaaagaaacauggugacccccgagggaaaggucguggaccucggcugcggccgcgggggauggagcuacuauuguggcgggcugaaaaauguucgggaagugaagggacuuacaaaaggcgggccgggacaugaggagccuauccccauguccacguacggcuggaaccuggucagacuccaaagcggcguggauguguuuuucacacccccugaaaagugcgacacccugcugugugauauuggggaguccucucccaauccuaccaucgaagcuggacgcacacuccggguucuuaaccuggucgagaauuggcugaacaauaacacccaguucugcauuaaggugcucaauccguauaugcccagcgugaucgagaagauggaggcccugcagagaaaguacggcggggcgcuuguccgcaacccucuguccagaaauucuacgcacgagauguacuggguuagcaacgccaccggaaauaucguguccucugugaacaugauuagcagaaugcucaucaaucgcuuuacaaugaaacacaagaaagcuaccuaugaacccgacgucgaucugggcuccgggacacggaacauuggaaucgagagcgaaauuccuaaccuggacaucauuggcaagagaaucgagaagaucaaacaggaacaugagaccucuuggcacuacgaccaagaucaucccuauaagacaugggccuaccacggcuccuaugagaccaaacagacggggagcgcuucuuccauggugaauggaguugugcgccuccuuacaaagccgugggacgucgugccuaugguuacccagauggccaugaccgauacaacgcccuucggccagcaacggguguuuaaagaaaaggucgacaccagaacacaggagccuaaggaagggaccaaaaagcugaugaaaauuacagcugaguggcuguggaaggagcucggcaagaagaaaacaccccgcauguguacaagagaagaguucacccggaaggugcgcagcaacgccgcgcugggcgccaucuuuacggaugaaaauaaguggaaaucugcuagagaggccguggaagacgggcgguucugggagcuugucgauagagagcggaaccugcaccucgaaggaaagugcgagaccuguguuuacaauaugaugggcaaacgcgaaaagaaacugggcgaguuugggaaggcuaagggauccagagccauuugguauauguggcugggcgcccgguuccucgaauuugaggcgcugggguuccuuaacgaggaccauugguuuagccgcggaaauucccugagcggcguggaaggggagggccuccacagacugggauacauccuucgggaugugucuaaaaaggaaggcggggcuauguacgccgacgauacagccggaugggacacccgcauuacacuggaggaccucaaaaacgaagagauggucaccaaucauaugaagggcgagcacaaaaagcuggcugaagccaucuucaagcugacguaucagaacaaagugguuagagugcagcggccuacaccccgcgggaccgucauggauaucauuagcagacgggaccaacgcggauccggccagguggggacauacggccucaauaccuuuacgaacauggaggcucagcugaucagacaaauggaaggagagggcauuuucaagucuauccagcaucuuaccgccgcggaggaaaauguugugcagaacuggcuggcccgggucgggcgcgagagacucagccggauggcuauuuccggagaugacugcgugguuaaaccgaucgaugacagauucgccucugcucugacagcccuuaaugauaugggcaaggugcgcaaagacauccagcaaugggaaccuagccggggguggaacgauuggacccagguccccuuuugcucccaccacuuccaugagcuggugaugaaggacggaagaguccucgugguucccugucgcaaccaggaugaacugauuggccgggcgagaaucucucagggggccggcuggagccugaaggagacagcuugccucggaaaauccuaugcccaaauguggacccugauguacuuucaccgccgggaccuuagacuggcugccaaugcuauuuguagcgccgugccuucucauugggucccgacaucccgcaccacguggagcauccacgcgaagcacgaguggaugacaaccgaagauaugcucgccguguggaaccggguguggauucaggagaaucccuggauggaagacaaaaccccuguugagucuugggaagaggugcccuaucugggcaagagagaggaccaguggugcgggucccuuaucggacugacaagccgcgcuaccugggccaaaaacauucagacagccaucaaucaaguccggucccucaucggcaacgaagaguacacggauuauaugccuucuaugaagagauuccggagagaagaggaagaggcuggggugcugugguga

SEQ ID NO: 19825 - RNA, 9876 nt, Artificial Sequence
  derived and/or modified CDS sequence (opt5) from DENV-2__EU596483__SS-prME
accgccggcgugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaagacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggagggauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauggaaucugcccucaacgacacguggaagauggagaaggcuuccuucauugaggugaaaagcugccacuggccuaagucucauacacuguggagcaaugggguccuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgugaccgccggccaugggcagaucgauaacuuuucucugggaguccugggcauggcucuuuuccucgaagagaugcugagaacgcgcauugggaccaaacacgcgauccugcucguggccguuagcuuugugacacugaucaccggaaauauguccuuccgggaccuuggcagagucauggugaugguuggcgcuacaaugaccgaugacauugggaugggagugacguaucuggcccuccuggccgcuuuuaagguccgcccuacauucgccgcgggccugcuucugagaaaacucaccucuaaggagcugaugauggcuacaaucgggauugcccuccugagccaguccaccauccccgaaaccauucuugagcugacagaugcccucgcucugggaaugauggugcugaaaaucguucggaacauggaaaaguaccaacuugccgugacgaucauggcgauuucuugcgucccuaaugcugugauccugcagaacgccuggaaggugagcuguaccauucucgccgcugucuccguuagcccccugcuccugacaucuucccagcagaaagccgacuggaucccucuugcucugaccauuaagggccucaaucccacagccaucuuucugaccacgcugagccgcacaucuaaaaagagauccuggccgcuuaacgaggcgaucauggccguggggauggugagcauucuggcuucuucccuccugaaaaaugacaucccuaugaccggaccccucgucgccggcggccugcuuaccgugugcuauguucugacagggcggagcgcugaucuggaacucgagcgcgccgccgacgugaagugggaggaucaagcugaaauuuccggaagcucuccuauccugagcauuaccaucuccgaggacggcucuaugagcauuaaaaacgaagaggaggaacagacacuuacgauccugaucagaaccgggcuccuggucauuuccggaguguuccccguuucuaucccgauuacagcggccgcuugguaccucugggaggugaagaagcagcgggccggcguccugugggaugugccuucucccccucccgucgaaaaagccgagcuugaagacggggcuuaucgcaucaagcagagagggauucugggcuacucccaaaucggcgccgggguguauaaagagggaaccuuucacacaauguggcauguuacccggggcgcggugcugaugcaccgcgggaagagaaucgagcccuccugggcugaugucaaaaaggaccucauuagcuacggaggcggguggaagcuggaaggagaguggaaagaaggcgaggaagugcagguucuugcccuggagccuggcaagaauccgcgggccgugcagacgaaacccgggaucuucaagaccaacacaggaaccauuggcgcugucucccucgauuuuagcccugggacaucuggaucccccaucguggacagaaaaggcaaggugguugggcuguacggaaauggcgucgugacccgcagcggcgccuaugugucugcgauugcucagacagagaaguccaucgaagauaacccugagaucgaagacgauauuuuccggaaaaagagacucacgaucauggaccugcaucccggggccggaaaaaccaagcgcuaccuuccugccauuguccgggaggcuaucaaaagaggccugcgcacacugauucucgccccgacccgggugguugcugccgaaauggaggaggcgcugagagggcuucccauccgcuaucaaaccccugccauuaagacagaacacacgggacgggagaucguggaccugaugugucaugcuaccuucacaaugagacuccugagccccguccgggugccuaacuacaaucucaucauuauggaugaagcccacuuuaccgaccccgcuuccaucgccgcccgcggcuauauuucuacaagaguugagaugggggaggcugcgggcaucuucaugaccgccacgccgccuggaagccgggaucccuuuccccaguccaacgcuccuauuauggacgaagaaagagaaauccccgagagaagcuggaacucuggccacgaaugggugacagauuucaaggggaaaaccgucugguuugugccuuccaucaaggccggaaacgacauugccgcuugccugcggaaaaauggcaagaaaguuauccagcuuagcagaaagaccuucgauucugaguacgugaagacacgcgccaacgacugggauuuugucgugaccacagacauuagcgagaugggggcgaauuucaaagcugaacgggugaucgauccgagacgcuguaugaagcccgucauucugaccgacggagaggaacggguuauccuggccggcccuaugcccgugacgcauuccucugccgcucaaagacgcgggcggaucggcagaaacccuaaaaaugagaacgaccaguauauuuacaugggagaaccccucgagaaugaugaggacugcgcccacuggaaggaagcgaaaaugcugcuugauaacaucaauacaccggagggcauuaucccuagcauguuugaacccgagcgcgaaaagguggacgccauugauggggaguacagacugcggggagaggcucgcaaaaccuucgucgaccucaugagacggggcgaucugccuguguggcuggccuauaagguugcugccgaagggaucaacuacacagaccgcaagugguguuuugauggaauuaaaaauaaccagauccucgaggaaaacauggagguggagaucuggaccaaggaaggcgagcgcaagaaacuuaaaccccgguggcuggacgcuagaauuuauuccgauccucuggcccucaaggaguucaaggaguucgcggccgggcgcaaaucucugacgcuuaaucugaucaccgaaaugggccggcuccccacauuuaugacccagaaggcuagaaacgcccuggacaaucuggcuguccuccauacagccgaggccggaggccgcgcuuacaaccacgcgcuuagcgagcugccggaaacccuggagacacuccugcuucugacccuccuggccacggugacagggggaauuuuccuguuucucauguccggcaaagggaucggaaagaugacccuuggcaugugcugcauuaucaccgcuagcauccugcugugguaugcccaaauucagccucacuggaucgccgcuucuauuauccucgaguucuuucugauuguucuucugauccccgagcccgaaaaacagcggacaccucaggauaaucaacucaccuacguggucaucgccauucugacaguggucgcggccacgauggcuaacgagaugggcuuccuggagaagaccaagaaagaccucgggcuuggauccaucacaacccaggaaagcgaguccaauauucuggacaucgaucugagaccggccucugcuuggacacucuaugccguggcgaccacguuuguuacccccaugcugcggcauagcauugaaaacuccucugugaaugugagccuuacagccaucgcuaaccaggccaccguccugaugggccucgggaagggauggccucuguccaaaauggacauuggcguuccccugcucgcuaucggguguuacagccaggugaauccuaucacacuuaccgccgcucugcugcuccugguggcccacuacgcgauuaucggacccggccuucaagccaaggcuacgcgcgaggcccagaaaagagcugccgccggcauuaugaagaacccuacagucgaugggaucaccgugauugaccuggaaccgauccccuaugauccuaaguucgagaaacagcucggacagguuaugcugcugauccucugcgugacacaaguccuuaugaugcggaccaccugggcgcugugugaggcucugacacucgccacgggccccauuucuacccugugggaagggaauccuggacgcuuuuggaacacaaccaucgcuguguccauggccaauauuuucagaggcagcuaccuugccggggcuggacugcucuuuucuaucaugaagaacacaaccuccacgcggcgcggcacaggcaauauuggggagacccugggagaaaaauggaaaagcagacugaacgcccucggcaaaucugaguuccagaucuauaagaaaagcgggauccaggaggucgaccggacccuugcgaaggaaggaauuaagcgcggcgagacagaucaucacgccguguccagagggucugcuaaacugcggugguuuguugaaagaaacauggugacccccgagggaaaggucguggaccugggcugcggccgcgggggauggagcuacuauuguggcgggcucaaaaauguucgggaagugaagggacugacaaaaggcgggccgggacaugaggagccuauccccauguccacguacggcuggaaccuugucagacugcaaagcggcguggauguguucuucacacccccugaaaagugcgacacccuccugugugauauuggggaguccucucccaauccuaccaucgaagccggacgcacacugcggguucucaaccuugucgagaauuggcugaacaauaacacccaguuuugcauuaaggugcugaauccguauaugcccagcgugaucgagaagauggaggcucuccagagacaguacggcggggcccugguccgcaacccucuuuccagaaauucuacgcacgagauguacuggguuagcaacgcgaccggaaauaucguguccucugugaacaugauuagcagaaugcugaucaaucgcuucacaaugaagcacaaaaaggccaccuaugaacccgacgucgaucucggcuccgggacacggaacauuggaaucgagagcgaaauuccuaaccuggacaucauuggcaaaagaaucgagaagaucaagcaagaacaugagauuucuuggcacuacgaccaggaucaucccuauaaaaccugggcuuaccacggcuccuaugagacaaagcagaccgggagcgccucuuccauggugaauggaguugugcgccugcucacgaaaccgugggacgucgugccuaugguuacacagauggcuaugaccgauaccacacccuuuggccaacagcggguguucaaggaaaaagucgacacgagaacccaggagccuaaggaagggacaaagaaacuuaugaagaucaccgccgaguggcuguggaaagagcugggaaagaaaaagacaccccgcauguguaccagagaagaguuuacacggaaagugcgcagcaacgcugcccucggcgcgauuuucaccgaugaaaauaaguggaagucugccagagaggcuguggaagacgggcgguuuugggagcuggucgauagagagcggaaccuucaccuggaaggaaaaugcgagacguguguuuacaauaugaugggcaagcgcgagaagaagcucggcgaguucgggaaagccaagggauccagagcuaucugguauauguggcugggcgcccgguuucuggaguucgaggcccucggguuucugaacgaggaccauugguucagccgcggaaauucccuuagcggcguggaaggggagggccugcacagacucggauacauucugcgggaugugggcaagaaagaagggggagcgauguacgcugacgauaccgccggcugggacacacgcaucacccuugaggaccugaagaacgaagagauggucacaaaucauaugaaaggggagcacaagaaacucgccgaagcuaucuuuaagcugaccuaucagaacaaggugguuagagugcaacggccuacgccccgcggaacagucauggauauuaucucuagacgggaccagcgcggcagcggacaggugggcaccuacggacugaauacauucaccaacauggaggcccaacucauuagacagauggaaggcgaggggaucuucaaauccauucagcaucugacggcuaccgaggaaaucgccguucagaauuggcuugcgcgggugggacgcgagagacugucucggauggccaucagcggcgaugacugcgucgugaagccgauugaugacagauuugcuuccgcccucacagcucugaacgauauggggaaaguucgcaaggacauccaacagugggaaccuucucggggauggaaugauuggacccaggugcccuucugcagccaccacuuucaugagcuugucaugaaagacggcagagugcuggucgugcccugucgcaaccaggaugaacucauugggcgggccagaaucucccaaggcgcgggauggucucugaaggagacagccugccugggcaagagcuaugcucagauguggacccucauguacuuccaccgccgggaccugagacuugccgcuaacgccauuuguuccgcuguuccuagccauugggugccgacaucucgcaccacgugguccauccacgccaaacacgaguggaugacaaccgaagauaugcuggcggucuggaaucggguguggauucaggagaaccccuggauggaagacaagaccccuguggagagcugggaagagguucccuaucucgggaaaagagaggaccaguggugcggaucucugaucggccuuacaucccgcgccaccugggcuaagaauauccaaacagccauuaaccaggugcggagccugaucgggaaugaagaguacacggauuauaugccuuccaugaaaagauuucggagagaagaggaagagaccggaguccucugguga

SEQ ID NO: 19826 - RNA, 9876 nt, Artificial Sequence
  derived and/or modified CDS sequence (opt5) from DENV-2__EU482597__SS-prME
accgccggcgugaucgucaugcugauucccacagcuauggccuuccaccucacgaccagaaauggggagccucauaugaucguuggacggcaggaaaagggcaagagccugcuuuuuaagaccgaggacggggugaauaugugcacccugauggcgauugaucucggagaacugugugaggacacaaucaccuacaaaugcccccuucugcgccaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucuguccgaggaacaggacaaacgcuuuaucugcaagcauagcaugguggauagaggcuggggcaauggguguggacuguucggcaaagggggaauugucacaugcgccauguuuacgugcaaaaagaacauggaaggcaaaguugugcagccugagaaucucgaauacaccaucgugauuacaccccacucuggggaggagcaugcggucggaaacgacaccggcaagcacggcaaagaaaucaagaucacaccucaguccagcauuaccgaggccgaacugacgggguauggaaccgugacaauggaguguucuccccggaccggccuugauuucaaugaaaugguucugcuccaaauggaggacaaggcuuggcuggugcaccgccagugguuucuugaucugccgcucccuuggcugcccggggccgacacacagggauccaacuggauccagaaggagacccuggucacguucaagaauccucaugcuaaaaagcaagacgugguugugcucggcagccaggaaggggccaugcacacagcccugaccggcgcuacagagauucagauguccucuggaaaccuucuguuuaccggccaucucaaaugcagacugcggauggauaaacuucaacugaaagggaugagcuacuccauguguaccggaaaguucaagaucgucaaagaaauugcggagacacagcacggcacgaucgugaucagaguccaguaugagggggacggaagccccugcaagauucccuucgaaaucaccgaucucgagaaacgccaugugcugggccggcugauuacaguuaauccuaucgugaccgaaaaggacucuccggucaacauugaggccgaacccccuuuuggggauuccuacaucauuaucggcguggagcccggacagcucaaacugaacugguucaagaagggcagcucuaucgggcaaauguuugagacaaccaugagaggagcuaaacgcauggccauucuuggcgacacggccugggauuucgggagccugggaggcguuuuuacauccaucgggaaggcucuccaccagguguucggcgccauuuacggagcggcuuuuucuggcgucagcuggaccaugaaaauccugauuggggugaucaucaccuggauuggaaugaacucccggagcacaucucuguccgugagccuuguucucgucggcguggugacccuguaucugggggccaugguccaggccgacucuggaugugugguuuccuggaagaacaaagaacucaagugcggcagcgggaucuucauuacagauaaugugcacacguggaccgagcaguacaaguuucaaccugaaucccccucuaaacuggcuagcgccauccagaaggcucaugaggaaggcauuuguggaaucagauccgucacacgccuugagaaccugauguggaaacagaucaccccggagcucaaucacauucugucugaaaacgaggugaagcugacaaucaugaccggcgacauucgggggaucaugcaggccggaaaaagaagccuucgcccucaacccacggaacucaaguauuccuggaaaaccuggggcaaggcgaagaugcugagcacagagucucauaaucagaccuuccugauugaugggccugaaacagccgagugccccaacaccaaucgggcuuggaacucccucgagguugaagacuacggauuuggcguguucacaaccaauaucuggcugaaacuuagagagaagcaggacgucuuuugugauagcaaacugaugucugccgcuaucaaggacaaccgcgccgugcacgcggauaugggcuauuggauugaauccgcccucaaugacacguggaaaauggagaaggcuagcuucaucgagguuaagucuugccacuggccuaaaagccauacacugugguccaacggggugcuggaaagcgagaugauuauccccaagaauuucgccggaccggucucucagcacaacuaccggccuggcuaucauacccaaaccgcugggcccuggcaccuuggaaaacucgaaauggauuuugaccugugugagggcacaaccgugguggucacggaagauugcgggaacagaggacccucccugcggacaaccacagccagcggcaagcucauuaccgaguggugcugucgcuccugcacacugccuccgcuuagauaccggggcgaggacggguguugguacggaauggaaaucagaccccugaaagagaaggaagagaaucucguuaacucucuggugaccgccggccaugggcagauugauaauuucagccugggagugcuuggcauggcucucuuucuggaagagaugcugcgcacgcggaucgggaccaagcacgcgauccuccuggucgccguguccuucguuacacuuauuaccggaaacaugucuuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccagcaaagagcucaugauggcuacaauugggaucgcccugcuuucccagucuaccauucccgaaaccauccuggagcucacagaugcccuggcucugggaaugaugguccuuaagaucgugcgcaauauggaaaaauaccaacuggccguuacgauuauggcgaucagcugcgugccuaacgcugucauucuccagaaugccuggaagguguccuguaccauccuggccgcugugagcgucucuccccuccugcuuacauccagccagcagaaggccgacuggauuccucuggcucucaccaucaaaggccugaaccccacagccaucuuccugaccacgcuuucuagaacauccaagaaacggagcuggccgcugaaugaggcgauuauggccguugggauggugucuauccucgcuuccagccugcucaagaacgacauuccuaugaccggaccccugguggccggcggccuucugaccgucugcuaugugcugacagggcgcuccgcugaucucgaacuggagagagccgccgacguuaaaugggaggaucaagcugaaaucagcggaucuagcccuauucuuuccaucaccauuucugaggacggcagcauguccaucaagaaugaagaggaggaacagacacugacgauccucauucggaccgggcugcucgugaucucuggagucuuucccgugagcauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacagccaaaucggcgccggggucuauaaggagggaaccuuccacacaauguggcaugugacccgcggcgcgguucucaugcacagagggaaacggauugagcccagcugggcugaugugaagaaagaccugaucuccuacggaggcggguggaaacuugaaggagaguggaaggaaggcgaggaaguccaggugcuggcccucgagccuggcaaaaacccgagagccguucagacgaagcccgggauuuuuaaaaccaauacaggaaccaucggcgcugugagccuggauuucucuccugggacauccggaagccccauugucgaccgcaagggcaaagugguggggcucuacggaaacggcguugucacccggucuggcgccuauguguccgcgaucgcucagacagaaaagagcaucgaagauaauccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagagucguggcugccgaaauggaggaggcgcuucgcgggcugcccauucgguaucaaaccacagccaucaaaacggaacacaccggaagagagaucguugaccucaugugucaugcuacauucaccaugcggcugcucuccccugugcgcguccccaacuacaaccugauuaucauggaugaagcccacuucacagacccugcuucuauugccgccagaggcuauaucagcacccggguggagaugggggaggcugcgggcauuuuuaugacggccacacccccgggaucccgcgauccuuucccccagagcaaugcucccaucauggacgaagagagagaaaucccugagcggucuuggaacuccggccacgaauggguuaccgauuuuaaggggaagaccgugugguucguccccagcauuaaagccggaaaugacaucgccgcuugccuuagaaagaacggcaaaaaggugauucagcugucucgcaaaacauuugauagcgaguacguuaagacccgggccaaugacugggauuucguggucacaaccgacaucuccgagaugggggcgaacuuuaaggcugaaagagugauugauccucgccgguguaugaaaccggugauccugacggacggagaggaaagagucauccucgccggccccaugccuguuacacauucuagcgccgcucaacgccgggggagaauuggccgcaaucccaagaacgagaaugaccaguauaucuacaugggagaaccucuggagaacgaugaggacugcgcccacuggaaagaagcgaagaugcuucuggauaauauuaacacccccgagggcaucauuccguccauguucgaaccugagagagaaaaaguggacgccaucgauggggaguaccggcuccgcggagaggcuagaaagacauuuguggaccugaugcggcgcggcgaucugcccgucuggcucgccuauaaaguggcugccgaagggauuaauuacgcugacagaaagugguguuucgauggaaucaagaacaaucagauccuugaggaaaacauggagguugagauuuggaccaaagaaggcgagcggaagaaacugaagccuagauggcuggacgcccgcaucuauucugauccccucgcgcugaaagaauuuaaggaguucgccgcugggcggaagucccuuacgcugaaccucauuaccgaaaugggcagacugccuacauucaugacccagaaagcccgcaaugcucuggacaaccucgccgugcuucauacagccgaggcuggaggccgggcguacaaucacgcccuguccgagcugcccgaaacccucgagacacugcuucugcucacccugcuggcuacggucacagggggaaucuuucucuuccuuaugagcggcaaggggauuggaaaaaugacccugggcaugugcugcaucaucaccgccucuauucugcucugguaugcccaaauccagccgcacuggauugcugccuccaucauucuggaauuuuuccuuaucgugcugcucaucccugagcccgaaaagcagagaacaccccaggauaaccaacugaccuacguugugauugcgauccugacagucguggccgcuacgauggccaaugagaugggcuuucucgagaaaaccaagaaggaccuugggcugggaagcauuacaacccaggaauccgagucuaacauccuggacauugaucuccggccugcuagcgccuggacacuguaugcggucgccaccacguucgugaccccgaugcuucgccauuccaucgaaaauucuagcguuaacgugucccugacagcuauugccaaucaggcuaccgugcucaugggccuggggaaaggauggccccugagcaagauggacaucggcgucccucuccuugccaucggguguuacucucagguuaaccccauuacacugaccgcugcccugcuccugcuuguggcgcacuacgccaucauuggaccuggccugcaagcuaaagccacgagagaggcucagaagcgggccgccgcgggcaucaugaaaaaucccacaguggaugggauuaccgucaucgaccucgaaccuaucccguaugaucccaaguuugagaagcagcugggacaggugaugcugcucauucuuugcguuacacaagugcugaugaugcgcaccaccugggcucugugugaggcccucacacuggcuacgggcccuaucuccacccuuugggaagggaaccccggaagauucuggaauacaaccauugccgucagcauggccaacaucuuucggggcucuuaccuggcuggggccggacuccuguucuccauuaugaaaaauacaaccaacacgcgcagaggcacaggcaauaucggggagacccugggagaaaaguggaaaagccggcucaacgcgcuuggcaagucugaguuucagaucuauaaaaagagcgggauucaggagguggaccgcacccuggccaaagaaggaaucaagagaggcgagacagaucaucacgcugucucccgggggucugccaagcugagaugguucguggaacgcaacaugguuaccccugagggaaaaguggucgaccucggcugcggcagagggggauggagcuacuauuguggcgggcugaagaaugugagagaaguuaaaggacuuacaaagggcgggcccggacaugaggagccgauuccuauguccacguacggcuggaaccuggugcgccuccaaagcggcgucgauguguuuuucacaccgcccgaaaaaugcgacacacugcugugugauaucggggaguccucuccuaaucccaccauugaagcuggacggacacucagagugcuuaaccugguugagaauuggcugaacaauaacacccaguucugcaucaagguccucaauccuuauaugccgagcgugaucgaaaagauggaggcccugcagcgcaaauacggcggggcgcuugugcggaacccccuguccagaaauucuacgcacgagauguacugggucagcaacgccaccggaaauauuguuuccucugugaacaugaucagccgcaugcucauuaaucgguuuacaaugaagcacaaaaaggcuaccuaugaaccugacguggaucugggcuccgggacaagaaacaucggaauugagagcgaaauccccaaccuggacauuaucggcaaacgcaucgagaagauuaagcaggaacaugagaccucuuggcacuacgaccaagaucauccuuauaaaacaugggccuaccacggcuccuaugagaccaagcagacggggagcgcuucuuccauggucaauggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagaucacagcugaguggcuguggaaagagcucggaaagaaaaagaccccuagaauguguacacgggaagaguucacccgcaaagucagaagcaacgccgcgcugggcgccauuuuuacggaugaaaauaaguggaagucugcucgggaggccguggaagacgggagauucugggagcuuguggaucgggagcgcaaccugcaccucgaaggaaaaugcgagaccugugucuacaauaugaugggcaagagagagaagaagcugggcgaguuugggaaagcuaagggaucccgggccaucugguauauguggcugggcgcccgcuuccucgaauuugaggcgcugggguuccuuaacgaggaccauugguuuagcagaggaaauucccugagcggcguugaaggggagggccuccaccggcugggauacauucuucgcgaugugggcaagaaagaagggggagcuauguacgccgacgauacagccggcugggacaccagaaucacacuggaggaccucaagaacgaagagauggugaccaaucauaugaaaggggagcacaagaaacuggcugaagccaucuucaagcugacguaucagaacaaggucgugcggguucagcgccccacaccuagaggaaccgugauggauauuaucucucggcgcgaccaaagaggcagcgggcaggucggcacauacggacucaauaccuuuacgaacauggaggcucagcugauucggcaaauggaaggcgaggggaucuucaaauccauucagcaucuuaccgccacagaggaaaucgcggugcagaauuggcuggcccgcguuggaagagagcggcucucuagaauggcuaucagcggcgaugacugcguggucaagcccauugaugaccgcuucgccuccgcucugaccgcccuuaacgauauggggaaaauccggaaggacauucagcaaugggaaccgucuagaggauggaaugauuggacacaggugccuuuuugcagccaccacuuccaugagcugguuaugaaagacggccgcgugcucgucgugcccugucggaaccaggaugaacugaucgggagagcgcgcauuucccagggcgccggauggucucugaaggagaccgcuugccucggcaagagcuaugcccaaauguggacacugauguacuuucaccggagagaccuucgccuggcugccaacgcuaucuguuccgccguccccagccauugggugccuaccucucggacgacaugguccauucacgcgaaacacgaguggaugaccaccgaagauaugcucgccguuuggaauagaguguggauccaggagaacccguggauggaagacaagacacccgucgagagcugggaagaggugccuuaucuggggaaacgcgaggaccaguggugcggaucucuuaucggccugaccucccgggcuacaugggccaagaauauucagacggccaucaaccaagugagaagccucauugggaaugaagaguacaccgauuauaugcccuccaugaaacgguucagacgcgaagaggaagaggcuggaguucugugguga

SEQ ID NO: 19827 - RNA, 9876 nt, Artificial Sequence
  derived and/or modified CDS sequence (opt5) from DENV-2__EU482598__SS-prME
accgccggcgugaucgugaugcugauucccacagcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccggugaacaucgaggccgaacccccuuuuggggauucuuacauuaucaucggcgucgagcccggacagcucaaacugaauugguucaagaagggcuccagcauugggcaaauguuugagacaaccaugagaggagcuaaacgcauggccauccuuggcgacacggccugggauuucgggucucugggaggcguguuuacaagcauugggaaggcucuccaccagguuuucggcgccaucuacggagcggcuuuuuccggcgugucuuggaccaugaaaauucugaucggggucaucauuaccuggaucggaaugaacagccgguccacaagccugucugugucccuugugcucguuggcgucgugacccuguaucugggggccauggugcaggccgacagcggaugugucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacauccgggggauuaugcaggccggaaaaagaucucuucgcccucaacccacggaacucaaguauagcuggaaaaccuggggcaaggcgaagaugcuguccacagagagccauaaccagaccuuccugaucgaugggccugaaacagccgagugccccaauaccaaccgggcuuggaacucucucgagguggaagacuacggauuuggcguuuucacaaccaacaucuggcugaaacuuagagagaagcaggacguguuuugugauuccaaacugaugagcgccgcuauuaaggacaaucgcgccguccacgcggauaugggcuauuggaucgaaucugcccucaacgacacguggaaaauggagaaggcuuccuucauugaggucaagagcugccacuggccuaaaucucauacacuguggagcaaugggguucuggaauccgagaugaucauucccaagaacuucgccggaccggugagccagcacaacuaccggccuggcuaucauacccaaaccgcugggcccuggcaccuuggaaaacucgaaauggauuuugaccugugugagggcacaaccgucguggugacggaagauugcgggaauagaggacccucucugcggacaaccacagccuccggcaagcucaucaccgaguggugcugucgcagcugcacacugccuccgcuuagauaccggggcgaggacggguguugguacggaauggaaauuagaccccugaaagagaaggaagagaaccucgucaauucccugguuaccgccggccaugggcagaucgauaacuucucucugggagugcuuggcauggcucucuuucuggaagagaugcugcgcacgcggaucgggaccaagcacgcgauucuccugguggccgucagcuucgugacacuuaucaccggaaauauguccuuuagagaccugggccgcguuauggugauggucggcgcuacaaugaccgaugacauugggaugggagugacguaucucgcccugcuggccgcuuucaaaguuagaccuacauuugccgcgggccuucugcuccggaagcugaccucuaaagagcucaugauggcuacaaucgggauugcccugcuuagccaguccaccauccccgaaaccauccuggagcucacagaugcccuggcucugggaaugauggugcuuaagauuguccgcaacauggaaaaauaccaacuggccgugacgaucauggcgauuucuugcguuccuaaugcugugauccuccagaacgccuggaaggucagcuguaccauucuggccgcuguguccgugagcccccuccugcuuacaucuucccagcagaaggccgacuggaucccucuggcucucaccaucaaaggccugaaucccacagccauuuuccugaccacgcuuagcagaacaucuaagaaacgguccuggccgcugaacgaggcgaucauggccgucgggaugguuagcauucucgcuucuucccugcucaagaaugacaucccuaugaccggaccccugguggccggcggccuucugaccgugugcuauguccugacagggcgcagcgcugaucucgaacuggagagagccgccgacgugaaaugggaggaucaagcugaaauuuccggaagcucuccuauccuuagcauuaccaucuccgaggacggcucuaugagcaucaagaacgaagaggaggaacagacacugacgauucucauccggaccgggcugcucguuauuuccggaguguuucccgucucuaucccgauuacagcggccgcuugguaccugugggaggugaaaaagcagcgcgccggcguucuuugggaugugccuucucccccucccgucgaaaaggccgagcuggaagacggggcuuauagaaucaaacagcggggaauccugggcuacucccaaauuggcgccgggguguauaaggagggaaccuuccacacaauguggcaugucacccgcggcgcggugcucaugcacagagggaaacggaucgagcccuccugggcugauguuaagaaagaccugauuagcuacggaggcggguggaaacuugaaggagaguggaaggaaggcgaggaagugcagguccuggcccucgagccuggcaaaaauccgagagccgugcagacgaagcccgggaucuuuaaaaccaacacaggaaccauuggcgcuguuucccuggauuucagcccugggacaucuggaucccccaucguggaccgcaagggcaaagucguggggcucuacggaaauggcgugguuacccggagcggcgccuaugucucugcgaucgcucagacagagaaguccauugaagauaacccugagaucgaagacgauauuuuuagaaagaaacgccugacgaucauggaccuucaucccggggccggaaagaccaaacgguaccugccugccauugugagagaggcuaucaagcgcggccugcggacacucauucuggccccgaccagaguggucgcugccgaaauggaggaggcgcuucgcgggcugcccauccgguaucaaaccacagccaucaaaacggaacacaccggaagagagauuguggaccucaugugucaugcuacauucaccaugcggcugcucagcccuguucgcgugcccaacuacaaucugaucauuauggaugaagcccacuucacagacccugcuuccaucgccgccagaggcuauauuucuacccgggucgagaugggggaggcugcgggcaucuuuaugacggccacacccccgggaagccgcgauccuuucccccaguccaacgcucccaucauggacgaagagagagaaauuccugagcggagcuggaacucuggccacgaaugggugaccgauuuuaaggggaagaccguuugguucgugcccuccaucaaagccggaaacgacauugccgcuugccuuagaaagaauggcaaaaaggucauccagcugagccgcaaaacauuugauucugaguacgugaagacccgggccaacgacugggauuucguugugacaaccgacauuagcgagaugggggcgaauuuuaaggcugaaagagucaucgauccucgccgguguaugaaaccggugauccugacggacggagaggaaagagugauucucgccggccccaugccugucacacauuccucugccgcucaacgccgggggagaaucggccgcaaccccaagaaugagaacgaccaguauauuuacaugggagaaccucuggagaaugaugaggacugcgcccacuggaaagaagcgaagaugcuucuggauaacaucaauacccccgagggcauuaucccgagcauguucgaaccugagagagaaaaaguugacgccauugauggggaguaccggcuccgcggagaggcuagaaagacauuuguggaccugaugcggcgcggcgaucugcccguguggcucgccuauaaagucgcugccgaagggaucaacuacgcugacagaaagugguguuucgauggaaucaagaauaaccagauucuugaggaaaacauggagguggagaucuggaccaaagaaggcgagcggaagaaacugaagccuagauggcuggacgcccgcauuuauuccgauccccucgcgcugaaagaauuuaaggaguucgccgcugggcggaagucucuuacgcugaaucucaucaccgaaaugggcagacugccuacauucaugacccagaaagcccgcaacgcucuggacaaucucgccguucuucauacagccgaggcuggaggccgggcguacaaccacgcccugagcgagcugcccgaaacccucgagacacugcuucugcucacccugcuggcuacggugacagggggaauuuuucucuuccuuauguccggcaaggggaucggaaaaaugacccugggcaugugcugcaucauuaccgccagcauccugcucugguaugcccaaauucagccgcacuggaucgcugccucuauuauccuggaauuuuuccuuaucguccugcucauuccugagcccgaaaagcagagaacaccccaggauaaucaacugaccuacgugguuaucgcgauucugacaguggucgccgcuacgauggccaacgagaugggcuuucucgagaaaaccaagaaggaccuugggcugggauccaucacaacccaggaaagcgaguccaauauucuggacaucgaucuccggccugcuucugccuggacacuguaugcgguggccaccacguucgucaccccgaugcuucgccauagcauugaaaacuccucugugaauguuagccugacagcuaucgccaaccaggcuaccgugcucaugggccuggggaaaggauggccccuguccaagauggacaucggcgugccucuccuugccauuggguguuacagccaggucaaucccaucacacugaccgcugcccugcuccugcuuguugcgcacuacgccauuaucggaccuggccugcaagcuaaagccacgagagaggcucagaagcgggccgccgcgggcauuaugaaaaaccccacaguggaugggaucaccgugaucgaccucgaaccuauuccguaugaucccaaguuugagaagcagcugggacaggucaugcugcucauccuuugcgugacacaaguucugaugaugcgcaccaccugggcucugugugaggcccucacacuggcuacgggcccuauuucuacccuuugggaagggaaucccggaagauucuggaacacaaccaucgccguguccauggccaauauuuuucggggcagcuaccuggcuggggccggacuccuguucucuaucaugaaaaacacaaccaauacgcgcagaggcacaggcaacaucggggagacccugggagaaaaguggaaaucccggcucaacgcgcuuggcaagagcgaguuucagauuuauaaaaagucugggauccaggaggucgaccgcacccuggccaaagaaggaauuaagagaggcgagacagaucaucacgcugugagccggggguccgccaagcugagaugguucgucgaacgcaauauggugaccccugagggaaaaguuguggaccucggcugcggcagagggggauggucuuacuauuguggcgggcugaagaacguccgggaagugaaaggacuuacaaagggcgggcccggacaugaggagccgaucccuaugagcacguacggcuggaaucugguucgccuccaauccggcguggaugucuuuuucacaccgcccgaaaaaugcgacacacugcugugugauauuggggagagcuccccuaaccccaccaucgaagcuggacggacacucagagugcuuaaucugguggagaacuggcugaauaacaauacccaguucugcaucaagguucucaacccuuauaugccgucugucauugaaaagauggaggcccugcagcgcaaauacggcggggcgcuugugcggaauccccugagcagaaacuccacgcacgagauguacugggugucuaaugccaccggaaacaucgucagcuccguuaauaugauuucucgcaugcucaucaaccgguuuacaaugaagcacaaaaaggcuaccuaugaaccugacguggaucugggcagcgggacaagaaacauuggaaucgaguccgaaauucccaaucuggacaucaucggcaaacgcauugagaagaucaagcaggaacaugagaccagcuggcacuacgaccaagaucauccuuauaaaacaugggccuaccacggcucuuaugagaccaagcagacgggguccgcuagcucuauggugaacggagucgugcggcuccuuacaaaacccugggacguugugccgauggucacccagauggccaugaccgauacaacgccuuucggccagcaaagaguguuuaaggaaaaaguugacacccgcacacaggagcccaaggaagggaccaagaaacugaugaagauuacagcugaguggcuguggaaagagcucggaaagaaaaagaccccuagaauguguacacgggaagaguucacccgcaaagugagauccaaugccgcgcugggcgccaucuuuacggaugaaaacaaguggaaaagcgcucgggaggccgucgaagacgggagauucugggagcuuguggaucgggagcgcaaucugcaccucgaaggaaaaugcgagaccuguguguacaacaugaugggcaagagagagaagaagcugggcgaguuugggaaagcuaagggaucucgggccauuugguauauguggcugggcgcccgcuuccucgaauuugaggcgcugggguuccuuaaugaggaccauugguuuuccagaggaaacagccuguccggcgucgaaggggagggccuccaccggcugggauacauccuucgcgauguuggcaagaaagaagggggagcuauguacgccgacgauacagccggcugggacaccagaaucacacuggaggaccucaagaaugaagagauggugaccaaccauaugaaaggggagcacaagaaacuggcugaagccauuuucaagcugacguaucagaauaaggugguccgggugcagcgccccacaccuagaggaaccguuauggauaucauuagccggcgcgaccaaagaggcucuggacaggugggcacauacggacucaacaccuuuacgaauauggaggcucagcugauccggcaaauggaaggcgaggggauuuucaaaagcauccagcaucuuaccgccacagaggaaaucgcgguccagaacuggcuggcccgcgugggaagagagcggcucuccagaauggcuauuucuggcgaugacugcguugugaagcccaucgaugaccgcuucgccagcgcucugaccgcccuuaaugauauggggaaaguccggaaggacauucagcaaugggaaccguccagaggauggaacgauuggacacaggugccuuuuugcucucaccacuuccaugagcugguuaugaaagacggccgcgugcucgucgugcccugucggaaccaggaugaacugaucgggagagcgcgcauuagccagggcgccggauggucccugaaggagaccgcuugccucggcaagucuuaugcccaaauguggacacugauguacuuucaccggagagaccuucgccuggcugccaaugcuaucuguagcgccguccccucccauugggugccuaccagccggacgacauggucuauucacgcgaaacacgaguggaugaccaccgaagauaugcucgccguuuggaacagaguguggauccaggagaauccguggauggaagacaagacacccgucgaguccugggaagaggugccuuaucuggggaaacgcgaggaccaguggugcggaagccuuaucggccugaccucucgggcuacaugggccaagaacauucagacggccaucaaucaagugagaucccucauugggaacgaagaguacaccgauuauaugcccagcaugaaacgguucagacgcgaagaggaagaggcuggaguucugugguga

SEQ ID NO: 19828 - RNA, 9876 nt, Artificial Sequence
  derived and/or modified CDS sequence (opt5) from DENV-2__EU482603__SS-prME
accgccggagugaucgucaugcugauucccacggcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugccgagggcauuuguggaaucagaagcgucacacgccuugaaaaucugauguggaaacagaucaccccggagcucaaccacauucuguccgagaaugaagugaagcugacaaucaugaccggcgacauuaaagggaucaugcaggcgggaaagcggucucuuagaccucaacccacggagcucaaauauagcuggaagaccuggggcaaggccaaaaugcuguccacagaaagccauaaccagaccuuccugauugaugggccugagacagcugaaugccccaauaccaaccgcgccuggaacucucucgagguugaggacuacggauuuggcguguucacaaccaacaucuggcugaaacuucgggaaaaacaggacgucuuuugugauuccaagcugaugagcgcugccaucaaagacaauagagcggugcacgccgauaugggcuauuggauugagucugcucucaacgacacguggaagauggaaaaggccuccuucaucgagguuaaaagcugccacuggccuaagucucauacacuguggagcaauggggugcuggaguccgaaaugauuauccccaaaaacuucgcuggaccggucagccagcacaacuaccgcccuggcuaucauacccaaaccgccgggcccuggcaccuuggaaagcucgagauggauuuugaccugugugaaggcacaaccgugguggucacggaggauugcgggaaucggggacccucucugagaacaaccacagccuccggcaaacucauuaccgaauggugcugucggagcugcacacugccuccgcuucgcuacagaggcgaggacggguguugguacggaauggagauccggccccugaaggaaaaggaggaaaaccucguuaauucccuggugaccgcuggccaugggcagauugauaacuucucucugggagugcuuggcauggcgcucuuucuggaggaaaugcugagaacgcgcaucgggaccaaacacgccauccuccuggucgcugugagcuucguuacacuuauuaccggaaauauguccuuucgggaccugggcagagugauggucauggugggcgccacaaugaccgaugacaucgggaugggaguuacguaucucgcccugcuggcugccuucaaggugcgcccuacauuugcggcuggccuucugcucagaaaacugaccucuaaggagcucaugauggccacaauugggaucgcccugcuuagccaguccaccauucccgagaccauccuggaacucacagaugcucuggcccugggaaugaugguccuuaaaaucgugcgggacauggagaaguaccaacuggcgguuacgauuauggcuaucucuugcgugccuaacgccgucauucuccagaaugccuggaaggugagcuguaccauccuggcugccguguccgucagcccccuccugcuuacaucuucccagcagaaagcugacuggauuccucuggcccucaccaucaagggccugaaccccacagcgaucuuccugaccacgcuuagccgcacaucuaaaaagagauccuggccgcugaaugaagccauuauggcuguugggauggugagcauccucgccucuucccugcucaaaaacgauauuccuaugaccggaccccugguggcuggcggccuucugaccgucugcuaugugcugacagggcggagcgccgaccucgagcuggaacgcgccgcugauguuaagugggaggaccaagcggagaucuccggaagcucuccuauucuuagcaucaccauuuccgaagauggcucuaugagcaucaaaaaugaggaagaggagcagacacugacgauccucauuagaaccgggcugcucgugaucuccggagucuuucccgugucuauuccgaucacagccgcugccugguaccugugggaaguuaagaagcagcgggccggcgugcuuugggacgucccuucucccccucccguggagaaagcugaacuggaggauggggccuaucgcauuaagcagagaggaauccugggcuacucccaaaucggcgcgggggucuauaaagaaggaaccuuccacacaauguggcaugugacccggggcgcuguucucaugcaccgcgggaagagaauugagcccuccugggccgacgugaaaaaggaucugaucagcuacggaggcggguggaaacuugagggagaauggaaagagggcgaagagguccaggugcuggcccucgaaccuggcaagaacccgcgggcuguucagacgaaacccgggauuuuuaagaccaauacaggaaccaucggcgccgugucccuggacuucagcccugggacaucuggaucccccauugucgauagaaaaggcaaggugguggggcucuacggaaacggcguugucacccgcagcggcgcguaugugucugcuaucgcccagacagagaaguccaucgaggacaauccugaaauugaggaugacaucuuucggaaaaagagacugacgauuauggaccuucaucccggggccggaaaaaccaagcgcuaccugccugcuaucgugcgggaagccauuaaaagaggccugcgcacacucauccuggcuccgacccgggucguggccgcggagauggaagaggcccuuagagggcugcccauucgcuaucaaaccccugcuaucaagacagagcacacgggacgggaaaucguugaucucaugugucaugccaccuucacaaugagacugcucagccccgugcgggucccuaacuacaaccugauuaucauggacgaggcucacuucaccgaucccgccuccauugccgcucgcggcuauaucucuacaagaguggaaaugggggaggcggccggcauuuuuaugaccgcuacgccgccuggaagccgggaccccuucccccaguccaaugccccuaucauggaugaggaacgcgagauccccgaaagaagcuggaacucuggccacgaguggguuacagacuuuaaggggaaaaccgugugguucgucccuuccauuaaggccggaaaugauaucgcugccugccuucggaaaaacggcaagaaagugauucagcugagcagaaagaccuuugacucugaauacguuaagacacgcgcgaaugauugggacuucguggucaccacagauaucagcgagaugggggcuaacuuuaaagccgagcgggugauugacccgagacgcuguaugaagcccgugauccugaccgacggagaagaacgggucauccucgccggcccuaugcccguuacgcauuccucugcugcccaaagacgcgggcggauuggcagaaauccuaaaaacgaaaaugaucaguauaucuacaugggagagccccuggaaaacgacgaggauugcgcgcacuggaaggaggccaaaaugcuucuggacaauauuaacacaccggaaggcaucauuccuagcauguucgagcccgaacgcgagaagguggaugcuaucgacggggaauacagacuccggggagaggcccgcaaaaccuuuguggaucugaugagacggggcgaccugccugucuggcucgcuuauaagguggccgcugaggggauuaauuacgccgaucgcaagugguguuucgacggaaucaaaaacaaucagauccuugaagagaacauggaaguugagauuuggacaaaggagggcgaacgcaagaagcugaaaccccgguggcuggaugcgagaaucuauuccgacccucucgcccugaaggaguuuaaggaguucgcugccgggcgcaaaucucuuacccugaaccucauuacggagaugggccggcugcccaccuucaugacacagaaggcuagaaaugcccuggauaaccucgccgugcuucauaccgcugaagcgggaggccgcgccuacaaucacgcucugagcgagcugccggagacacucgaaacccugcuucugcucacacugcuggccaccgucacagggggaaucuuucucuuccuuauguccggcaaagggauuggaaagaugacacugggcaugugcugcaucaucaccgccagcauucugcucugguaugcucaaauccagccucacuggauugccgcgucuaucauucuggaguuuuuccuuaucgugcugcucauccccgaacccgagaaacagcggaccccucaggacaaccaacugacauacguugugauugccauccugaccgucguggcugccacaauggcuaaugaaaugggcuuucucgagaagacgaagaaagaccuugggcugggauccauuaccacacaggagagcgaauccaacauccuggauauugaccucagaccggccucugcguggacccuguaugccgucgcuacaaccuucgugacgcccaugcuucggcauagcaucgaaaauagcucuguuaacgugagccugaccgccauugcuaaucaggccacagugcucaugggccuggggaagggauggccucuguccaaaauggauaucggcgucccccuccuugcuaucggguguuacagccagguuaacccuauuacccugacagccgcgcugcuccugcuuguggcccacuacgcuaucauuggacccggccugcaagccaaggcuacccgcgaagcccagaaaagagccgcggcuggcaucaugaagaauccuacgguggacgggauuacagucaucgaucucgagccgauccccuaugacccuaaguuugaaaaacagcugggacaggugaugcugcucauucuuugcguuacccaagugcugaugaugcggacaaccugggcccugugugaggcucucacccuggccacaggccccaucucuacgcuuugggaggggaacccuggacgcuucuggaauaccacaauugccgucuccauggcuaacaucuuuagaggcagcuaccuggccggggcgggacuccuguucucuauuaugaagaauaccacauccacccggcgcggcacgggcaacaucggggaaacacugggagagaaauggaaaagcagacucaaugcccuuggcaaaucugaauuucagaucuauaagaaaagcgggauucaggagguggaucggacccuggcuaaggagggaaucaagcgcggcgaaaccgaccaucacgccgucuccagagggucugcuaaacugcggugguucguggagagaaacaugguuacacccgaaggaaagguggucgaucucggcugcggccgcgggggauggagcuacuauuguggcgggcugaaaaacgugcgggagguuaagggacuuaccaaaggcgggccgggacaugaggagccuauucccauguccacauacggcuggaaucuggugagacuccaaagcggcgucgacguguuuuucacgcccccugagaagugcgauacccugcugugugacaucggggaauccucucccaacccuacaauugaggccggacgcacccuccgggugcuuaaucugguugaaaacuggcugaauaacaauacacaguucugcaucaagguccucaacccguauaugcccagcgugaucgagaaaauggaagcgcugcagagaaaguacggcggggcccuugugcgcaauccucugucccggaacucuacccacgagauguacugggucagcaaugcuacgggaaacauuguuuccucugugaauaugaucagcagaaugcucauuaaccgcuuuaccaugaaacacaagaaaacaaccuaugagcccgauguggaccugggcuccgggacacggaauaucggaauugaaagcgagaucccuaaccuggacauuaucggcaagagaaucgaaaagauuaaacaggagcaugaaaccucuuggcacuacgaucaagaccaucccuauaagacaugggccuaccacggcuccuaugagaccaaacagacggggagcgcuucuuccauggucaacggagugguucgccuccuuacaaagccgugggauguggucccuauggugacccagauggccaugaccgacacaacgcccuucggccagcaacggguuuuuaaagagaagguggauaccagaacacaggaaccuaaggaggggaccaaaaagcugaugaaaaucacagcugaauggcuguggaaggagcucggcaagaagaaaacccccagaauguguacaagagaggaguucacccggaagguccgcagcaaugccgcgcugggcgccauuuuuacggacgagaacaaguggaaaucugcuagagaagccguggaggaugggcgguucugggaacuuguggacagagagcggaaucugcaccucgagggaaagugcgaaaccugugucuacaacaugaugggcaaacgcgagaagaaacugggcgaauuugggaaggcuaagggauccagagccaucugguauauguggcugggcgcccgguuccucgaguuugaagcgcugggguuccuuaaugaggaucauugguuuagccgcggaaacucccugagcggcguugagggggaaggccuccacagacugggauacauucuucgggacgugucuaaaaaggagggcggggcuauguacgccgaugacacagccggaugggacacccgcaucacacuggaagaucucaaaaaugaggaaauggugaccaaccauaugaagggcgagcacaaaaagcuggcugaggccaucuucaagcugacguaucagaauaaagucgugagaguucagcggccuacaccccgcgggaccgugauggacauuaucagcagacgggaucaacgcggauccggccaggucgggacauacggccucaacaccuuuacgaauauggaagcucagcugauuagacaaauggagggagaaggcaucuucaagucuauucagcaucuuaccgccacagaggagaucgugguucagaacuggcuggcgcggguggggcgcgaaagacucagccggauggccaucuccggagacgauugcgucgugaaaccgauugacgauagauucgcuucugcccugaccgcucuuaaugacaugggcaagguucgcaaagauauccagcaaugggagccuagccggggguggaacgacuggacacaggugcccuuuugcucccaccacuuccaugaacuggucaugaaggauggaagagugcucgucgugcccugucgcaaucaggacgagcugauuggccgggccagaaucucucagggggcgggcuggagccugaaggaaaccgccugccucggaaaauccuaugcucaaauguggacacugauguacuuucaccgccgggaucuuagacuggccgcuaacgccauuuguagcgcuguuccuucucauugggugccgaccucccgcacgacauggagcauccacgccaagcacgaguggaugaccaccgaggacaugcucgcggucuggaaccggguguggauucaggaaaaucccuggauggaggacaaaacaccuguggaaucuugggaggaaguucccuaucugggcaagagagaggaucaguggugcgggucccuuaucggacugaccagccgcgccacaugggcuaaaaacauccagacggccauuaaucaagugcggucccucaucggcaacgaggaauacaccgacuauaugccuucuaugaagagauuccggagagaggaagaggaagccgggguccugugguga

SEQ ID NO: 19829 - RNA, 9876 nt, Artificial Sequence
  derived and/or modified CDS sequence (opt5) from DENV-2__EU482599__SS-prME
accgccggcgugaucgucaugcugauucccacagcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggugaucucuugcgucccuaaugcggugauucuccagaacgcuuggaaggugagcuguaccauccuggccgccgucuccguuagcccccuccugcuuacaucuucccagcagaaggcugacuggauuccucuggcccucaccaucaaaggccugaaucccacagcuaucuuccugaccacgcuuagcagaacaucuaagaaacgguccuggccgcugaacgaggccauuauggcgguggggauggugagcauccucgccucuucccugcucaagaaugacauuccuaugaccggaccccuggucgcuggcggccuucugaccgugugcuauguucugacagggcgcagcgccgaucucgaacuggagagagcugccgacgugaaaugggaggaucaagccgaaaucuccggaagcucuccuauucuuagcaucaccauuuccgaggacggcucuaugagcaucaagaacgaagaggaggaacagacacugacgauccucauucggaccgggcugcucgucaucuccggaguguuucccguuucuauuccgaucacagcugcggccugguaccugugggaggugaaaaagcagcgcgcuggcguccuuugggaugugccuucucccccucccgucgaaaaggccgagcuggaagacggggccuauagaauuaaacagcggggaauccugggcuacucccaaaucggcgcugggguguauaaggagggaaccuuccacacaauguggcauguuacccgcggcgccgugcucaugcacagagggaaacggauugagcccuccugggcggaugucaagaaagaccugaucagcuacggaggcggguggaaacuugaaggagaguggaaggaaggcgaggaagugcagguucuggcucucgagccuggcaaaaauccgagagccgugcagacgaagcccgggauuuuuaaaaccaacacaggaaccaucggcgccgucucccuggauuucagcccugggacaucuggaucccccauuguggaccgcaagggcaaagugguugggcucuacggaaauggcgucgugacccggagcggcgcuuaugugucugccaucgcgcagacagagaaguccaucgaagauaacccugagauugaagacgauaucuuuagaaagaaacgccugacgauuauggaccuucaucccggggcuggaaagaccaaacgguaccugccugccaucgucagagaggccauuaagcgcggccugcggacacucauccuggcuccgaccagagugguugccgcugaaauggaggaggcccuucgcgggcugcccauucgguaucaaaccacagcgaucaaaacggaacacaccggaagagagaucguggaccucaugugucaugccacauucaccaugcggcugcucagcccuguccgcgugcccaacuacaaucugauuaucauggaugaagcucacuucacagacccugccuccauugcugccagaggcuauaucucuacccggguugagaugggggaggccgcuggcauuuuuaugacggcgacacccccgggaagccgcgauccuuucccccaguccaacgcccccaucauggacgaagagagagaaaucccugagcggagcuggaacucuggccacgaaugggugaccgauuuuaaggggaagaccgucugguucgugcccuccauuaaagcuggaaacgacaucgccgccugccuuagaaagaauggcaaaaagguuauucagcugagccgcaaaacauuugauucugaguacgugaagacccgggcuaacgacugggauuucgucgugacaaccgacaucagcgagaugggggccaauuuuaaggcggaaagagugauugauccucgccgguguaugaaaccggucauccugacggacggagaggaaagaguuauccucgcuggccccaugccugugacacauuccucugccgcccaacgccgggggagaauuggccgcaaccccaagaaugagaacgaccaguauaucuacaugggagaaccucuggagaaugaugaggacugcgcucacuggaaagaagccaagaugcuucuggauaacauuaauacccccgagggcaucauuccgagcauguucgaaccugagagagaaaaaguggacgcgaucgauggggaguaccggcuccgcggagaggccagaaagacauuugucgaccugaugcggcgcggcgaucugcccguguggcucgcuuauaaaguugccgcugaagggauuaacuacgccgacagaaagugguguuucgauggaaucaagaauaaccagauccuugaggaaaacauggagguggagauuuggaccaaagaaggcgagcggaagaaacugaagccuagauggcuggacgcucgcaucuauuccgauccccucgcccugaaagaauuuaaggaguucgcggccgggcggaagucucuuacgcugaaucucauuaccgaaaugggcagacugccuacauucaugacccagaaagcucgcaacgcccuggacaaucucgcuguccuucauacagccgaggccggaggccgggcuuacaaccacgcgcugagcgagcugcccgaaacccucgagacacugcuucugcucacccugcuggccacggugacagggggaaucuuucucuuccuuauguccggcaaggggauuggaaaaaugacccugggcaugugcugcaucaucaccgcuagcauucugcucugguaugcccaaauccagccgcacuggauugccgcuucuaucauucuggaauuuuuccuuaucguucugcucaucccugagcccgaaaagcagagaacaccccaggauaaucaacugaccuacguggucauugccauccugacaguggucgcggccacgauggcuaacgagaugggcuuucucgagaaaaccaagaaggaccuugggcugggauccauuacaacccaggaaagcgaguccaauauccuggacauugaucuccggccugccucugcuuggacacuguaugccguggcgaccacguucguuaccccgaugcuucgccauagcaucgaaaacuccucugugaaugugagccugacagccauugcuaaccaggccaccguccucaugggccuggggaaaggauggccccuguccaagauggacaucggcguuccucuccuugcuaucggguguuacagccaggugaaucccauuacacugaccgccgcucugcuccugcuuguggcccacuacgcgaucauuggaccuggccugcaagccaaagcuacgagagaggcccagaagcgggcugccgccggcaucaugaaaaaccccacagucgaugggauuaccgugaucgaccucgaaccuaucccguaugaucccaaguuugagaagcagcugggacagguuaugcugcucauucuuugcgugacacaaguccugaugaugcgcaccaccugggcgcugugugaggcucucacacuggccacgggcccuaucucuacccuuugggaagggaaucccggaagauucuggaacacaaccauugcuguguccauggccaauaucuuucggggcagcuaccuggccggggcuggacuccuguucucuauuaugaaaaacacaaccaauacgcgcagaggcacaggcaacaucggggagacccugggagaaaaguggaaaucccggcucaacgcccuuggcaagagcgaguuucagaucuauaaaaagucugggauucaggaggucgaccgcacccuggcgaaagaaggaaucaagagaggcgagacagaucaucacgccgugagccggggguccgcuaagcugagaugguucguugaacgcaauauggugaccccugagggaaaagucguggaccucggcugcggcagagggggauggucuuacuauuguggcgggcugaagaacguucgggaagugaaaggacuuacaaagggcgggcccggacaugaggagccgauuccuaugagcacguacggcuggaaucugguccgccuccaauccggcguggauguguuuuucacaccgcccgaaaaaugcgacacacugcugugugauaucggggagagcuccccuaaccccaccauugaagccggacggacacucagaguucuuaaucuggucgagaacuggcugaauaacaauacccaguucugcaucaaggugcucaacccuuauaugccgucugugaucgaaaagauggaggcucugcagcgcaaauacggcggggcccuuguccggaauccccugagcagaaacuccacgcacgagauguacuggguuucuaaugcgaccggaaacauugugagcuccgugaauaugaucucucgcaugcucauuaaccgguuuacaaugaagcacaaaaaggccaccuaugaaccugacgucgaucugggcagcgggacaagaaacaucggaauugaguccgaaauccccaaucuggacauuaucggcaaacgcaucgagaagauuaagcaggaacaugagaccagcuggcacuacgaccaagaucauccuuauaaaacaugggcuuaccacggcucuuaugagaccaagcagacgggguccgccagcucuauggugaacggaguugugcggcuccuuacaaaacccugggacgucgugccgaugguuacccagauggcuaugaccgauacaacgccuuucggccagcaaagaguguuuaaggaaaaagucgacacccgcacacaggagcccaaggaagggaccaagaaacugaugaagaucacagccgaguggcuguggaaagagcucggaaagaaaaagaccccuagaauguguacacgggaagaguucacccgcaaagugagauccaaugcugcccugggcgcgauuuuuacggaugaaaacaaguggaaaagcgcccgggaggcuguggaagacgggagauucugggagcuugucgaucgggagcgcaaucugcaccucgaaggaaaaugcgagaccuguguuuacaacaugaugggcaagagagagaagaagcugggcgaguuugggaaagccaagggaucucgggcuaucugguauauguggcugggcgcccgcuuccucgaauuugaggcccugggguuccuuaaugaggaccauugguuuuccagaggaaacagccuguccggcguggaaggggagggccuccaccggcugggauacauucuucgcgaugugggcaagaaagaagggggagcgauguacgcugacgauacagccggcugggacaccagaaucacacuggaggaccucaagaaugaagagauggucaccaaccauaugaaaggggagcacaagaaacuggccgaagcuaucuucaagcugacguaucagaauaaggugguucgggugcagcgccccacaccuagaggaaccgucauggauauuaucagccggcgcgaccaaagaggcucuggacaggugggcacauacggacucaacaccuuuacgaauauggaggcccagcugauucggcaaauggaaggcgaggggaucuucaaaagcauucagcaucuuaccgcuacagaggaaaucgccguucagaacuggcuggcgcgcgugggaagagagcggcucuccagaauggccaucucuggcgaugacugcgucgugaagcccauugaugaccgcuucgcuagcgcccugaccgcucuuaaugauauggggaaaguucggaaggacauccagcaaugggaaccguccagaggauggaacgauuggacacaggugccuuuuugcucucaccacuuccaugagcuggucaugaaagacggccgcgugcucgucgugcccugucggaaccaggaugaacugauugggagagcccgcaucagccagggcgcgggauggucccugaaggagaccgccugccucggcaagucuuaugcucaaauguggacacugauguacuuucaccggagagaccuucgccuggccgcuaaugccauuuguagcgcuguucccucccauugggugccuaccagccggacgacauggucuauccacgccaaacacgaguggaugaccaccgaagauaugcucgcggucuggaacagaguguggauucaggagaauccguggauggaagacaagacacccguggaguccugggaagagguuccuuaucuggggaaacgcgaggaccaguggugcggaagccuuaucggccugaccucucgggccacaugggcuaagaacauccagacggccauuaaucaagugagaucccucaucgggaacgaagaguacaccgauuauaugcccagcaugaaacgguucagacgcgaagaggaagaggccggaguccugugguga

SEQ ID NO: 19830 - RNA, 9876 nt, Artificial Sequence
  derived and/or modified CDS sequence (opt5) from DENV-2__FJ898436__SS-prME
accgccggcgugaucgucaugcugauucccacagcuauggccuuccaccucacgaccagaaauggggagccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuaugugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaaccuuccacacaauguggcaugugacccgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuacggaaauggcguugucacccggagcggcgccuaugugucugcgaucgcucagacagagaaguccaucgaagauaacccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagagucguggcugccgaaauggaggaggcgcuucgcgggcugcccauucgguaucaaaccacagccaucaaaacggaacacaccggaagagagaucguugaccucaugugucaugcuacauucaccaugcggcugcucagcccugugcgcguccccaacuacaaucugauuaucauggaugaagcccacuucacagacccugcuuccauugccgccagaggcuauaucucuacccggguggagaugggggaggcugcgggcauuuuuaugacggccacacccccgggaagccgcgauccuuucccccaguccaacgcucccaucauggacgaagagagagaaaucccugagcggagcuggaacucuggccacgaauggguuaccgauuuuaaggggaagaccgugugguucguccccuccauuaaagccggaaacgacaucgccgcuugccuuagaaagaauggcaaaaaggugauucagcugagccgcaaaacauuugauucugaguacguuaagacccgggccaacgacugggauuucguggucacaaccgacaucagcgagaugggggcgaauuuuaaggcugaaagagugauugauccucgccgguguaugaaaccggugauccugacggacggagaggaaagagucauccucgccggccccaugccuguuacacauuccucugccgcucaacgccgggggagaauuggccgcaaccccaagaaugagaacgaccaguauaucuacaugggagaaccucuggagaaugaugaggacugcgcccacuggaaagaagcgaagaugcuucuggauaacauuaauacccccgagggcaucauuccgagcauguucgaaccugagagagaaaaaguggacgccaucgauggggaguaccggcuccgcggagaggcuagaaagacauuuguggaccugaugcggcgcggcgaucugcccgucuggcucgccuauaaaguggcugccgaagggauuaacuacgcugacagaaagugguguuucgauggaaucaagaauaaccagauccuugaggaaaacauggagguugagauuuggaccaaagaaggcgagcggaagaaacugaagccuagauggcuggacgcccgcaucuauuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccgugcuucauacagccgaggcuggaggccgggcguacaaccacgcccugagcgagcugcccgaaacccucgagacacugcuucugcucacccugcuggcuacggucacagggggaaucuuucucuuccuuauguccggcaaggggauuggaaaaaugacccugggcaugugcugcaucaucaccgccagcauucugcucugguaugcccaaauccagccgcacuggauugcugccucuaucauucuggaauuuuuccuuaucgugcugcucaucccugagcccgaaaagcagagaacaccccaggauaaucaacugaccuacguugugauugcgauccugacagucguggccgcuacgauggccaacgagaugggcuuucucgagaaaaccaagaaggaccuugggcugggauccauuacaacccaggaaagcgaguccaauauccuggacauugaucuccggccugcuucugccuggacacuguaugcggucgccaccacguucgugaccccgaugcuucgccauagcaucgaaaacuccucuguuaaugugagccugacagcuauugccaaccaggcuaccgugcucaugggccuggggaaaggauggccccuguccaagauggacaucggcgucccucuccuugccaucggguguuacagccagguuaaucccauuacacugaccgcugcccugcuccugcuuguggcgcacuacgccaucauuggaccuggccugcaagcuaaagccacgagagaggcucagaagcgggccgccgcgggcaucaugaaaaaccccacaguggaugggauuaccgucaucgaccucgaaccuaucccguaugaucccaaguuugagaagcagcugggacaggugaugcugcucauucuuugcguuacacaagugcugaugaugcgcaccaccugggcucugugugaggcccucacacuggcuacgggcccuaucucuacccuuugggaagggaaucccggaagauucuggaacacaaccauugccgucuccauggccaauaucuuucggggcagcuaccuggcuggggccggacuccuguucucuauuaugaaaaacacaaccaauacgcgcagaggcacaggcaacaucggggagacccugggagaaaaguggaaaucccggcucaacgcgcuuggcaagagcgaguuucagaucuauaaaaagucugggauucaggagguggaccgcacccuggccaaagaaggaaucaagagaggcgagacagaucaucacgcugucagccggggguccgccaagcugagaugguucguggaacgcaauaugguuaccccugagggaaaaguggucgaccucggcugcggcagagggggauggucuuacuauuguggcgggcugaagaacgugcgggaaguuaaaggacuuacaaagggcgggcccggacaugaggagccgauuccuaugagcacguacggcuggaaucuggugcgccuccaauccggcgucgauguguuuuucacaccgcccgaaaaaugcgacacacugcugugugauaucggggagagcuccccuaaccccaccauugaagcuggacggacacucagagugcuuaaucugguugagaacuggcugaauaacaauacccaguucugcaucaagguccucaacccuuauaugccgucugugaucgaaaagauggaggcccugcagcgcaaauacggcggggcgcuugugcggaauccccugagcagaaacuccacgcacgagauguacugggucucuaaugccaccggaaacauuguuagcuccgugaauaugaucucucgcaugcucauuaaccgguuuacaaugaagcacaaaaaggcuaccuaugaaccugacguggaucugggcagcgggacaagaaacaucggaauugaguccgaaauccccaaucuggacauuaucggcaaacgcaucgagaagauuaagcaggaacaugagaccagcuggcacuacgaccaagaucauccuuauaaaacaugggccuaccacggcucuuaugagaccaagcagacgggguccgcuagcucuauggucaacggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagaucacagcugccuggcuguggaaagagcucggaaagaaaaagaccccuagaauguguacacgggaggaguucacccgcaaagucagauccaaugcggcccugggcgcuauuuuuacggaugagaacaaguggaaaagcgcccgggaagcuguggaggacgggagauucugggaacuuguggaucgggagcgcaaucugcaccucgagggaaaaugcgaaaccugugucuacaacaugaugggcaagagagagaaaaagcugggcgaauuugggaaagccaagggaucucgggccaucugguauauguggcugggcgcgcgcuuccucgaguuugaagcucugggguuccuuaaugaggaccauugguuuuccagaggaaacagccuguccggcguugagggggaaggccuccaccggcugggauacauucuucgcgaugugggcaagaaagaagggggagccauguacgccgacgauacagcuggcugggacaccagaaucacacuggaagaccucaagaaugaggaaauggugaccaaccauaugaaaggggagcacaagaaacuggccgaggcuaucuucaagcugacguaucagaauaaggucgugcggguucagcgccccacaccuagaggaaccgugauggauauuaucagccggcgcgaccaaagaggcucugggcaggucggcacauacggacucaacaccuuuacgaauauggaagcccagcugauucggcaaauggagggcgaagggaucuucaaaagcauucagcaucuuaccgcgacagaggagaucgccgugcagaacuggcuggcucgcguuggaagagaacggcucuccagaauggccaucucuggcgaugacugcguggucaagcccauugaugaccgcuucgcuagcgcccugaccgcgcuuaaugauauggggaaagugcggaaggacauccagcaaugggagccguccagaggauggaacgauuggacacagguuccuuuuugcucucaccacuuccaugaacuggugaugaaagacggccgcguccucgugguccccugucggaaccaggaugagcugauugggagagcccgcaucagccagggcgcuggauggucccugaaggaaaccgccugccucggcaagucuuaugcucaaauguggacacugauguacuuucaccggagagaccuucgccuggccgcuaaugccauuuguagcgcggugcccucccauuggguuccuaccagccggacgacauggucuauccacgccaaacacgaguggaugaccaccgaggauaugcucgcuguguggaacagagucuggauucaggaaaauccguggauggaggacaagacacccguggaauccugggaggaagugccuuaucuggggaaacgcgaggaccaguggugcggaagccuuaucggccugaccucucgggccacaugggccaagaacauccagacggcuauuaaucaaguuagaucccucaucgggaacgaggaauacaccgauuauaugcccagcaugaaacgguucagacgcgaggaagaggaagccggagugcugugguga

SEQ ID NO: 19831 - RNA, 9876 nt, Artificial Sequence
  derived and/or modified CDS sequence (opt5) from DENV-2__EU482634__SS-prME
accgccggcgugaucgucaugcugauucccacggcuauggccuuccaccucacgaccagaaacggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcacagacgggaaaagcgcuccgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuggccgaaaaugaggugaagcugacaaucaugaccggcgacauuaaagggaucaugcaggcgggaaagcggucccuuagaccucaacccacggaacucaaauauucuuggaagaccuggggcaaggccaaaaugcugagcacagagucccauaaccagaccuuccugauugaugggccugaaacagcugagugccccaauaccaaccgcgccuggaauagccucgagguugaagacuacggauuuggcguguucacaaccaacaucuggcugaaacuucgggagaaacaggacgucuuuugugauucuaagcugauguccgcugccaucaaagacaauagagcggugcacgccgauaugggcuauuggauugaaagcgcucucaacgacacguggaagauggagaaggccucuuucaucgagguuaaauccugccacuggccuaagagccauacacuguggucuaauggggugcuggaaagcgagaugauuauccccaaaaacuucgcuggaccggucucccagcacaacuaccgcccuggcuaucauacccaaaccgccgggcccuggcaccuuggaaagcucgaaauggauuuugaccugugugagggcacaaccgugguggucacggaagauugcgggaaucggggacccagccugagaacaaccacagccucuggcaaacucauuaccgaguggugcugucgguccugcacacugccuccgcuucgcuacagaggcgaggacggguguugguacggaauggaaauccggccccugaaggagaaggaagagaaccucguuaauagccuggugaccgcuggccaugggcagauugauaacuucucccugggagugcuuggcauggcgcucuuucuggaagagaugcugagaacgcgcaucgggaccaaacacgccauccuccuggucgcugugucuuucguuacacuuauuaccggaaauaugagcuuucgggaccugggcagagugauggucauggugggcgccacaaugaccgaugacaucgggaugggaguuacguaucucgcccugcuggcugccuucaaggugcgcccuacauuugcggcuggccuucugcucagaaaacugaccuccaaggagcucaugauggccacaauugggaucgcccugcuuucucagagcaccauucccgaaaccauccuggagcucacagaugcucuggcccugggaaugaugguccuuaaaaucgugcggaacauggaaaaguaccaacuggcgguuacgauuauggcuaucuccugcgugccuaaugccgucauucuccagaacgccuggaaggugucuuguaccauccuggcugccgugagcgucagcccccuccugcuuacaagcucucagcagaaagcugacuggauuccucuggcccucaccaucaagggccugaaucccacagcgaucuuccugaccacgcuuucccgcacaaacaaaaagagaagcuggccgcugaaugaggccauuauggcuguugggauggugucuauccucgccuccagccugcucaaaaacgacauuccuaugaccggaccccugguggcuggcggccuucugaccgucugcuaugugcugacagggcggucugccgaucucgaacuggagcgcgccgcugacguuaagugggaggaucaagcggaaaucuccggaagcuccccuauucuuagcaucaccauuucugaggacggcagcauguccaucaaaaaugaagaggaggaacagacacugacgauccucauuagaaccgggcugcucgugaucucuggagucuuucccgugagcauuccgaucacagccgcugccugguaccugugggagguuaagaagcagcgggccggcgugcuuugggaugucccuucucccccucccguggaaaaagcugagcuggaagacggggccuaucgcauuaagcagagaggaauccugggcuacagccaaaucggcgcgggggucuauaaagagggaaccuuccacacaauguggcaugugacccggggcgcuguucucaugcaccgcgggaagagaauugagcccagcugggccgaugugaaaaaggaccugaucuccuacggaggcggguggaaacuugaaggagaguggaaagaaggcgaggaaguccaggugcuggcccucgagccuggcaagaacccgcgggcuguucagacgaaacccgggauuuuuaagaccaauacaggaaccaucggcgccgugucucuggauuucagcccugggacauccggaagccccauugucgacagaaaaggcaaggugguggggcucuacggaaacggcguugucacccgcucuggcgcguauguguccgcuaucgcccagacagaaaaguccaucgaagauaacccugagauugaagacgauaucuuucggaaaaagagacugacgauuauggaccuucaucccggggccggaaaaaccaagcgcuaccugccugcuaucgugcgggaggccauuaaaagaggccugcgcacacucauccuggcuccgacccgggucguggccgcggaaauggaggaggcccuuagagggcugcccauucgcuaucaaaccccugcuaucaagacagaacacacgggacgggagaucguugaccucaugugucaugccaccuucacaaugagacugcucucucccgugcgggucccuaauuacaaccugauuaucauggaugaagcucacuucaccgaccccgccuccauugccgcucgcggcuauaucagcacaagaguggagaugggggaggcggccggcauuuuuaugaccgcuacgccgccuggaucccgggaucccuucccccagucuaaugccccuaucauggacgaagagagagaaauccccgagagaagcuggaacuccggccacgaauggguuacagauuuuaaggggaaaaccgugugguucgucccuagcauuaaggccggaaaugacaucgcugccugccuucggaaaaacggcaagaaagugauucagcugucuagaaagaccuuugauuccgaguacguuaagacacgcgcgaaugacugggauuucguggucaccacagacaucagcgagaugggggcuaacuuuaaagccgaacgggugauugauccgagacgcuguaugaagcccgugauccugaccgacggagaggaacgggucauccucgccggcccuaugcccguuacgcauucuagcgcugcccaaagacgcgggcggauuggcagaaauccuaaaaacgagaaugaccaguauaucuacaugggagaaccccuggagaacgaugaggacugcgcgcacuggaaggaagccaaaaugcuucuggauaauauuaacacaccggagggcaucauuccuuccauguucgaacccgagcgcgaaaagguggacgcuaucgauggggaguacagacuccggggagaggcccgcaaaaccuuuguggaccugaugagacggggcgaucugccugucuggcucgcuuauaagguggccgcugaagggauuaauuacgccgaccgcaagugguguuucgauggaaucaaaaacaaccagauccuugaggaaaauauggagguugagauuuggacaaaggaaggcgagcgcaagaagcugaaaccccgguggcuggacgcgagaaucuauucugauccucucgcccugaaggaauuuaaggaguucgcugccgggcgcaaaagccuuacccugaaccucauuacggaaaugggccggcugcccaccuucaugacacagaaggcuagaaaugcccuggacaaccucgccgugcuucauaccgcugaggcgggaggccgcgccuacaaucacgcucuguccgagcugccggaaacacucgagacccugcuucugcucacacugcuggccaccgucacagggggaaucuuucucuuccuuaugucuggcaaagggauuggaaagaugacacugggcaugugcugcaucaucaccgccagcauucugcucugguaugcucaaauccagccucacuggauugccgcguccaucauucuggaauuuuuccuuaucgugcugcucauccccgagcccgaaaaacagcggaccccucaggauaaccaacugacauacguugugauugccauccugaccgucguggcugccacaauggcuaaugagaugggcuuucucgagaagacgaagaaagaccuugggcugggaagcauuaccacacaggaaucugaguccaacauccuggacauugaucucagaccggccagcgcguggacccuguaugccgucgcuacaaccuucgugacgcccaugcuucggcauuccaucgaaaauucuagcguuaacgugucccugaccgccauugcuaaucaggccacagugcucaugggccuggggaagggauggccucugucuaaaauggacaucggcgucccccuccuugcuaucggguguuacagccagguuaacccuauuacccugacagccgcgcugcuccugcuuguggcccacuacgcuaucauuggacccggccugcaagccaaggcuacccgcgaggcccagaaaagagccgcggcuggcaucaugaagaauccuacgguggaugggauuacagucaucgaccucgaaccgauccccuaugauccuaaguuugagaaacagcugggacaggugaugcugcucauucuuugcguuacccaagugcugaugaugcggacaaccugggcccugugugaggcucucacccuggccacaggccccaucuccacgcuuugggaagggaacccuggacgcuucuggaauaccacaauugccgucagcauggcuaacaucuuuagaggcucuuaccuggccggggcgggacuccuguucuccauuaugaagaauaccacaagcacccggcgcggcacgggcaacaucggggagacacugggagaaaaauggaagucuagacucaacgcccuuggcaaauccgaguuucagaucuauaagaaaagcgggauucaggagguggaccggacccuggcuaaggaaggaaucaagcgcggcgagaccgaucaucacgccgucucuagagggagcgcuaaacugcggugguucguggaaagaaauaugguuacacccgagggaaagguggucgaccucggcugcggccgcgggggaugguccuacuauuguggcgggcugaaaaacgugcgggaaguuaagggacuuaccaaaggcgggccgggacaugaggagccuauucccaugucuacauacggcuggaaucuggugagacuccaaagcggcgucgauguguuuuucacgcccccugaaaagugcgacacccugcugugugauaucggggaguccagccccaacccuacaauugaagccggacgcacccuccgggugcuuaaucugguugagaacuggcugaauaacaauacaaaguucugcaucaaaguccucaacccguauaugcccuccgugaucgaaaagauggaggcgcugcagagaaaauacggcggggcccuugugcgcaauccucugucucggaacagcacccacgagauguacugggucuccaaugcuacgggaaacauuguuucuagcgugaauaugaucuccagaaugcucauuaaccgcuuuaccaugaagcacaaaaaggccacauaugaacccgacguggaucugggcucugggacccggaacaucggaauugagagcgaaaucccuaaucuggacauuaucggcaagagaaucgagaaaauuaagcaggaacaugagacauccuggcacuacgaccaggaucaucccuauaaaaccugggcuuaccacggcagcuaugagacaaagcaaaccgggucugccuccagcauggucaacggagugguucgccuccuuacgaaaccgugggacguggucccuauggugacacagauggcuaugaccgauaccacacccuucggccagcagcggguuuuuaaggaaaagguggacacgagaacccaagagccuaaagaagggacaaagaaacugaugaagaucaccgccgaguggcuguggaaagagcucggaaagaaaaagacaccccgcauguguaccagagaagaguucacacggaagguccgcucuaaugcggcccugggcgcuauuuuuaccgaugaaaacaaauggaaguccgccagagaggcuguggaagacgggcgguucugggagcuuguggauagagagcggaaucugcaccucgaaggaaaaugcgagacgugugucuacaacaugaugggcaagcgcgagaagaagcugggcgaguuugggaaggccaaaggaagcagagccaucugguauauguggcugggcgcgcgguuccucgaauuugaggcucugggguuccuuaaugaggaccauugguuuucucgcggaaacucccugagcggcguugaaggggagggccuccacagacugggauacauucuucgggauguguccaagaaagaaggcggggccauguacgccgacgauaccgcuggaugggacacacgcaucacccuggaggaccucaagaaugaagagauggugacaaaccauaugaaaggcgagcacaagaagcuggccgaagcuaucuucaaacugaccuaucagaauaaggucgugagaguucagcggccuacgccccgcgggacagugauggauauuaucagcagacgggaccagcgcggaucuggccaagucgggaccuacggccucaacacauuuaccaauauggaggcccagcugauuagacagauggaaggagagggcaucuucaaaagcauucaacaucuuacggcgaccgaggaaaucgugguucagaacuggcuggcccggguggggcgcgagagacucucccggauggcuaucucuggagaugacugcgucgugaagccgauugaugacagauucgccagcgcucugacagcccuuaaugauaugggcaaaguucgcaaggacauccagcagugggaaccuucccggggguggaacgauuggacccaagugcccuuuugcucucaccacuuccaugagcuggucaugaaggacggaagagugcucgucgugcccugucgcaaccaggaugaacugauuggccgggcgagaaucagccagggggccggcuggucccugaaagagacagcuugccucggaaagucuuaugcccagauguggacccugauguacuuucaccgccgggaccuuagacuggcugccaaugcuauuuguagcgccguuccuucccauugggugccgacaagccgcaccacguggucuauccacgcgaaacacgaguggaugacaaccgaagauaugcucgccgucuggaaccggguguggauucaagagaaucccuggauggaagacaagaccccuguggaguccugggaagagguucccuaucugggcaaaagagaggaccaguggugcgggagccuuaucggacugacaucucgcgcuaccugggccaagaacauccagacagccauuaaucaggugcggucccucaucggcaacgaagaguacacggauuauaugccuagcaugaagagauuccggagagaagaggaagaggcugggguccugugguga

SEQ ID NO: 19832 - RNA, 9876 nt, Artificial Sequence
  derived and/or modified CDS sequence (opt5) from DENV-2__EU482635__SS-prME
accgccggcgugaucgucaugcugauucccacagcuauggccuuccaccucacgaccagaaauggggagccucauaugaucguuggacggcaggaaaagggcaagagccugcuuuuuaagaccgaggacggggugaauaugugcacccugauggcgauugaucucggagaacugugugaggacacaaucaccuacaaaugcccccuucugcgccaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucuguccgaggaacaggacaaacgcuuuaucugcaagcauagcaugguggauagaggcuggggcaauggguguggacuguucggcaaagggggaauugucacaugcgccauguuuacgugcaaaaagaacauggaaggcaaaguugugcagccugagaaucucgaauacaccaucgugauuacaccccacucuggggaggagcaugcggucggaaacgacaccggcaagcacggcaaagaaaucaagaucacaccucaguccagcauuaccgaggccgaacugacgggguauggaaccgugacaauggaguguucuccccggaccggccuugauuucaaugaaaugguucugcuccaaauggaggacaaggcuuggcuggugcaccgccagugguuucuugaucugccgcucccuuggcugcccggggccgacacacagggauccaacuggauccagaaggagacccuggucacguucaagaauccucaugcuaaaaagcaagacgugguugugcucggcagccaggaaggggccaugcacacagcccugaccggcgcuacagagauucagauguccucuggaaaccuucuguuuaccggccaucucaaaugcagacugcggauggauaaacuucaacugaaagggaugagcuacuccauguguaccggaaaguucaagaucgucaaagaaauugcggagacacagcacggcacgaucgugaucagaguccaguaugagggggacggaagccccugcaagauucccuucgaaaucaccgaucucgagaaacgccaugugcugggccggcugauuacaguuaauccuaucgugaccgaaaaggacucuccggucaacauugaggccgaacccccuuuuggggauuccuacaucauuaucggcguggagcccggacagcucaaacugaacugguucaagaagggcagcucuaucgggcaaauguuugagacaaccaugagaggagcuaaacgcauggccauucuuggcgacacggccugggauuucgggagccugggaggcguuuuuacauccaucgggaaggcucuccaccagguguucggcgccauuuacggagcggcuuuuucuggcgucagcuggaccaugaaaauccugauuggggugaucaucaccuggauuggaaugaacucccggagcacaucucuguccgugagccuuguucucgucggcguggugacccuguaucugggggccaugguccaggccgacucuggaugugugguuuccuggaagaacaaagaacucaagugcggcagcgggaucuucauuacagauaaugugcacacguggaccgagcaguacaaguuucaaccugaaucccccucuaaacuggcuagcgccauccagaaggcucaugaggaaggcauuuguggaaucagauccgucacacgccuugagaaccugauguggaaacagaucaccccggagcucaaucacauucugucugaaaacgaggugaagcugacaaucaugaccggcgacauucgggggaucaugcaggccggaaaaagaagccuucgcccucaacccacggaacucaaguauuccuggaaaaccuggggcaaggcgaagaugcugagcacagagucucauaaucagaccuuccugauugaugggccugaaacagccgagugccccaacaccaaucgggcuuggaacucccucgagguugaagacuacggauuuggcguguucacaaccaauaucuggcugaaacuuagagagaagcaggacgucuuuugugauagcaaacugaugucugccgcuaucaaggacaaccgcgccgugcacgcggauaugggcuauuggauugaauccgcccucaaugacacguggaaaauggagaaggcuagcuucaucgagguuaagucuugccacuggccuaaaagccauacacugugguccaacggggugcuggaaagcgagaugauuauccccaagaauuucgccggaccggucucucagcacaacuaccggccuggcuaucauacccaaaccgcugggcccuggcaccuuggaaaacucgaaauggauuuugaccugugugagggcacaaccgugguggucacggaagauugcgggaacagaggacccucccugcggacaaccacagccagcggcaagcucauuaccgaguggugcugucgcuccugcacacugccuccgcuuagauaccggggcgaggacggguguugguacggaauggaaaucagaccccugaaagagaaggaagagaaucucguuaacucucuggugaccgccggccaugggcagauugauaauuucagccugggagugcuuggcauggcucucuuucuggaagagaugcugcgcacgcggaucgggaccaagcacgcgauccuccuggucgccguguccuucguuacacuuauuaccggaaacaugucuuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccagcaaagagcucaugauggcuacaauugggaucgcccugcuuucccagucuaccauucccgaaaccauccuggagcucacagaugcccuggcucugggaaugaugguccuuaagaucgugcgcaauauggaaaaauaccaacuggccguuacgauuauggcgaucagcugcgugccuaacgcugucauucuccagaaugccuggaagguguccuguaccauccuggccgcugugagcgucucuccccuccugcuuacauccagccagcagaaggccgacuggauuccucuggcucucaccaucaaaggccugaaccccacagccaucuuccugaccacgcuuucuagaacauccaagaaacggagcuggccgcugaaugaggcgauuauggccguugggauggugucuauccucgcuuccagccugcucaagaacgacauuccuaugaccggaccccugguggccggcggccuucugaccgucugcuaugugcugacagggcgcuccgcugaucucgaacuggagagagccgccgacguuaaaugggaggaucaagcugaaaucagcggaucuagcccuauucuuuccaucaccauuucugaggacggcagcauguccaucaagaaugaagaggaggaacagacacugacgauccucauucggaccgggcugcucgugaucucuggagucuuucccgugagcauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacagccaaaucggcgccggggucuauaaggagggaaccuuccacacaauguggcaugugacccgcggcgcgguucucaugcacagagggaaacggauugagcccagcugggcugaugugaagaaagaccugaucuccuacggaggcggguggaaacuugaaggagaguggaaggaaggcgaggaaguccaggugcuggcccucgagccuggcaaaaacccgagagccguucagacgaagcccgggauuuuuaaaaccaauacaggaaccaucggcgcugugagccuggauuucucuccugggacauccggaagccccauugucgaccgcaagggcaaagugguggggcucuacggaaacggcguugucacccggucuggcgccuauguguccgcgaucgcucagacagaaaagagcaucgaagauaauccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagagucguggcugccgaaauggaggaggcgcuucgcgggcugcccauucgguaucaaaccacagccaucaaaacggaacacaccggaagagagaucguugaccucaugugucaugcuacauucaccaugcggcugcucuccccugugcgcguccccaacuacaaccugauuaucauggaugaagcccacuucacagacccugcuucuauugccgccagaggcuauaucagcacccggguggagaugggggaggcugcgggcauuuuuaugacggccacacccccgggaucccgcgauccuuucccccagagcaaugcucccaucauggacgaagagagagaaaucccugagcggucuuggaacuccggccacgaauggguuaccgauuuuaaggggaagaccgugugguucguccccagcauuaaagccggaaaugacaucgccgcuugccuuagaaagaacggcaaaaaggugauucagcugucucgcaaaacauuugauagcgaguacguuaagacccgggccaaugacugggauuucguggucacaaccgacaucuccgagaugggggcgaacuuuaaggcugaaagagugauugauccucgccgguguaugaaaccggugauccugacggacggagaggaaagagucauccucgccggccccaugccuguuacacauucuagcgccgcucaacgccgggggagaauuggccgcaaucccaagaacgagaaugaccaguauaucuacaugggagaaccucuggagaacgaugaggacugcgcccacuggaaagaagcgaagaugcuucuggauaauauuaacacccccgagggcaucauuccguccauguucgaaccugagagagaaaaaguggacgccaucgauggggaguaccggcuccgcggagaggcuagaaagacauuuguggaccugaugcggcgcggcgaucugcccgucuggcucgccuauaaaguggcugccgaagggauuaauuacgcugacagaaagugguguuucgauggaaucaagaacaaucagauccuugaggaaaacauggagguugagauuuggaccaaagaaggcgagcggaagaaacugaagccuagauggcuggacgcccgcaucuauucugauccccucgcgcugaaagaauuuaaggaguucgccgcugggcggaagucccuuacgcugaaccucauuaccgaaaugggcagacugccuacauucaugacccagaaagcccgcaaugcucuggacaaccucgccgugcuucauacagccgaggcuggaggccgggcguacaaucacgcccuguccgagcugcccgaaacccucgagacacugcuucugcucacccugcuggcuacggucacagggggaaucuuucucuuccuuaugagcggcaaggggauuggaaaaaugacccugggcaugugcugcaucaucaccgccucuauucugcucugguaugcccaaauccagccgcacuggauugcugccuccaucauucuggaauuuuuccuuaucgugcugcucaucccugagcccgaaaagcagagaacaccccaggauaaccaacugaccuacguugugauugcgauccugacagucguggccgcuacgauggccaaugagaugggcuuucucgagaaaaccaagaaggaccuugggcugggaagcauuacaacccaggaauccgagucuaacauccuggacauugaucuccggccugcuagcgccuggacacuguaugcggucgccaccacguucgugaccccgaugcuucgccauuccaucgaaaauucuagcguuaacgugucccugacagcuauugccaaucaggcuaccgugcucaugggccuggggaaaggauggccccugagcaagauggacaucggcgucccucuccuugccaucggguguuacucucagguuaaccccauuacacugaccgcugcccugcuccugcuuguggcgcacuacgccaucauuggaccuggccugcaagcuaaagccacgagagaggcucagaagcgggccgccgcgggcaucaugaaaaaucccacaguggaugggauuaccgucaucgaccucgaaccuaucccguaugaucccaaguuugagaagcagcugggacaggugaugcugcucauucuuugcguuacacaagugcugaugaugcgcaccaccugggcucugugugaggcccucacacuggcuacgggcccuaucuccacccuuugggaagggaaccccggaagauucuggaauacaaccauugccgucagcauggccaacaucuuucggggcucuuaccuggcuggggccggacuccuguucuccauuaugaaaaauacaaccagcacgcgcagaggcacaggcaacaucggggagacccugggagaaaaguggaaaucucggcucaaugcgcuuggcaagagcgaguuucagaucuauaaaaaguccgggauucaggagguggaccgcacccuggccaaagaaggaaucaagagaggcgagacagaucaucacgcugucucucgggggagcgccaagcugagaugguucguggaacgcaacaugguuaccccugagggaaaaguggucgaccucggcugcggcagagggggaugguccuacuauuguggcgggcugaagaacgugagagaaguuaaaggacuuacaaagggcgggcccggacaugaggagccgauuccuaugagcacguacggcuggaaucuggugcgccuccaauccggcgucgauguguuuuucacaccgcccgaaaaaugcgacacacugcugugugauaucggggagucuagcccuaaccccaccauugaagcuggacggacacucagagugcuuaaucugguugagaacuggcugaauaacaauacccaguucugcaucaagguccucaacccuuauaugccguccgugaucgaaaagauggaggcccugcagcgcaaauacggcggggcgcuugugcggaauccccugucuagaaacagcacgcacgagauguacugggucuccaaugccaccggaaacauuguuucuagcgugaauaugaucucccgcaugcucauuaaccgguuuacaaugaagcacaaaaaggcuaccuaugaaccugacguggaucugggcagcgggacaagaaauaucggaauugagucugaaauccccaaccuggacauuaucggcaaacgcaucgagaagauuaagcaggaacaugagaccuccuggcacuacgaccaagaucauccuuauaaaacaugggccuaccacggcagcuaugagaccaagcagacggggucugcuuccagcauggucaacggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagaucacagcugaguggcuguggaaagagcucggaaagaaaaagaccccuagaauguguacacgggaagaguucacccgcaaagucagaucuaaugccgcgcugggcgccauuuuuacggaugaaaacaaguggaaguccgcucgggaggccguggaagacgggagauucugggagcuuguggaucgggagcgcaaucugcaccucgaaggaaaaugcgagaccugugucuacaacaugaugggcaagagagagaagaagcugggcgaguuugggaaagcuaagggaagccgggccaucugguauauguggcugggcgcccgcuuccucgaauuugaggcgcugggguuccuuaaugaggaccauugguuuuccagaggaaacagccugucuggcguugaaggggagggccuccaccggcugggauacauucuucgcgaugugagcaagaaagaaggcggggcuauguacgccgacgauacagccggaugggacaccagaaucacacuggaggaccucaagaaugaagagauggugaccaaccauaugaaaggcgagcacaagaaacuggcugaagccaucuucaagcugacguaucagaauaaggucgugcggguucagcgccccacaccuagagggaccgugauggauauuaucucccggcgcgaccaaagaggaucuggccaggucgggacauacggccucaacaccuuuacgaauauggaggcucagcugauucggcaaauggaaggagagggcaucuucaaaagcauucagcaucuuaccgccacagaggaaaucgcggugcagaacuggcuggcccgcguugggagagagcggcucuccagaauggcuaucucuggagaugacugcguggucaagcccauugaugaccgcuucgccagcgcucugaccgcccuuaaugauaugggcaaagugcggaaggacauccagcaaugggaaccguccagaggguggaacgauuggacacagguuccuuuuugcucucaccacuuccaugagcuggugaugaaagacggacgcguccucgugguccccugucggaaucaggaugaacugauuggcagagcgcgcaucagccagggggccggcuggucccugaaggagaccgcuugccucggaaagagcuaugcccaaauguggacacugauguacuuucaccggagagaccuucgccuggcugccaacgcuauuuguucugccgugcccucccauuggguuccuaccagccggacgacauggucuauccacgcgaaacacgaguggaugaccaccgaagauaugcucgccguguggaacagagucuggauucaggagaauccguggauggaagacaagacacccguggaguccugggaagaggugccuuaucugggcaaacgcgaggaccaguggugcgggagccuuaucggacugaccucccgggcuacaugggccaagaacauccagacggccauuaaucaaguuagaucucucaucggcaacgaagaguacaccgauuauaugcccagcaugaaacgguucagacgcgaagaggaagaggcuggggugcugugguga

SEQ ID NO: 19833 - RNA, 9876 nt, Artificial Sequence
  derived and/or modified CDS sequence (opt5) from DENV-2__GQ199874__SS-prME
accgccggcgugaucgucaugcugauucccacagcuauggccuuccaccucacgaccagaaauggggaaccucauaugaucguuggacggcaggaaaagggcaagagccugcuuuuuaagaccgaggacggggugaauaugugcacccugauggcgauggaucucggagaacugugugaggacacaauuaccuacaagugcccccuucugcgccaaaaugaacccgaggauaucgacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggauugagaccuggauccugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacauuguccucgagcacggguccugugugacaaccauggccaagaauaagcccacacuggauuucgaacuuaucaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgucacaugcgccauguuuacgugcaaaaagaauauggaaggcaaaguugugcagccugagaaccucgaauacaccauugugaucacaccccacagcggggaggagcaugcggucggaaaugacaccggcaagcacggcaaagaaauuaagaucacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgauugugaucagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucauuggcguggagcccggacagcucaaacugaauugguucaagaagggcuccagcaucgggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucggggugauuaucaccuggaucggaaugaacagccgguccacaagccugucugugucccuuguucucgucggcguggugacccuguaucugggggccaugguccaggccgacagcggaugugugguuucuuggaagaauaaagaacucaagugcggcuccgggauuuucaucacagauaacgugcacacguggaccgagcaguacaaguuucaaccugaaagccccuccaaacuggcuucugccauucagaaggcucaugaggaaggcaucuguggaauuagaagcgucacacgccuugagaaucugauguggaaacagaucaccccggagcucaaccacauccuguccgaaaaugaggugaagcugacaauuaugaccggcgacauccgggggauuaugcaggccggaaaaagaucucuucgcccucaacccacggaacucaaguauagcuggaaaaccuggggcaaggcgaagaugcuguccacagagagccauaaccagaccuuccugaucgaugggccugaaacagccgagugccccaauaccaaccgggcuuggaacucucucgagguugaagacuacggauuuggcguguucacaaccaacauuuggcugaaacuuagagagaagcaggacgucuuuugugauuccaaacugaugagcgccgcuaucaaggacaaucgcgccgugcacgcggauaugggcuauuggaucgaaucugcccucaacgacacguggaaaauggagaaggcuuccuucauugagguuaagagcugccacuggccuaaaucucauacacuguggagcaauggggugcuggaauccgagaugaucauucccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucaucaccgaguggugcugucgcagcugcacacugccuccgcuuagauaccggggcgaggacggguguugguacggaauggaaauuagaccccugaaagagaaggaagagaaccucguuaauucccuggugaccgccggccaugggcagaucgauaacuucucucugggagugcuuggcauggcucucuuucuggaagagaugcugcgcacgcggauugggaccaagcacgcgauccuccuggucgccgugagcuucguuacacuuaucaccggaaauauguccuuuagagaccugggccgcgugauggucauggugggcgcuacaaugaccgaugacauugggaugggaguuacguaucucgcccugcuggccgcuuucaaagugagaccuacauuugccgcgggccuucugcuccggaagcugaccucuaaagagcucaugauggcuacaaucgggauugcccugcuuagccaguccaccauccccgaaaccauucuggagcucacagaugcccuggcucugggaaugaugguccuuaagaucgugcgcaacauggaaaaauaccaacuggccguuacgaucauggcgauuucuugcgugccuaaugcugucauccuccagaacgccuggaaggugagcuguaccauucuggccgcuguguccgucagcccccuccugcuuacaucuucccagcagaaggccgacuggaucccucuggcucucaccauuaaaggccugaaucccacagccaucuuccugaccacgcuuagcagaacaucuaagaaacgguccuggccgcugaacgaggcgaucauggccguugggauggugagcauucucgcuucuucccugcucaagaaugacaucccuaugaccggaccccugguggccggcggccuucugaccgucugcuaugugcugacagggcgcagcgcugaucucgaacuggagagagccgccgacguuaaaugggaggaucaagcugaaauuuccggaagcucuccuauccuuagcauuaccaucuccgaggacggcucuaugagcauuaagaacgaagaggaggaacagacacugacgauccucauccggaccgggcugcucgugauuuccggagucuuucccgugucuaucccgauuacagcggccgcuugguaccugugggagguuaaaaagcagcgcgccggcgugcuuugggaugucccuucucccccucccguggaaaaggccgagcuggaagacggggcuuauagaaucaaacagcgggggauucugggcuacucccaaaucggcgccggggucuauaaggagggaaccuuccacacaauguggcaugugacccgcggcgcgguucucaugcacagagggaaacggaucgagcccuccugggcugaugugaagaaagaccugauuagcuacggaggcggguggaaacuugaaggagaguggaaggaaggcgaggaaguccaggugcuggcccucgagccuggcaaaaauccgagagccguucagacgaagcccgggaucuuuaaaaccaacacaggaaccauuggcgcugugucccuggauuucagcccugggacaucuggaucccccaucgucgaccgcaagggcaaagugguggggcucuacggaaauggcguugucacccggagcggcgccuaugugucugcgauugcucagacagagaaguccaucgaagauaacccugagaucgaagacgauauuuuuagaaagaaacgccugacgaucauggaccuucaucccggggccggaaagaccaaacgguaccugccugccauugugagagaggcuaucaagcgcggccugcggacacucauucuggccccgaccagagucguggcugccgaaauggaggaggcgcuucgcgggcugcccauccgguaucaaaccacagccauuaaaacggaacacaccggaagagagaucguugaccucaugugucaugcuacauucaccaugcggcugcucagcccugugcgcguccccaacuacaaucugaucauuauggaugaagcccacuucacagacccugcuuccaucgccgccagaggcuauauuucuacccggguggagaugggggaggcugcgggcaucuuuaugacggccacacccccgggaagccgcgauccuuucccccaguccaacgcucccauuauggacgaagagagagaaaucccugagcggagcuggaacucuggccacgaauggguuaccgauuuuaaggggaagaccgugugguucguccccuccaucaaagccggaaacgacauugccgcuugccuuagaaagaauggcaaaaaggugauccagcugagccgcaaaacauuugauucugaguacguuaagacccgggccaacgacugggauuucguggucacaaccgacauuagcgagaugggggcgaauuuuaaggcugaaagagugaucgauccucgccgguguaugaaaccggugauucugacggacggagaggaaagagucauccucgccggccccaugccuguuacacauuccucugccgcucaacgccgggggagaaucggccgcaaccccaagaaugagaacgaccaguauauuuacaugggagaaccucuggagaaugaugaggacugcgcccacuggaaagaagcgaagaugcuucuggauaacaucaauacccccgagggcauuaucccgagcauguucgaaccugagagagaaaaaguggacgccauugauggggaguaccggcuccgcggagaggcuagaaagacauuuguggaccugaugcggcgcggcgaucugcccgucuggcucgccuauaaaguggcugccgaagggaucaacuacgcugacagaaagugguguuucgauggaauuaagaauaaccagauccuugaggaaaacauggagguugagaucuggaccaaagaaggcgagcggaagaaacugaagccuagauggcuggacgcccgcauuuauuccgauccccucgcgcugaaagaauuuaaggaguucgccgcugggcggaagucucuuacgcugaaucucaucaccgaaaugggcagacugccuacauucaugacccagaaagcccgcaacgcucuggacaaucucgccgugcuucauacagccgaggcuggaggccgggcguacaaccacgcccugagcgagcugcccgaaacccucgagacacugcuucugcucacccugcuggcuacggucacagggggaauuuuucucuuccuuauguccggcaaggggaucggaaaaaugacccugggcaugugcugcauuaucaccgccagcauccugcucugguaugcccaaauucagccgcacuggaucgcugccucuauuauccuggaauuuuuccuuauugugcugcucaucccugagcccgaaaagcagagaacaccccaggauaaucaacugaccuacguugugaucgcgauucugacagucguggccgcuacgauggccaacgagaugggcuuucucgagaaaaccaagaaggaccuugggcugggauccaucacaacccaggaaagcgaguccaauauucuggacaucgaucuccggccugcuucugccuggacacuguaugcggucgccaccacguucgugaccccgaugcuucgccauagcauugaaaacuccucuguuaaugugagccugacagcuaucgccaaccaggcuaccgugcucaugggccuggggaaaggauggccccuguccaagauggacauuggcgucccucuccuugccaucggguguuacagccagguuaaucccaucacacugaccgcugcccugcuccugcuuguggcgcacuacgccauuaucggaccuggccugcaagcuaaagccacgagagaggcucagaagcgggccgccgcgggcauuaugaaaaaccccacaguggaugggaucaccgucauugaccucgaaccuaucccguaugaucccaaguuugagaagcagcugggacaggugaugcugcucauccuuugcguuacacaagugcugaugaugcgcaccaccugggcucugugugaggcccucacacuggcuacgggcccuauuucuacccuuugggaagggaaucccggaagauucuggaacacaaccaucgccgucuccauggccaauauuuuucggggcagcuaccuggcuggggccggacuccuguucucuaucaugaaaaacacaaccaauacgcgcagaggcacaggcaacauuggggagacccugggagaaaaguggaaaucccggcucaacgcgcuuggcaagagcgaguuucagaucuauaaaaagucugggauccaggagguggaccgcacccuggccaaagaaggaauuaagagaggcgagacagaucaucacgcugucagccggggguccgccaagcugagaugguucguggaacgcaauaugguuaccccugagggaaaaguggucgaccucggcugcggccggggaggauggucuuacuauuguggcgggcugaagaacgugagagaaguuaaaggacuuacaaagggcgggcccggacaugaggagccgaucccuaugagcacguacggcuggaaucuggugcgccuccaauccggcgucgauguguuuuucacaccgcccgaaaaaugcgacacacugcugugugauauuggggagagcuccccuaaccccaccaucgaagcuggacggacacucagagugcuuaaucugguugagaacuggcugaauaacaauacccaguucugcauuaagguccucaacccuuauaugccgucugugaucgaaaagauggaggcccugcagcgcaaauacggcggggcgcuugugcggaauccccugagcagaaacuccacgcacgagauguacugggucucuaaugccaccggaaacaucguuagcuccgugaauaugauuucucgcaugcucaucaaccgguuuacaaugaagcacaaaaaggcuaccuaugaaccugacguggaucugggcagcgggacaagaaacauuggaaucgaguccgaaauucccaaucuggacaucauuggcaaacgcaucgagaagaucaagcaggaacaugagaccagcuggcacuacgaccaagaucauccuuauaaaacaugggccuaccacggcucuuaugagaccaagcagacgggguccgcuagcucuauggucaacggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagauuacagcugaguggcuguggaaagagcucggaaagaaaaagaccccuagaauguguacacgggaagaguucacccgcaaagucagauccaaugccgcgcugggcgccaucuuuacggaugaaaacaaguggaaaagcgcucgggaggccguggaagacgggagauucugggagcuuguggaucgggagcgcaaucugcaccucgaaggaaaaugcgagaccugugucuacaacaugaugggcaagagagagaagaagcugggcgaguuugggaaagcuaagggaucucgggccauuugguauauguggcugggcgcccgcuuccucgaauuugaggcgcugggguuccuuaaugaggaccauugguuuuccagaggaaacagccuguccggcguugaaggggagggccuccaccggcugggauacauccuucgcgaugugggcaagaaagaagggggagcuauguacgccgacgauacagccggcugggacaccagaauuacacuggaggaccucaagaaugaagagauggugaccaaccauaugaaaggggagcacaagaaacuggcugaagccaucuucaagcugacguaucagaauaaggucgugcggguucagcgccccacaccuagaggaaccgugauggauaucauuagccggcgcgaccaaagaggcucugggcaggucggcacauacggacucaacaccuuuacgaauauggaggcucagcugauccggcaaauggaaggcgaggggauuuucaaaagcauccagcaucuuaccgccacagaggaaauugcggugcagaacuggcuggcccgcguuggaagagagcggcucuccagaauggcuaucucuggcgaugacugcguggucaagcccaucgaugaccgcuucgccagcgcucugaccgcccuuaaugauauggggaaagugcggaaggacauucagcaaugggaaccguccagaggauggaacgauuggacacagguuccuuuuugcucucaccacuuccaugagcuggugaugaaagacggccgcguccucgugguccccugucggaaccaggaugaacugaucgggagagcgcgcauuagccagggcgccggauggucccugaaggagaccgcuugccucggcaagucuuaugcccaaauguggacacugauguacuuucaccggagagaccuucgccuggcugccaaugcuaucuguagcgccgugcccucccauuggguuccuaccagccggacgacauggucuauucacgcgaaacacgaguggaugaccaccgaagauaugcucgccguguggaacagagucuggauccaggagaauccguggauggaagacaagacacccguggaguccugggaagaggugccuuaucuggggaaacgcgaggaccaguggugcggaagccuuauuggccugaccucucgggcuacaugggccaagaacauccagacggccaucaaucaaguuagaucccucauugggaacgaagaguacaccgauuauaugcccagcaugaaacgguucagacgcgaagaggaagaggcuggagugcugugguga

SEQ ID NO: 19834 - RNA, 9876 nt, Artificial Sequence
  derived and/or modified CDS sequence (opt5) from DENV-2__EU482639__SS-prME
accgccggcgugaucgucaugcugauucccacagcuauggccuuccaccucacgaccagaaauggggagccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuaugugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaaccuuccacacaauguggcaugugacccgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuacggaaauggcguugucacccggagcggcgccuaugugucugcgaucgcucagacagagaaguccaucgaagauaacccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagagucguggcugccgaaauggaggaggcgcuucgcgggcugcccauucgguaucaaaccacagccaucaaaacggaacacaccggaagagagaucguugaccucaugugucaugcuacauucaccaugcggcugcucagcccugugcgcguccccaacuacaaucugauuaucauggaugaagcccacuucacagacccugcuuccauugccgccagaggcuauaucucuacccggguggagaugggggaggcugcgggcauuuuuaugacggccacacccccgggaagccgcgauccuuucccccaguccaacgcucccaucauggacgaagagagagaaaucccugagcggagcuggaacucuggccacgaauggguuaccgauuuuaaggggaagaccgugugguucguccccuccauuaaagccggaaacgacaucgccgcuugccuuagaaagaauggcaaaaaggugauucagcugagccgcaaaacauuugauucugaguacguuaagacccgggccaacgacugggauuucguggucacaaccgacaucagcgagaugggggcgaauuuuaaggcugaaagagugauugauccucgccgguguaugaaaccggugauccugacggacggagaggaaagagucauccucgccggccccaugccuguuacacauuccucugccgcucaacgccgggggagaauuggccgcaaccccaagaaugagaacgaccaguauaucuacaugggagaaccucuggagaaugaugaggacugcgcccacuggaaagaagcgaagaugcuucuggauaacauuaauacccccgagggcaucauuccgagcauguucgaaccugagagagaaaaaguggacgccaucgauggggaguaccggcuccgcggagaggcuagaaagacauuuguggaccugaugcggcgcggcgaucugcccgucuggcucgccuauaaaguggcugccgaagggauuaacuacgcugacagaaagugguguuucgauggaaucaagaauaaccagauccuugaggaaaacauggagguugagauuuggaccaaagaaggcgagcggaagaaacugaagccuagauggcuggacgcccgcaucuauuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccgugcuucauacagccgaggcuggaggccgggcguacaaccacgcccugagcgagcugcccgaaacccucgagacacugcuucugcucacccugcuggcuacggucacagggggaaucuuucucuuccuuauguccggcaaggggauuggaaaaaugacccugggcaugugcugcaucaucaccgccagcauucugcucugguaugcccaaauccagccgcacuggauugcugccucuaucauucuggaauuuuuccuuaucgugcugcucaucccugagcccgaaaagcagagaacaccccaggauaaucaacugaccuacguugugauugcgauccugacagucguggccgcuacgauggccaacgagaugggcuuucucgagaaaaccaagaaggaccuugggcugggauccauuacaacccaggaaagcgaguccaauauccuggacauugaucuccggccugcuucugccuggacacuguaugcggucgccaccacgcuugugaccccgaugcugcgccauagcaucgaaaacuccucuguuaaugugagccucacagcuauugccaaccaggcuaccgugcugaugggccuggggaaaggauggccccucuccaagauggacaucggcgucccucuucuggccaucggguguuacagccagguuaaucccauuacacugaccgcugcccuccugcuucugguggcgcacuacgccaucauuggaccuggccuccaagcuaaagccacgagagaggcucagaagcgggccgccgcgggcaucaugaaaaaccccacaguggaugggauuaccgucaucgaccuggaaccuaucccguaugaucccaaguucgagaagcagcugggacaggugaugcuccuuauucugugcguuacacaagugcugaugaugcgcaccaccugggcucucugugaggcccugacacuugcuacgggcccuaucucuacccugugggaagggaaucccggaagauuuuggaacacaaccauugccgucuccauggccaauaucuuccggggcagcuaccucgcuggggccggacugcuguuuucuauuaugaaaaacacaaccaauacgcgcagaggcacaggcaacaucggggagacccucggagaaaaguggaaaucccggcuuaacgcgcugggcaagagcgaguuccagaucuauaaaaagucugggauucaggagguggaccgcacccuggccaaagaaggaaucaagagaggcgagacagaucaucacgcugucagccggggguccgccaagcucagaugguuuguggaacgcaauaugguuaccccugagggaaaaguggucgaccugggcugcggcagagggggauggucuuacuauuguggcgggcuuaagaacgugcgggaaguuaaaggacugacaaagggcgggcccggacaugaggagccgauuccuaugagcacguacggcuggaaucucgugcgccugcaauccggcgucgauguguucuuuacaccgcccgaaaaaugcgagacacugcucugugacaucggggaaagcuccccuaaccccaccauugaggcuggacggacacuuagagugcugaaucugguugaaaacuggcucaauaacaauacccaguucugcaucaagguccugaacccuuauaugccgucugugaucgagaagauggaggcccuucagcgcaaauacggcggggcgcuggugcggaauccccucagcagaaacuccacgcacgaaauguacugggucucuaaugccaccggaaacauuguuagcuccgugaauaugaucucucgcaugcugauuaaccgguucacaaugaagcacaaaaaggcuaccuaugagccugauguggaccugggcagcgggacaagaaacaucggaauugaauccgagauccccaaucucgauauuaucggcaaacgcaucgaaaagauuaagcaggagcaugagaccagcuggcacuacgaccaagaccauccuuauaaaacaugggccuaccacggcucuuaugaaaccaagcagacgggguccgcuagcucuauggucaacggagugguucggcuucugacaaaacccugggauguggucccgauggugacccagauggccaugaccgacacaacgccuuuuggccagcaaagaguuuucaaggagaaaguggauacccgcacacaggaacccaaggaggggaccaagaaacugaugaagaucacagcugaguggcucuggaaagaacugggaaagaaaaagaccccuagaauguguacacgggaggaauuuacccgcaaagucagauccaaugccgcgcuuggcgccauuuucacggacgagaacaaguggaaaagcgcucgggaagccguggaggaugggagauuuugggagcugguggaccgggaacgcaaucuccaccuggagggaaaaugcgaaaccugugucuacaacaugaugggcaagagagagaaaaagcugggcgaguucgggaaagcuaagggaucucgggccaucugguauauguggcucggcgcccgcuuucuggaguucgaggcgcuuggguuucugaaugaagaucauugguucuccagaggaaacagccucuccggcguugagggggaaggccugcaccggcuuggauacauucugcgcgacgugggcaagaaagaagggggagcuauguacgccgaugacacagccggcugggauaccagaaucacacucgaagaccugaagaaugaggagauggugaccaaccauaugaaaggggaacacaagaaacuggcugaggccaucuuuaagcucacguaucagaauaaggucgugcggguucagcgccccacaccuagaggaaccgugauggacauuaucagccggcgcgaucaaagaggcucugggcaggucggcacauacggacugaacaccuucacgaauauggaagcucagcuuauucggcaaauggagggcgaggggaucuuuaaaagcauucagcaucugaccgccacagaagagaucgcggugcagaacuggcucgcccgcguuggaagagaacggcuguccagaauggcuaucucuggcgacgauugcguggucaagcccauugacgaucgcuucgccagcgcucuuaccgcccugaaugacauggggaaaauccggaaggauauucagcaaugggagccguccagaggauggaacgacuggacacaggugccuuucugcucucaccacuuucaugaacucguuaugaaagauggccgcgugcuggucgugcccugucggaaccaggacgagcugaucgggagagcgcgcauuagccagggcgccggauggucccucaaggagaccgcuugccugggcaagucuuaugcccaaauguggacacuuauguacuuccaccggagagaucugcgccucgcugccaaugcuaucuguagcgccguccccucccauugggugccuaccagccggacgacauggucuauucacgcgaaacacgaauggaugaccaccgaggacaugcuggccguuuggaacagaguguggauccaggaaaauccguggauggaggauaagacacccgucgaauccugggaggaggugccuuaucuugggaaacgcgaagaccaguggugcggaagccugaucggccucaccucucgggcuacaugggccaagaacauucagacggccaucaaucaagugagaucccugauugggaacgaggaauacaccgacuauaugcccagcaugaaacgguuuagacgcgaggaagaggaggcuggaguucugugguga

SEQ ID NO: 19835 - RNA, 9876 nt, Artificial Sequence
  derived and/or modified CDS sequence (opt5) from DENV-2__EU482766__SS-prME
accgccggcgugaucgugaugcucauucccaccgcuauggccuuccaccucacgaccagaaauggggaaccucauaugaucguuggacggcaggaaaagggcaaaagccugcuuuuuaagacggaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcucucggaccggccuugauuucaacgaaaugguucugcuccaaauggaggacaaggcuuggcuggugcaccgccagugguuucuugaucugccccucccguggcugccuggggccgacacacagggauccaauuggauccagaaggagacccuggucacguucaagaacccccaugcuaaaaagcaagacgugguugugcucggcagccaggaaggggccaugcacacagcccugaccggcgcuacagagauucagauguccucuggaaaucuucuguuuaccggccaucucaaaugcagacugcggauggauaaacuucaacugaaagggaugagcuacuccauguguaccggaaaguucaagaucgucaaagaaauugcggagacacagcacggcacgaucgugaucagaguccaguaugagggggacggaagcccuugcaagauucccuucgaaaucaccgaucucgagaaacgccaugugcugggccggcugauuacaguuaaccccaucgugaccgaaaaggacucuccugucaacauugaggccgaaccgcccuuuggggauuccuacaucauuaucggcguggagccuggacagcucaaacugaauugguucaagaagggcagcucuaucgggcaaauguuugagacaaccaugagaggagcuaaacgcauggccauucuuggcgacacggccugggauuucgggagccugggaggcguuuuuacauccaucgggaaggcucuccaccagguguucggcgccauuuacggagcggcuuuuucuggcgucagcuggaccaugaaaauccugauuggggugaucaucaccuggauuggaaugaacucccggagcacaucucuguccgugagccuuguucucgucggcguggugacccuguaucugggggccgucgugcaggccgacucuggauguguuguguccuggaagaauaaagaacucaagugcggcagcgggaucuucauuacagauaacguccacacguggaccgagcaguacaaguuucaacccgaauccccuucuaaacuggcuagcgccauccagaaggcucaugaggaaggcauuuguggaaucagauccgugacacgccuugagaaucugauguggaaacagaucacccccgagcucaaccacauucugucugaaaaugagguuaagcugacaaucaugaccggcgacauuaaagggaucaugcaggccggaaagcggagccuuagaccgcaaccuacggaacucaaauauuccuggaagaccuggggcaaggcgaaaaugcugagcacagagucucauaaccagaccuuccugauugaugggcccgaaacagccgagugcccuaauaccaaccgcgcuuggaacucccucgagguggaagacuacggauuuggcgucuucacaaccaacaucuggcugaaacuucgggagaaacaggacguguuuugugauagcaagcugaugucugccgcuaucaaagacaauagagccguucacgcggauaugggcuauuggauugaauccgcccucaacgacacguggaagauggagaaggcuagcuucaucgaggugaaaucuugccacuggcccaagagccauacacugugguccaaugggguccuggaaagcgagaugauuaucccuaaaaacuucgccggacccgugucucagcacaacuaccgcccgggcuaucauacccaaaccgcugggccuuggcaccuuggaaagcucgaaauggauuuugacuucugugagggcacaaccguggucguuacggaagauugcgggaaucggggacccucccugagaacaaccacagccagcggcaaacugauuaccgaguggugcugucgguccugcacacugcccccucugcgcuacagaggcgaggacggguguugguacggaauggaaauccggccgcuuaaggagaaggaagagaaccuggucaauucucucgugaccgccggccaugggcagauugauaacuuuagccugggaguccugggcauggcucuuuuccucgaagagaugcugagaacgcgcaucgggaccaaacacgcgauccugcucguggccguuuccuuugugacacugauuaccggaaauaugucuuuccgggaccuuggcagagucauggugaugguuggcgcuacaaugaccgaugacaucgggaugggagugacguaucuggcccuccuggccgcuuuuaagguccgccccacauucgccgcgggccugcuucugagaaaacucaccagcaaggagcugaugauggcuacaauugggaucgcccuccugucccagucuaccauuccugaaaccauccuugagcugacagaugcccucgcucugggaaugauggugcugaaaaucguucggaacauggaaaaguaccaacuugccgugacgauuauggcgaucagcugcguccccaaugcugugauucugcagaacgccuggaagguguccuguaccauccucgccgcugucagcguuucuccucugcuccugacauccagccagcagaaagccgacuggauuccccuugcucugaccaucaagggccucaauccuacagccaucuuucugaccacgcugucucgcacauccaaaaagagaagcuggccccuuaacgaggcgauuauggccguggggauggugucuauccuggcuuccagccuccugaaaaaugacauuccgaugaccggaccucucgucgccggcggccugcuuaccgugugcuauguucugacagggcgguccgcugaucuggaacucgagcgcgccgccgacgugaagugggaggaucaagcugaaaucagcggaucuagccccauucuguccaucaccauuucugaggacggcagcauguccaucaaaaacgaagaggaggaacagacacuuacgauccugauuagaaccgggcuccuggucaucucuggaguguucccuguuagcauucccaucacagcggccgcuugguaccucugggaggugaagaagcagcgggccggcguccugugggaugugccguccccucccccugucgaaaaagccgagcuugaagacggggcuuaucgcauuaagcagagaggaauccugggcuacucucaaaucggcgccgggguguauaaagagggaaccuuucacacaauguggcauguuacccggggcgcggugcugaugcaccgcgggaagagaauugagcccagcugggcugaugucaaaaaggaccucaucuccuacggaggcggguggaagcuggaaggagaguggaaagaaggcgaggaagugcagguucuugcccuggagcccggcaagaauccucgggccgugcagacgaaaccggggauuuucaagaccaacacaggaaccaucggcgcugucagccucgauuuuucucccgggacauccggaagcccuauuguggacagaaaaggcaaggugguugggcuguacggaaauggcgucgugacccgcucuggcgccuauguguccgcgaucgcucagacagaaaagagcaucgaagauaaccccgagauugaagacgauaucuuccggaaaaagagacucacgauuauggaccugcauccuggggccggaaaaaccaagcgcuaccuucccgccaucguccgggaggcuauuaaaagaggccugcgcacacugauccucgccccuacccgggugguugcugccgaaauggaggaggcgcugagagggcuuccgauucgcuaucaaacccccgccaucaagacagaacacacgggacgggagaucguggaccugaugugucaugcuaccuucacaaugagacuccuguccccuguccgggugcccaacuacaaucucauuaucauggaugaagcccacuuuaccgacccugcuucuauugccgcccgcggcuauaucagcacaagaguugagaugggggaggcugcgggcauuuucaugaccgccacgcccccgggaucccgggauccuuuuccccagagcaacgcucccaucauggacgaagaaagagaaaucccugagagaucuuggaacuccggccacgaaugggugacagauuucaaggggaaaaccgucugguuugugcccagcauuaaggccggaaacgacaucgccgcuugccugcggaaaaauggcaagaaaguuauucagcuuucuagaaagaccuucgauagcgaguacgugaagacacgcgccaacgacugggauuuugucgugaccacagacaucuccgagaugggggcgaauuucaaagcugaacgggugauugauccuagacgcuguaugaagccggucauccugaccgacggagaggaacggguuauccuggccggccccaugccugugacgcauucuagcgccgcucaaagacgcgggcggauuggcagaaaccccaaaaaugagaacgaccaguauaucuacaugggagaaccucucgagaaugaugaggacugcgcccacuggaaggaagcgaaaaugcugcuugauaacauuaauacacccgagggcaucauuccguccauguuugaaccugagcgcgaaaagguggacgccaucgauggggaguacagacugcggggagaggcucgcaaaaccuucgucgaccucaugagacggggcgaucugcccguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccucgguggcuggacgccagaaucuauucugauccccuggcgcucaaggaguucaaggaguucgccgcugggcgcaaaagccugacccuuaaucugauuacggaaaugggccggcucccuaccuuuaugacacagaaggccagaaacgcucuggacaaucuggccguccuccauaccgccgaggcuggaggccgcgcguacaaccacgcccuuuccgagcugcccgaaacacuggagacccuccugcuucugacacuccuggcuaccgugacagggggaaucuuccuguuucucaugagcggcaaagggauuggaaagaugacacuuggcaugugcugcaucaucaccgccucuauucugcugugguaugcccaaauccagccgcacuggauugcugccuccaucauucucgaguucuuucugaucguucuucugaucccugagcccgaaaaacagcggacaccccaggauaaucaacucacauacguggucauugcgauccugaccguggucgccgcuacaauggccaacgagaugggcuuccuggagaagacgaagaaagaccucgggcuuggaagcauuaccacacaggaauccgagucuaauauccuggacauugaucugagaccugcuagcgccuggacccucuaugcgguggccacaaccuuuguuacgccgaugcugcggcauuccaucgaaaacucuagcgugaaugugucccuuaccgcuauugccaaccaggcuacaguccugaugggccucgggaagggauggccccugagcaaaauggacaucggcguuccucugcucgccaucggguguuacucucaggugaaucccauuacccuuacagcugcccugcugcuccugguggcgcacuacgccaucauuggaccuggccuucaagcuaaggccacccgcgaggcucagaaaagagccgccgcgggcaucaugaagaaccccacggucgaugggauuacagugaucgaccuggaaccuaucccguaugaucccaaguucgagaaacagcucggacagguuaugcugcugauucucugcgugacccaaguccuuaugaugcggacaaccugggcucugugugaggcccugacccucgcuacaggcccuaucuccacgcugugggaagggaaucccggacgcuuuuggaacaccacaauugccgugagcauggccaauaucuucagaggcucuuaccuugcuggggccggacugcucuuuuccauuaugaagaacaccacaagcacccggcgcggcacgggcaauaucggggagacacugggagaaaaauggaagucuagacugaacgcgcucggcaaaagcgaguuccagaucuauaagaaauccgggauucaggaggucgaccggacccuugccaaggaaggaaucaagcgcggcgagaccgaucaucacgcugugucuagagggagcgccaaacugcggugguuuguugaaagaaacauggugacaccugagggaaaggucguggaccugggcugcggccgcgggggaugguccuacuauuguggcgggcucaaaaauguucgggaagugaagggacugaccaaaggcgggcccggacaugaggagccgauuccuaugagcacauacggcuggaaccuugucagacugcaauccggcguggauguguucuucacgccucccgaaaagugcgacacccuccugugugauaucggggagucuagccccaaucccacaauugaagcuggacgcacccugcggguucucaaccuugucgagaauuggcugaacaauaacacacaguuuugcaucaaggugcugaauccuuauaugccguccgugaucgagaagauggaggcccuccagagacaguacggcggggcgcugguccgcaacccccuuucucggaauagcacccacgagauguacuggguuuccaacgccacgggaaauauugugucuagcgugaacaugaucuccagaaugcugauuaaucgcuucaccaugaagcacaaaaaggcuacauaugaaccugacgucgaucucggcagcgggacccggaacaucggaauugagucugaaauccccaaccuggacauuaucggcaaaagaaucgagaagauuaagcaagaacaugagaucuccuggcacuacgaccaggaucauccuuauaaaacaugggccuaccacggcagcuaugagaccaagcagacagggucugcuuccagcauggugaauggaguugugcgccugcucaccaaacccugggacgucgugccgaugguuacgcagauggccaugacagauaccaccccuuuuggccaacagcggguguucaaggaaaaagucgacacaagaacgcaggagcccaaggaagggaccaagaaacuuaugaagauuacagcugaguggcuguggaaagagcugggaaagaaaaagaccccucgcauguguacaagagaagaguuuacccggaaagugcgcucuaacgccgcgcucggcgccaucuucacagaugaaaauaaguggaaguccgcuagagaggccguggaagacgggcgguuuugggagcuggucgauagagagcggaaccuucaccuggaaggaaaaugcgagaccuguguuuacaauaugaugggcaagcgcgagaagaagcucggcgaguucgggaaagcuaagggaagcagagccauuugguauauguggcugggcgcccgguuucuggaguucgaggcgcucggguuucugaacgaggaccauugguucucccgcggaaauagccuuucuggcguggaaggggagggccugcacagacucggauacauccugcgggaugugggcaagaaagaagggggagcuauguacgccgacgauacggccggcugggacacccgcaucacacuugaggaccugaagaacgaagagauggucaccaaucauaugaaaggggagcacaagaaacucgcugaagccauuuuuaagcugacauaucagaacaaggugguuagagugcaacggcccaccccucgcggaacggucauggauaucauuagcagacgggaccagcgcggcuccggacaggugggcacauacggacugaauaccuucacaaacauggaggcucaacucaucagacagauggaaggcgaggggauuuucaaaucuauccagcaucugaccgccacggaggaaaucgcgguucagaauuggcuugcccgggugggacgcgagagacugagccggauggcuauuuccggcgaugacugcgucgugaagcccaucgaugacagauuugccucugcucucaccgcccugaacgauauggggaaaguucgcaaggacauucaacagugggaaccgagccggggauggaaugauuggacacaggugccuuucugcucccaccacuuucaugagcuugucaugaaagacggcagagugcuggucgugcccugucgcaaccaggaugaacucaucgggcgggcgagaauuucucaaggcgccggauggagccugaaggagaccgcuugccugggcaaguccuaugcccagauguggacacucauguacuuccaccgccgggaccugagacuugcugccaacgcuaucuguagcgccguucccucucauugggugccuaccucccgcacaaccuggagcauucacgcgaaacacgaguggaugacgacagaagauaugcuggccgucuggaaucggguguggauccaggagaacccguggauggaagacaagacccccguggagucuugggaagagguuccuuaucucgggaaaagagaggaccaguggugcggaucccugaucggccuuaccagccgcgcuacaugggccaagaauauucaaaccgccaucaaccaggugcggucccugauugggaaugaagaguacacagauuauaugcccucuaugaaaagauuucggagagaagaggaagaggcuggaguccucugguga

SEQ ID NO: 19836 - RNA, 9876 nt, Artificial Sequence
  derived and/or modified CDS sequence (opt5) from DENV-2__EU482695__SS-prME
accgccggcgugaucgucaugcugauucccacagcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuaugugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaaccuuccacacaauguggcaugugacccgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuacggaaauggcguugucacccggagcggcgccuaugugucugcgaucgcucagacagagaaguccaucgaagauaacccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagagucguggcugccgaaauggaggaggcgcuucgcgggcugcccauucgguaucaaaccacagccaucaaaacggaacacaccggaagagagaucguugaccucaugugucaugcuacauucaccaugcggcugcucagcccugugcgcguccccaacuacaaucugauuaucauggaugaagcccacuucacagacccugcuuccauugccgccagaggcuauaucucuacccggguggagaugggggaggcugcgggcauuuuuaugacggccacacccccgggaagccgcgauccuuucccccaguccaacgcucccaucauggacgaagagagagaaaucccugagcggagcuggaacucuggccacgaauggguuaccgauuuuaaggggaagaccgugugguucguccccuccauuaaagccggaaacgacaucgccgcuugccuuagaaagaauggcaaaaaggugauucagcugagccgcaaaacauuugauucugaguacguuaagacccgggccaacgacugggauuucguggucacaaccgacaucagcgagaugggggcgaauuuuaaggcugaaagagugauugauccucgccgguguaugaaaccggugauccugacggacggagaggaaagagucauccucgccggccccaugccuguuacacauuccucugccgcucaacgccgggggagaauuggccgcaaccccaagaaugagaacgaccaguauaucuacaugggagaaccucuggagaaugaugaggacugcgcccacuggaaagaagcgaagaugcuucuggauaacauuaauacccccgagggcaucauuccgagcauguucgaaccugagagagaaaaaguggacgccaucgauggggaguaccggcuccgcggagaggcuagaaagacauuuguggaccugaugcggcgcggcgaucugcccgucuggcucgccuauaaaguggcugccgaagggauuaacuacgcugacagaaagugguguuucgauggaaucaagaauaaccagauccuugaggaaaacauggagguugagauuuggaccaaagaaggcgagcggaagaaacugaagccuagauggcuggacgcccgcaucuauuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccgugcuucauacagccgaggcuggaggccgggcguacaaccacgcccugagcgagcugcccgaaacccucgagacacugcuucugcucacccugcuggcuacggucacagggggaaucuuucucuuccuuauguccggcaaggggauuggaaaaaugacccugggcaugugcugcaucaucaccgccagcauucugcucugguaugcccaaauccagccgcacuggauugcugccucuaucauucuggaauuuuuccuuaucgugcugcucaucccugagcccgaaaagcagagaacaccccaggauaaucaacugaccuacguugugauugcgauccugacagucguggccgcuacgauggccaacgagaugggcuuucucgagaaaaccaagaaggaccuugggcugggauccauuacaacccaggaaagcgaguccaauauccuggacauugaucuccggccugcuucugccuggacacuguaugcggucgccaccacguucgugaccccgaugcuucgccauagcaucgaaaacuccucuguuaaugugagccugacagcuauugccaaccaggcuaccgugcucaugggccuggggaaaggauggccccuguccaagauggacaucggcgucccucuccuugccaucggguguuacagccagguuaaucccauuacacugaccgcugcccugcuccugcuuguggcgcacuacgccaucauuggaccuggccugcaagcuaaagccacgagagaggcucagaagcgggccgccgcgggcaucaugaaaaaccccacaguggaugggauuaccgucaucgaccucgaaccuaucccguaugaucccaaguuugagaagcagcugggacaggugaugcugcucauucuuugcguuacacaagugcugaugaugcgcaccaccugggcucugugugaggcccucacacuggcuacgggcccuaucucuacccuuugggaagggaaucccggaagauucuggaacacaaccauugccgucuccauggccaauaucuuucggggcagcuaccuggcuggggccggacuccuguucucuauuaugaaaaacacaaccaauacgcgcagaggcacaggcaacaucggggagacccugggagaaaaguggaaaucccggcucaacgcgcuuggcaagagcgaguuucagaucuauaaaaagucugggauucaggagguggaccgcacccuggccaaagaaggaaucaagagaggcgagacagaucaucacgcugucagccggggguccgccaagcugagaugguucguggaacgcaauaugguuaccccugagggaaaaguggucgaccucggcugcggcagagggggauggucuuacuauuguggcgggcugaagaacgugcgggaaguuaaaggacuuacaaagggcgggcccggacaugaggagccgauuccuaugagcacguacggcuggaaucuggugcgccuccaauccggcgucgauguguuuuucacaccgcccgaaaaaugcgacacacugcugugugauaucggggagagcuccccuaaccccaccauugaagcuggacggacacucagagugcuuaaucugguugagaacuggcugaauaacaauacccaguucugcaucaagguccucaacccuuauaugccgucugugaucgaaaagauggaggcccugcagcgcaaauacggcggggcgcuugugcggaauccccugagcagaaacuccacgcacgagauguacugggucucuaaugccaccggaaacauuguuagcuccgugaauaugaucucucgcaugcucauuaaccgguuuacaaugaagcacaaaaaggcuaccuaugaaccugacguggaucugggcagcgggacaagaaacaucggaauugaguccgaaauccccaaucuggacauuaucggcaaacgcaucgagaagauuaagcaggaacaugagaccagcuggcacuacgaccaagaucauccuuauaaaacaugggccuaccacggcucuuaugagaccaagcagacgggguccgcuagcucuauggucaacggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagaucacagcugaguggcuguggaaagagcucggaaagaaaaagaccccuagaauguguacacgggaagaguucacccgcaaagucagauccaaugccgcgcugggcgccauuuuuacggaugaaaacaaguggaaaagcgcucgggaggccguggaagacgggagauucugggagcuuguggaucgggagcgcaaucugcaccucgaaggaaaaugcgagaccugugucuacaacaugaugggcaagagagagaagaagcugggcgaguuugggaaagcuaagggaucucgggccaucugguauauguggcugggcgcccgcuuccucgaauuugaggcgcugggguuccuuaaugaggaccauugguuuuccagaggaaacagccuguccggcguugaaggggagggccuccaccggcugggauacauucuucgcgaugugggcaagaaagaagggggagcuauguacgccgacgauacagccggcugggacaccagaaucacacuggaggaccucaagaaugaagagauggugaccaaccauaugaaaggggagcacaagaaacuggcugaagccaucuucaagcugacguaucagaauaaggucgugcggguucagcgccccacaccuagaggaaccgugauggauauuaucagccggcgcgaccaaagaggcucugggcaggucggcacauacggacucaacaccuuuacgaauauggaggcucagcugauucggcaaauggaaggcgaggggaucuucaaaagcauucagcaucuuaccgccacagaggaaaucgcggugcagaacuggcuggcccgcguuggaagagagcggcucuccagaauggcuaucucuggcgaugacugcguggucaagcccauugaugaccgcuucgccagcgcucugaccgcccuuaaugauauggggaaagugcggaaggacauccagcaaugggaaccguccagaggauggaacgauuggacacagguuccuuuuugcucucaccacuuccaugagcuggugaugaaagacggccgcguccucgugguccccugucggaaccaggaugaacugauugggagagcgcgcaucagccagggcgccggauggucccugaaggagaccgcuugccucggcaagucuuaugcccaaauguggacacugauguacuuucaccggagagaccuucgccuggcugccaaugcuauuuguagcgccgugcccucccauuggguuccuaccagccggacgacauggucuauccacgcgaaacacgaguggaugaccaccgaagauaugcucgccguguggaacagagucuggauucaggagaauccguggauggaagacaagacacccguggaguccugggaagaggugccuuaucuggggaaacgcgaggaccaguggugcggaagccuuaucggccugaccucucgggcuacaugggccaagaacauccagacggccauuaaucaaguuagaucccucaucgggaacgaagaguacaccgauuauaugcccagcaugaaacgguucagacgcgaagaggaagaggcuggagugcugugguga

SEQ ID NO: 19837 - RNA, 9876 nt, Artificial Sequence
  derived and/or modified CDS sequence (opt5) from DENV-2__EU482769__SS-prME
accgccggcgugaucgucaugcugauucccacagcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuaugugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaaccuuccacacaauguggcaugugacccgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuacggaaauggcguugucacccggagcggcgccuaugugucugcgaucgcucagacagagaaguccaucgaagauaacccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagagucguggcugccgaaauggaggaggcgcuucgcgggcugcccauucgguaucaaaccacagccaucaaaacggaacacaccggaagagagaucguugaccucaugugucaugcuacauucaccaugcggcugcucagcccugugcgcguccccaacuacaaucugauuaucauggaugaagcccacuucacagacccugcuuccauugccgccagaggcuauaucucuacccggguggagaugggggaggcugcgggcauuuuuaugacggccacacccccgggaagccgcgauccuuucccccaguccaacgcucccaucauggacgaagagagagaaaucccugagcggagcuggaacucuggccacgaauggguuaccgauuuuaaggggaagaccgugugguucguccccuccauuaaagccggaaacgacaucgccgcuugccuuagaaagaauggcaaaaaggugauucagcugagccgcaaaacauuugauucugaguacguuaagacccgggccaacgacugggauuucguggucacaaccgacaucagcgagaugggggcgaauuuuaaggcugaaagagugauugauccucgccgguguaugaaaccggugauccugacggacggagaggaaagagucauccucgccggccccaugccuguuacacauuccucugccgcucaacgccgggggagaauuggccgcaaccccaagaaugagaacgaccaguauaucuacaugggagaaccucuggagaaugaugaggacugcgcccacuggaaagaagcgaagaugcuucuggauaacauuaauacccccgagggcaucauuccgagcauguucgaaccugagagagaaaaaguggacgccaucgauggggaguaccggcuccgcggagaggcuagaaagacauuuguggaccugaugcggcgcggcgaucugcccgucuggcucgccuauaaaguggcugccgaagggauuaacuacgcugacagaaagugguguuucgauggaaucaagaauaaccagauccuugaggaaaacauggagguugagauuuggaccaaagaaggcgagcggaagaaacugaagccuagauggcuggacgcccgcaucuauuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccgugcuucauacagccgaggcuggaggccgggcguacaaccacgcccugagcgagcugcccgaaacccucgagacacugcuucugcucacccugcuggcuacggucacagggggaaucuuucucuuccuuauguccggcaaggggauuggaaaaaugacccugggcaugugcugcaucaucaccgccagcauucugcucugguaugcccaaauccagccgcacuggauugcugccucuaucauucuggaauuuuuccuuaucgugcugcucaucccugagcccgaaaagcagagaacaccccaggauaaucaacugaccuacguugugauugcgauccugacagucguggccgcuacgauggccaacgagaugggcuuucucgagaaaaccaagaaggaccuugggcugggauccauuacaacccaggaaagcgaguccaauauccuggacauugaucuccggccugcuucugccuggacacuguaugcggucgccaccacguucgugaccccgaugcuucgccauagcaucgaaaacuccucuguuaaugugagccugacagcuauugccaaccaggcuaccgugcucaugggccuggggaaaggauggccccuguccaagauggacaucggcgucccucuccuugccaucggguguuacagccagguuaaucccauuacacugaccgcugcccugcuccugcuuguggcgcacuacgccaucauuggaccuggccugcaagcuaaagccacgagagaggcucagaagcgggccgccgcgggcaucaugaaaaaccccacaguggaugggauuaccgucaucgaccucgaaccuaucccguaugaucccaaguuugagaagcagcugggacaggugaugcugcucauucuuugcguuacacaagugcugaugaugcgcaccaccugggcucugugugaggcccucacacuggcuacgggcccuaucucuacccuuugggaagggaaucccggaagauucuggaacacaaccauugccgucuccauggccaauaucuuucggggcagcuaccuggcuggggccggacuccuguucucuauuaugaaaaacacaaccaauacgcgcagaggcacaggcaacaucggggagacccugggagaaaaguggaaaucccggcucaacgcgcuuggcaagagcgaguuucagaucuauaaaaagucugggauucaggagguggaccgcacccuggccaaagaaggaaucaagagaggcgagacagaucaucacgcugucagccggggguccgccaagcugagaugguucguggaacgcaauaugguuaccccugagggaaaaguggucgaccucggcugcggcagagggggauggucuuacuauuguggcgggcugaagaacgugcgggaaguuaaaggacuuacaaagggcgggcccggacaugaggagccgauuccuaugagcacguacggcuggaaucuggugcgccuccaauccggcgucgauguguuuuucacaccgcccgaaaaaugcgacacacugcugugugauaucggggagagcuccccuaaccccaccauugaagcuggacggacacucagagugcuuaaucugguugagaacuggcugaauaacaauacccaguucugcaucaagguccucaacccuuauaugccgucugugaucgaaaagauggaggcccugcagcgcaaauacggcggggcgcuugugcggaauccccugagcagaaacuccacgcacgagauguacugggucucuaaugccaccggaaacauuguuagcuccgugaauaugaucucucgcaugcucauuaaccgguuuacaaugaagcacaaaaaggcuaccuaugaaccugacguggaucugggcagcgggacaagaaacaucggaauugaguccgaaauccccaaucuggacauuaucggcaaacgcaucgagaagauuaagcaggaacaugagaccagcuggcacuacgaccaagaucauccuuauaaaacaugggccuaccacggcucuuaugagaccaagcagacgggguccgcuagcucuauggucaacggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagaucacagcugaguggcuguggaaagagcucggaaagaaaaagaccccuagaauguguacacgggaagaguucacccgcaaagucagauccaaugccgcgcugggcgccauuuuuacggaugaaaacaaguggaaaagcgcucgggaggccguggaagacgggagauucugggagcuuguggaucgggagcgcaaucugcaccucgaaggaaaaugcgagaccugugucuacaacaugaugggcaagagagagaagaagcugggcgaguuugggaaagcuaagggaucucgggccaucugguauauguggcugggcgcccgcuuccucgaauuugaggcgcugggguuccuuaaugaggaccauugguuuuccagaggaaacagccuguccggcguugaaggggagggccuccaccggcugggauacauucuucgcgaugugggcaagaaagaagggggagcuauguacgccgacgauacagccggcugggacaccagaaucacacuggaggaccucaagaaugaagagauggugaccaaccauaugaaaggggagcacaagaaacuggcugaagccaucuucaagcugacguaucagaauaaggucgugcggguucagcgccccacaccuagaggaaccgugauggauauuaucagccggcgcgaccaaagaggcucugggcaggucggcacauacggacucaacaccuuuacgaauauggaggcucagcugauucggcaaauggaaggcgaggggaucuucaaaagcauucagcaucuuaccgccacagaggaaaucgcggugcagaacuggcuggcccgcguuggaagagagcggcucuccagaauggcuaucucuggcgaugacugcguggucaagcccauugaugaccgcuucgccagcgcucugaccgcccuuaaugauauggggaaagugcggaaggacauccagcaaugggaaccguccagaggauggaacgauuggacacagguuccuuuuugcucucaccacuuccaugagcuggugaugaaagacggccgcguccucgugguccccugucggaaccaggaugaacugauugggagagcgcgcaucagccagggcgccggauggucccugaaggagaccgcuugccucggcaagucuuaugcccaaauguggacacugauguacuuucaccggagagaccuucgccuggcugccaaugcuauuuguagcgccgugcccucccauuggguuccuaccagccggacgacauggucuauccacgcgaaacacgaguggaugaccaccgaagauaugcucgccguguggaacagagucuggauucaggagaauccguggauggaagacaagacacccguggaguccugggaagaggugccuuaucuggggaaacgcgaggaccaguggugcggaagcaugaucggccuuaccucucgggcuacaugggccaagaacauccagacggccauuaaucaaguuagaucccugaucgggaacgaagaguacauugauuauaugcccagcaugaaacgguucagacgcgaagaggaagaggcuggagugcucugguga

SEQ ID NO: 19838 - RNA, 9876 nt, Artificial Sequence
  derived and/or modified CDS sequence (opt5) from DENV-2__EU482696__SS-prME
accgccggagugaucgucaugcugauucccacagcuauggccuuccaccucacgacccggaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggauguguggcuucuuggaagaauaaagaacucaagugcggcuccgggaucuucauuacagauaacguucacacguggaccgagcaguacaaguuucaaccugaaagccccuccaaacuggccucugcuauccagaaggcccaugaggaaggcauuuguggaaucagaagcgugacacgccuugagaaucugauguggaaacagaucaccccggagcucaaccacauucuguccgaaaaugaggucaagcugacaaucaugaccggcgacauuaaagggaucaugcaggcgggaaagcggucucuuagaccucaacccacggaacucaaauauagcuggaagaccuggggcaaggccaaaaugcuguccacagagagccauaaccagaccuuccugauugaugggccugaaacagcugagugccccaauaccaaccgcgccuggaacucucucgagguggaagacuacggauuuggcguuuucacaaccaacaucuggcugaaacuucgggagaaacaggacguguuuugugauuccaagcugaugagcgcugccaucaaagacaauagagcgguccacgccgauaugggcuauuggauugaaucugcucucaacgacacguggaagauggagaaggccuccuucaucgaggugaaaagcugccacuggccuaagucucauacacuguggagcaaugggguucuggaauccgagaugauuauccccaaaaacuucgcuggaccggugagccagcacaacuaccgcccuggcuaucauacccaaaccgccgggcccuggcaccuuggaaagcucgaaauggauuuugaccugugugagggcacaaccgucguggugacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucgucaauucccugguuaccgcuggccaugggcagauugauaacuucucucugggagugcuuggcauggcgcucuuucuggaagagaugcugagaacgcgcaucgggaccaaacacgccacacuccugguggcugucagcuucgugacccuuaucacaggaaauauguccuuucgggaccugggcagaguuauggugauggucggcgccaccaugacggaugacauugggaugggagugacauaucucgcccugcuggcugccuucaagguucgcccuaccuuugcggcuggccuucugcucagaaaacugacaucuaaggagcucaugauggccaccaucgggauugcccugcuuagccaguccaccauccccgaaacaauucuggagcucacggaugcucuggcccugggaaugauggugcuuaaaaucguccggaacauggaaaaguaccaacuggcggugaccaucauggcuauuucuugcguuccuaaugccgugauccuccagaacgccuggaaggucagcuguacaauucuggcugccguguccgugagcccccuccugcuuaccucuucccagcagaaagcugacuggaucccucuggcccucacaauuaagggccugaaucccaccgcgaucuuccugacgacacuuagccgcaccucuaaaaagagauccuggccgcugaacgaggccaucauggcugucgggaugguuagcauucucgccucuucccugcucaaaaaugacaucccuaugaccggaccccugguggcuggcggccuucugacagugugcuauguccugaccgggcggagcgccgaucucgaacuggagcgcgccgcugacgugaagugggaggaucaagcggaaauuuccggaagcucuccuauccuuagcauuacaaucuccgaggacggcucuaugagcauuaaaaacgaagaggaggaacagacgcugaccauccucaucagaacagggcugcucguuauuuccggaguguuucccgucucuaucccgauuaccgccgcugccugguaccugugggaggugaagaagcagcgggccggcguucuuugggaugugccuucucccccucccgucgaaaaagcugagcuggaagacggggccuaucgcaucaagcagagaggcauucugggauacucccaaaucggcgcggggguguauaaagagggaacauuccacaccauguggcaugucacgcggggcgcugugcucaugcaccgcgggaagagaaucgagcccuccugggccgauguuaaaaaggaccugauuagcuacggaggcggguggaaacuugaaggagaguggaaagaaggcgaggaagugcagguccuggcccucgagccuggcaagaauccgcgggcugugcagaccaaacccgggacauuuaagaccaacacaggaaccaucggcgccguuucccuggauuucagcccugggacaucuggaucccccauuguggacagaaaaggcaaggucguggggcucuacggaaauggcgugguuacgcgcagcggcgcguaugucucugcuaucgcccagaccgagaaguccauugaagauaacccugagaucgaagacgauaucuuucggaaaaagagacugacaauuauggaccuucaucccggggccggaaaaaccaagcgcuaccugccugcuaucgugcgggaggccauuaaaagaggccugcgcacccucauccuggcuccgacacggguggucgccgcggaaauggaggaggcccuuagagggcugcccauucgcuaucaaacgccugcuaucaagaccgaacacacaggacgggagauuguggaccucaugugucaugccaccuucacaaugagacugcucagccccguucgggugccuaacuacaaucugaucaucauggaugaagcucacuucaccgaccccgccuccauugccgcucgcggcuauaucucuacgagagucgagaugggggaggcggccggcauuuuuaugacagcuaccccgccuggaagccgggaucccuucccccaguccaacgccccuaucauggacgaagagagagaaauucccgagagaagcuggaacucuggccacgaaugggugaccgauuuuaaggggaaaacaguuugguucgugccuuccaucaaggccggaaacgacaucgcugccugccuucggaaaaauggcaagaaagucauucagcugagcagaaagaccuuugauucugaguacgugaagacacgcgcgaacgacugggauuucguugugaccacggacaucagcgagaugggggcuaauuuuaaagccgaacgggucauugauccgagacgcuguaugaagcccgugauccugacagacggagaggaacgggugauucucgccggcccuaugcccgucacccauuccucugcugcccaaagacgcgggcggaucggcagaaacccuaaaaaugagaacgaccaguauaucuacaugggagaaccccuggagaaugaugaggacugcgcgcacuggaaggaagccaaaaugcuucuggauaacauuaauacaccggagggcaucauuccuagcauguucgaacccgagcgcgaaaagguugacgcuaucgauggggaguacagacuccggggagaggcccgcaaaaccuuuguggaccugaugagacggggcgaucugccuguguggcucgcuuauaaggucgccgcugaagggauuaacuacgccgaccgcaagugguguuucgauggaaucaaaaauaaccagauucuugaggaaaacauggagguggagaucuggacgaaggaaggcgagcgcaagaagcugaaaccccgguggcuggacgcgagaaucuauuccgauccucucgcccugaaggaauuuaaggaguucgcugccgggcgcaaaucucuuacccugaaucucauuacagaaaugggccggcugcccaccuucaugacacagaaggcuagaaacgcccuggacaaucucgccguucuucauaccgcugaggcgggaggccgcgccuacaaccacgcucugagcgagcugccggaaacacucgagacccugcuucugcucacgcugcuggccacagugaccgggggaaucuuucucuuccuuauguccggcaaagggauuggaaagaugacccugggcaugugcugcaucauuacagccagcauccugcucugguaugcucaaauccagccucacuggauugccgcgucuaucauucuggaauuuuuccuuaucguccugcucauucccgagcccgaaaaacagcggaccccucaggauaaucaacugacauacgugguuaucgccauccugacgguggucgcugccaccauggcuaacgagaugggcuuucucgagaagacaaagaaagaccuugggcugggauccauuaccacacaggaaagcgaguccaauauccuggacauugaucucagaccggccucugcguggacccuguaugccguggcuacgaccuucgucacacccaugcuucggcauagcaucgaaaacuccucugugaauguuagccugaccgccauugcuaaccaggccacagugcucaugggccuggggaagggauggccucuguccaaaauggacaucggcgugccccuccuugcuauuggguguuacagccaggucaauccuaucacccugacggccgcgcugcuccugcuuguugcccacuacgcuaucauuggacccggccugcaagccaaggcuacacgcgaggcccagaaaagagccgcggcuggcaucaugaagaacccuaccguggaugggauuacagugaucgaccucgaaccgauucccuaugauccuaaguuugagaaacagcugggacaggucaugcugcucauccuuugcgugacccaaguucugaugaugcggaccacaugggcccugugugaggcucucacgcuggccaccggccccaucucuacacuuugggaagggaauccuggacgcuucuggaacaccacaauugccguguccauggcuaauaucuuuagaggcagcuaccuggccggggcgggacuccuguucucuauuaugaagaacaccacguccacacggcgcggcaccggcaauaucggggagacccugggagaaaaauggaaaagcagacucaacgcccuuggcaaaucugaguuucagauuuauaagaaaagcgggauccaggaggucgaccggacacuggcuaaggaaggaaucaagcgcggcgagaccgaucaucacgccguguccagagggucugcuaaacugcggugguucgucgaaagaaacauggugacacccgagggaaagguuguggaccucggcugcggccgcgggggauggagcuacuauuguggcgggcugaaaaauguccgggaagugaagggacuuacgaaaggcgggccgggacaugaggagccuauucccauguccaccuacggcuggaaccugguuagacuccaaagcggcguggaugucuuuuucacacccccugaaaagugcgacacccugcugugugauaucggggaguccucucccaauccuacaauugaagccggacgcacccuccgggugcuuaaccugguggagaauuggcugaacaauaacacgcaguucugcaucaagguucucaauccguauaugcccagcgucauugagaagauggaggcgcugcagagaaaguacggcggggcccuugugcgcaacccucuguccagaaauucuacccacgagauguacugggugagcaacgcuacaggaaauaucgucuccucuguuaacaugaucagcagaaugcucauuaaucgcuuuaccaugaaacacaagaaagccacauaugaacccgacguggaucugggcuccgggacccggaacaucggaauugagagcgaaaucccuaaccuggacauuaucggcaagagaauugagaagaucaaacaggaacaugagacaucuuggcacuacgaccaagaucaucccuauaagaccugggcuuaccacggcuccuaugagacgaaacagacagggagcgccucuuccauggugaauggagucgugcgccuccuuaccaagccgugggacguugugccuauggucacccagauggcuaugacagauacgacccccuucggccagcaacggguguuuaaagaaaagguugacacaagaacccaggagccuaaggaagggaccaagaagcugaugaaaaucaccgccgaguggcuguggaaggagcucggcaagaagaaaacaccccgcauguguaccagagaagaguucacgcggaaggugcgcagcaacgcggcccugggcgcuauuuuuaccgaugaaaauaaguggaaaucugccagagaggcugucgaagacgggcgguucugggagcuuguggauagagagcggaaccugcaccucgaaggaaagugcgagacauguguguacaauaugaugggcaaacgcgaaaagaaacugggcgaguuugggaaggccaagggauccagagccaucugguauauguggcugggcgcgcgguuccucgaauuugaggcucugggguuccuuaacgaggaccauugguuuagccgcggaaauucccugagcggcgucgaaggggagggccuccacagacugggauacauucuucgggauguuucuaaaaaggaaggcggggccauguacgccgacgauaccgcuggaugggacacacgcaucacccuggaggaccucaaaaacgaagagauggugacgaaucauaugaagggcgagcacaaaaagcuggccgaagcuauuuucaagcugacauaucagaacaaaguggucagagugcagcggccuacaccccgcgggaucguuauggauaucauuagcagacgggaccaacgcggauccggccagguggggacauacggccucaauaccuuuacgaacauggaggcccagcugaucagacaaauggaaggagagggcauuuucaagucuauccagcaucuuaccgcggccgaggaaauugucgugcagaauuggcuggcucggguugggcgcgagagacucagccggauggccaucuccggagaugacugcguggucaaaccgaucgaugacagauucgcuucugcccugacagcgcuuaacgauaugggcaaggugcgcaaagacauucagcaaugggaaccuagccggggguggaaugauuggacccagguucccuuuugcucccaccacuuccaugagcuggugaugaaggacggaagaguccucgugguccccugucgcaaccaggaugaacugaucggccgggccagaauuucucagggggcuggcuggagccugaaggagacagccugccucggaaaauccuaugcucaaauguggacccugauguacuuucaccgccgggaccuuagacuggccgcuaacgccaucuguagcgcggugccuucucauuggguuccgacaucccgcaccacguggagcauucacgccaagcacgaguggaugacaaccgaagauaugcucgcuguguggaaucgggucuggauccaggagaaccccuggauggaagacaaaaccccuguggagucuugggaagaggugcccuaucugggcaagagagaggaccaguggugcgggucccuuauuggacugacaagccgcgccaccugggccaaaaauauccagacagcuaucaaccaaguucggucccucauuggcaaugaagaguacacggauuauaugccuucuaugaagagauuccggagagaagaggaagaggccggggugcugugguga

SEQ ID NO: 19839 - RNA, 9876 nt, Artificial Sequence
  derived and/or modified CDS sequence (opt5) from DENV-2__KC294207__SS-prME
accgccggcgugaucgugaugcugauucccacagcuauggccuuccaccucacgaccagaaacggggaaccucauaugaucguuggacggcaggaaaagggcaaaucccugcuuuuuaagacagaagacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacuguaugugcacaggaaaguucaagaucgugaaagaaauugcggagacgcagcacggcaccaucgucaucagagugcaguaugagggggacggaagccccuguaagauucccuucgaaaucacagaucucgagaaacgccauguccugggccggcugauuaccgugaacccuaucguuacagaaaaggacuccccggugaacauugaggccgaacccccuuuuggggauagcuacaucauugucggcguggagcccggacagcucaaacugaauugguucaagaagggaucuuccaucgggcaaauguuugagaccacgaugagaggagcuaaacgcauggccauccuuggcgacacagccugggauuucgggagccugggaggcguuuuuaccucuauugggaaggcucuccaccagguguucggcgccaucuacggagcggcuuuuagcggcgucuccuggaccaugaaaauucugaucggggugauuaucacauggaucggaaugaacucucggagcaccucccugagcgugucucuuguucucgucggcguggugacacuguaucugggggccaugguccaggccgacuccggaugcauugugagcuggaagaauaaagaacucaaguguggcucugggaucuucauuacggauaacguucacaccuggacagagcaguacaaguuucaaccugaaucccccagcaaacuggcuuccgccauccagaaggcucaugaggaaggcauuugcggaaucagaucugugacccgccuugagaaucugauguggaaacagaucacaccggagcucaaccacauucugagcgaaaaugaggucaagcugaccaucaugacgggcgacauuaaagggaucaugcaggccggaaagcggucccuuagaccucaacccaccgaacucaaauauucuuggaagacauggggcaaggcgaaaaugcugagcaccgagucccauaaccagacauuccugauugaugggccugaaaccgccgagugucccaauacaaaccgcgcuuggaauagccucgagguggaagacuacggauuuggcguuuucaccacgaacaucuggcugaaacuucgggagaaacaggacguguuuugcgauucuaagcugauguccgccgcuaucaaagacaauagagccguccacgcggauaugggcuauuggauugaaagcgcccucaacgacacauggaagauggagaaggcuucuuucaucgaggugaaauccugucacuggccuaagagccauacccuguggucuaaugggguucuggaaagcgagaugauuauccccaaaaacuucgccggaccggugucccagcacaacuaccgcccuggcuaucauacccaaacagcugggcccggacaccuuggcaagcucgaaauggauuuugaccugugcgaggggaccacggucguggugacagaagauugcggaaaucggggccccagccugagaaccacaaccgccucuggcaaacucauuacagagugguguugccgguccuguacccugccuccgcuucgcuacagaggggaggacggaugcugguacggcauggaaauccggccccugaaggagaaggaagagaaccucgucaauagccugguuacggccgggcauggacagauugauaacuucucccugggcgugcuugggauggcucucuuucuggaagagaugcugagaacccgcgugggaacaaaacacgcgauccuccuggucgcccuuucuuucgugacccugaucacaggcaauaugagcuuucgggaccucggcagaguuauggugauggucggggcuaccaugacggaugacauuggaaugggcgugacauaucuggcccugcuugccgcuuucaagguucgcccuaccuuugccgcggggcugcuccugagaaaacucacauccaaggagcugaugauggcuaccaucggaauugcccuucugucucagagcacccuccccgaaacaauccuggagcugacggaugcccuugcucugggcaugauggcccucaaaauugugcggaacauggaaaaguaccaacuggcggucaccaucauggcuaucuccugugugccuaaugccguuauucuccagaacgccuggaaggugucuugcacaauccuggcugccgucagcgugagcccccuucugcucaccagcucucagcagaaagcugacuggauuccucuggcccugacaaucaaggggcuuaaucccaccgcgauuuuccugacgacacucucccgcaccagcaaaaagagaucuuggccgcugaacgaggccaucauggcugugggaauggucuccauccucgccagcucucugcuuaaaaaugacauuccuaugaccggcccccugguugcuggcgggcugcucacaguguguuaugugcugaccggacgguccgccgaucuugaacuggagcgcgccgcugacgucaagugggaggaucaagcggaaaucagcggcuccagcccuauucucucuaucacaauuagcgaggacggguccaugucuaucaaaaacgaagaggaggaacagacgcugaccauucucaucagaacaggacugcuugugaucagcggcguuuuucccguguccauuccgaucaccgccgcugccugguaccugugggaggucaagaagcagcgggccggggugcugugggauguuccuucucccccucccgugggaaaagcugaacucgaggacggcgccuaucgcauuaagcagagaggcauccugggguacagccaaauuggagcgggcgucuauaaagaagggacauuccacaccauguggcaugugacgcggggagcuguccuuaugcaccgcggcaagagaaucgagcccuccugggccgaugugaaaaaggaccugaucucuuacgggggaggcuggaagcucgagggcgaauggaaagagggggaagagguucaggugcuggcccucgaaccuggaaagaauccgcgggcuguccagaccaaacccggcauuuuuaagacaaacaccgggacaaucggagccgugagccuggauuucuccccuggcaccagcgggucucccauuguugacagaaaaggaaagguggucggccuuuacggcaaugggguggugacacgcuccggagcguauguuagcgcuaucgcccagacggagaagucuauugaggauaacccugaaaucgaggacgauaucuuucggaaaaagagacugaccauuauggaccugcaucccggcgccgggaaaacaaagcgcuaccucccugcuaucguccgggaagccauuaaaagaggacugcgcacccuuauccuggcuccgacccgggugguggccgcggagauggaagaggcccucagaggccugcccauucgcuaucaaaccccugcuauccgggccgagcacacggggagagaaauugucgaccucaugugccaugcuaccuucacaaugcggcugcuuucccccgugcgcguuccuaacuacaaucugaucaucauggaugaggcccacuucaccgaccccgccagcauugcugcgagaggcuauaucuccacacggguggaaaugggagaggccgcuggcauuuuuaugaccgccacgccgccugggucucgcgaucccuucccccagagcaacgccccuaucauggacgaggaaagagagauucccgaacgguccuggaauagcggacacgagugggucacagauuuuaagggcaagaccgugugguucguuccuucuaucaaagcugggaacgacaucgccgcgugucugagaaagaauggcaagaaggugauucagcucucccgcaaaaccuuugauagcgaauacgucaagacacgggcuaacgacugggauuucgugguuaccacagacaucucugagaugggcgccaauuuuaaggccgagagagugauugauccgcgccggugcaugaaacccgucauccugaccgacggggaagagagagugauucuugcuggcccuaugcccgugacgcauagcuccgccgcgcaacgccggggaagaaucggccgcaacccuaagaaugaaaacgaccaguauaucuacaugggggagccccuggaaaaugaugaggacugugcccacuggaaagaggcuaagaugcuccuggauaacauuaauacaccggaaggaaucauuccuucuauguucgagcccgaaagagagaaagucgacgccaucgauggcgaauaccggcugcgcggggaggcuagaaagaccuuuguugaccucaugcggcgcggagaucuuccuguguggcuggccuauaaaguggcugccgagggcauuaacuacgcggacagaaaguggugcuucgaugggaucaagaauaaccagauucuggaagagaacgucgaaguggagaucuggacaaaagagggcgaacggaagaaacucaagcccagauggcuggacgcccgcaucuauagcgauccucuugcucugaaagaguuuaaggaguucgccgcuggacggaagucccucacccugaaucugauuacggagaugggcagacuccccaccuucaugacacagaaagcccgcaacgcccuugacaaucuggcuguucugcauaccgcggaagucgggggaaaggccuacacacacgcucucucugagcugccggagacccuugaaacacugcuccugcugacccuccuugccgccgucacgggcgggaucuuucuguuccugaugagcggaaaaggcgugggcaagaugacacucgggaugugcuguauuaucaccgcuuccauucugcuuugguaugcccaaauccagccucacuggaucgcggccagcauuauccuggaguuuuuccucauuguucugcugauccccgaacccgagaaacagcggaccccucaggauaaccaacucacauacguggucauugcuauccuuaccguggucgccgcuacaauggccaaugaaaugggauuucuggagaagacgaagaaagaccugggcuucgggucuaucaccacacaggaguccgaaagcaacauucucgacaucgaucugagaccggcguccgccuggacccuuuaugcuguggccacaaccuuuguuacgcccaugcugcggcauucuauugagaauagcuccgugaacgugucucucaccgcuaucgccaaucaggcuacaguccugaugggacugggcaagggguggccucucagcaaaauggacauuggaguuccccuucuggccaucggcugcuacucccaggugaacccuauuacccugacagcggcccuccugcuucugguggcucacuacgccaucaucggccccgggcuccaagcuaaggccacccgcgaagcccagaaaagagcggcugccggaauuaugaagaauccuacggucgauggcaucacagugauugaccuggagccgauccccuaugauccuaaguucgaaaaacagcuggggcagguuaugcuccuuauucugugugugacccaaguccugaugaugcggacaaccugggcucucugcgaggcccugacccuugccacaggacccaucagcacgcugugggagggcaacccugggcgcuuuuggaauaccacaaucgcugugucuauggccaacauuuucagaggauccuaccucgcgggcgccggccugcuguuuagcaucaugaagaauaccacaaacacccggcgcgggacgggaaaugucggcgaaacacucggggagaaauggaagucuagacuuaacgcucugggaaaauccgaguuccagauuuauaagaaaagcggcauccaggagguggaccggacccuggccaaggaggggauuaagcgcggagaaaccgaucaucacgcuguuucuagaggcagcgccaaacuccggugguuuguggagagaaacauggucacacccgaaggcaaggugguugaccugggguguggacgcggcgggugguccuacuauugcggaggccuuaaaaaugugcgggaggucaaggggcugaccaaaggaggcccgggccaugaagaaccuauccccaugucuacauacggguggaaccucgugagacugcaaagcggaguggauguuuucuucacgcccccugagaagugugacacccugcucugcgauaucggcgaauccagccccaauccuacaauugaggcggggcgcacccuucggguccugaaccugguggaaaauuggcucaacaauaacacacaguuuuguaucaaggugcugaauccguauaugcccuccgucauugagaaaauggaaacccuucagagaaaguacggaggcgcccugguucgcaacccucucucucggaauagcacgcacgagauguacuggguguccaacgcuaccgggaauaucgugucuagcgucaacaugauuuccagaaugcugaucaaucgcuucacaaugaaacacaagaaagccaccuaugagcccgacguggaucugggaucuggcacacggaacaucggcauugaaagcgagaucccuaaccucgacauuguugggaagagaaucgaaaagauuaaacaggagcaugaaaccuccuggcacuacgaccaagaucaucccuauaagacaugggcuuaccacggaagcuaugagaccaaacagacgggcucugccuccagcauggugaauggggucgugcgccuucugacaaagccgugggacguugugccuauggucacccagauggcuaugaccgauacaacgcccuuuggacagcaacggguguucaaagagaagguggacaccagaacacaggaaccuaaggagggcaccaaaaagcugaugaaaaucacagccgaauggcucuggaaggagcuggggaaagagaagacaccccgcaugugcacaagagaagaguuuacccggaaaguccgcucuaacgcggcccuuggagcuguuuucacggaugaaaauaaguggaaguccgccagagaggcuguggaagacggccgguuuugggagcugguggauagagagcggaaccuccaccuggaaggcaaaugugagaccugcgucuacaauaugauggggaagcgcgagaagaagcugggagaguucggcaaagccaaggggagcagagccauuugguauauguggcucggagcgcgguuucuggaguucgaggcucuuggcuuucugaacgaggaccauugguucucucgcggaaauucccucagcggcguggaaggagagggccugcacagacuuggguacauccugcgggaaguuggaaagaaagagggcggggccauguacgccgaugacacagcuggaugggauacccgcaucacacucgaagaccugaagaacgaggagauggugaccaaucauaugaaaggcgaacacaagaaacuggccgaggcuauuuuuaagcucacguaucagaacaaggucgugagaguucagcggccuacaccccgcgggaccgugauggacaucauuuccagaaaagaucaacggggcagcggacaggucggcacauacgggcugaauaccuucacgaacauggaagcccagcuuauccgccaaauggagggagagggcauuuucaagucuauccagcaucugaccgcgacagaagagaucgccgugcagaauuggcucgcuagaguugggcgggaacgccugagcagaauggccauuuccggagacgauugcguggucaaaccgaucgacgaucgguuugcuucugcccuuaccgcgcugaacgacaugggcaaggugagaaaagauauucagcaaugggagccuagccgcggguggaaugacuggacacagguccccuucuguucccaccacuuucaugaacucgugaugaaggauggccggguucuggugguccccugcagaaaccaggacgagcugaucggacgcgcccggauuucucagggcgcuggguggagccucaaggagaccgccugucugggaaaauccuaugcucaaauguggacacuuauguacuuccacagacgcgaucugcggcucgccgcuaacgccaucugcucugcggugccuagccauugggugccgaccuccagaacgacauggagcauccacgccaagcacgaauggaugaccaccgaggacaugcugguuguguggaaucgcgucuggauucaggaaaaccccuggauggaggauaaaacaccuguggaaucuugggaggagguucccuaucuuggcaagcgggaagaccaguggugugggucccugaucggacucaccagcagagcuacaugggccaaaaauauucagacggccaucaaccaagugcgcucucugauuggcaaugagggguacaccgacuauaugccuuccaugaagcgguuuagacgggaagaggaagaggcuggcguccugugguga

SEQ ID NO: 19840 - RNA, 9876 nt, Artificial Sequence
  derived and/or modified CDS sequence (opt5) from DENV-2__KC294208__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgaugugaaaaaggaccuuaucagcuacggcgggggauggaagcuggagggcgaauggaaagagggcgaagagguucaggugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaguccaacgccccuaucauggacgaggaaagagagauucccgaacggagcuggaacucugggcacgagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcauuccucugccgcgcaacgccggggcagaaucggacgcaacccuaagaaugaaaacgaccaguauaucuacaugggcgagccccuugaaaaugaugaggacugcgcccacuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcaacgcccucgacaaucuugcuguucugcauaccgcggaagugggcgggaaggccuacacacacgcucugagcgagcucccggagacccuggaaacacuucugcuccugacccugcucgccgccgucacgggaggcaucuuccuuuuucugauguccgggaaaggaauuggcaagaugacacugggcaugugcugcaucauuaccgcuagcauccuccugugguaugcccaaauccagccucacuggauugcggccucuaucauucuugaguucuuucugaucgugcuccugauucccgaacccgagaaacagcggaccccucaggauaaccaacugacauacguugugaucgcuauccucaccgucguggccgcuacaauggccaaugaaaugggguuccuugagaagacgaagaaagaccugggauuuggcuccauuaccacacaggagagcgaauccaacauccuggacauugaucucagaccggcgucugccuggacccuguaugcugucgccacaaccuucgugacgcccaugcuucggcauagcaucgaaaauagcucuguuaacgugagccugaccgcuauugccaaucaggcuacagugcucauggggcugggaaagggcuggccucuguccaaaauggacaucggggucccccuccuugccauuggauguuacagccagguuaacccuaucacccugacagcggcccugcuccugcuuguggcucacuacgccaucauuggccccggccugcaagcuaaggccacccgcgaagcccagaaaagagcggcugccgggaucaugaagaauccuacgguggauggaauuacagucaucgaccucgagccgauucccuaugauccuaaguuugaaaaacagcugggccaggugaugcugcucauccuuugcguuacccaagugcugaugaugcggacaaccugggcucugugugaggcccucacccuggccacagggcccaucucuacgcuuugggagggagacccuggccgcuucuggaacaccacaauugcugucuccauggccaauaucuuuagagggagcuaccuggcgggagccggccuccuguucucuauuaugaagaacaccacaaauacccggcgcggcacggggaacgugggagaaacacugggcgagaaauggaaguccagacucaaugcucuugggaaaagcgaauuucagaucuauaagaaaucuggcauucaggaggucgaucggacccuggccaaggagggcaucaagcgcggggaaaccgaccaucacgcugugagcagaggauccgccaaacugcggugguucguugagagaaacauggugacacccgaaggcaaggucguggaucucggcugcgggcgcggaggcuggucuuacuauugugggggacugaaaaacguucgggaggugaagggccuuaccaaagggggaccgggccaugaggaaccuauccccaugagcacauacggcuggaaucuggucagacuccaauccgggguggacguguucuuuacgcccccugagaagugcgauacccugcugugugacauuggagaaagcucccccaacccuacaaucgaggcgggccgcacccuccggguucuuaaucuggucgaaaacuggcugaauaacaauacacaguucugcauuaaggugcucaacccguauaugcccucugugaucgagaaaauggaaacccugcagagaaaguacgggggagcccuuguccgcaauccucugagccggaacuccacgcacgagauguacuggguuucuaaugcuaccggcaacauugugagcuccgugaauaugaucucuagaaugcucaucaaccgcuuuacaaugaaacacaagaaagccaccuaugagcccgaugucgaccuggggagcggaacacggaauauuggcaucgaauccgagauuccuaaccuggacaucgugggcaagagaauugaaaagaucaaacaggagcaugaaaccagcuggcacuacgaucaagaccaucccuauaagacaugggcuuaccacgggucuuaugagaccaaacagacgggauccgccagcucuaugguuaacggcgugguccgccuccuuacaaagccgugggaugugguuccuauggugacccagauggcuaugaccgacacaacgcccuucgggcagcaacgggucuuuaaagagaagguggauaccagaacacaggaaccuaaggagggaaccaaaaagcugaugaaaauuacagccgaauggcuguggaaggagcucggcaaagagaagacaccccgcauguguacaagagaagaguucacccggaaagugcgcuccaaugcggcccugggggcugucuuuacggacgaaaacaaguggaaaagcgccagagaggcuguugaagauggacgguucugggagcuuguggacagagagcggaaucugcaccucgaaggcaaaugcgagaccuguguguacaacaugaugggcaagcgcgagaagaagcugggggaguuuggaaaagccaagggcucuagagccaucugguauauguggcugggggcgcgguuccucgaauuugaggcucugggauuccuuaaugaggaucauugguuuucccgcggcaacagccuguccggggucgaaggcgagggacuccacagacugggcuacauccuucgggaaguggggaagaaagagggaggcgccauguacgccgacgauacagcugggugggacacccgcauuacacuggaagaccucaagaaugaggagaugguuaccaaccauaugaaaggagaacacaagaaacuggccgaggcuaucuucaagcugacguaucagaauaagguggucagagugcagcggccuacaccccgcggcaccguuauggauauuaucagcagaaaagaccaacgggggucuggccaggugggaacauacggccucaacaccuucacgaauauggaagcccagcugauucgccaaauggagggggagggaaucuuuaagagcauccagcaucuuaccgcgacagaagagauugccguccagaacuggcuggcuagagugggccgggaacgccucuccagaauggccaucucuggggaugacugcguugugaaaccgauugaugaccgguucgcuagcgcccugaccgcgcuuaaugauaugggaaaggucagaaaagacauccagcaaugggagccuucccgcggcuggaacgauuggacacaggugcccuuuugcucucaccacuuccaugaacuggucaugaaggacgggcgggugcucguugugcccuguagaaaucaggaugagcugauuggccgcgcccggaucagccagggagcuggcuggucccugaaggagaccgccugccucgggaaaucuuaugcucaaauguggacacugauguacuuucacagacgcgaccuucggcuggccgcuaacgccaucuguagcgcggucccuucccauugggugccgaccagcagaacgacauggucuauucacgccaagcacgaauggaugaccaccgaggauaugcucgugguuuggaaccgcguguggauccaggaaaaucccuggauggaggacaaaacaccugucgaauccugggaggaggugcccuaucugggaaagcgggaagaccaguggugcggcagccuuauugggcugaccucuagagcuacaugggccaaaaacauccagacggccauuaaucaaguucgcucccucaucggaaacgagggcuacaccgauuauaugccuagcaugaagcgguucagacgggaagaggaagaggcuggggugcugugguga

SEQ ID NO: 19841 - RNA, 9876 nt, Artificial Sequence
  derived and/or modified CDS sequence (opt5) from DENV-2__KC294209__SS-prME
accgccggcgugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgaugugaaaaaggaccuuaucagcuacggcgggggauggaagcuggagggcgaauggaaagagggcgaagagguucaggugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaguccaacgccccuaucauggacgaggaaagagagauucccgaacggagcuggaacucugggcacgagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcauuccucugccgcgcaacgccggggcagaaucggacgcaacccuaagaaugaaaacgaccaguauaucuacaugggcgagccccuugaaaaugaugaggacugcgcccacuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcaacgcccucgacaaucuugcuguucugcauaccgcggaagugggcgggaaggccuacacacacgcucugagcgagcucccggagacccuggaaacacuucugcuccugacccugcucgccgccgucacgggaggcaucuuccuuuuucugauguccgggaaaggagugggcaagaugacacugggcaugugcugcauuaucaccgcuagcauucuccugugguaugcccaaauccagccucacuggaucgcggccucuauuauccuugaguucuuucugauuguucuccugauccccgaacccgagaaacagcggaccccucaggauaaccaacugacauacguggucauugcuauccucaccguggucgccgcuacaauggccaaugaaaugggguuccuugagaagacgaagaaagaccugggauuuggcuccaucaccacacaggagagcgaauccaacauucuggacaucgaucucagaccggcgucugccuggacccuguaugcuguggccacaaccuucguuacgcccaugcuucggcauagcauugaaaauagcucugugaacgugagccugaccgcuaucgccaaucaggcuacaguccucauggggcugggaaagggcuggccucuguccaaaauggacauugggguuccccuccuugccaucggauguuacagccaggugaacccuauuacccugacagcggcccugcuccugcuuguggcucacuacgccaucaucggccccggccugcaagcuaaggccacccgcgaagcccagaaaagagcggcugccgggauuaugaagaauccuacggucgauggaaucacagugauugaccucgagccgauccccuaugauccuaaguuugaaaaacagcugggccagguuaugcugcucauucuuugcgugacccaaguccugaugaugcggacaaccugggcucugugugaggcccucacccuggccacagggcccaucucuacgcuuugggagggaaacccuggccgcuucuggaauaccacaaucgcuguguccauggccaacauuuuuagagggagcuaccuggcgggagccggccuccuguucucuaucaugaagaauaccacaaacacccggcgcggcacggggaaugucggagaaacacugggcgagaaauggaaguccagacucaacgcucuugggaaaagcgaauuucagauuuauaagaaaucuggaauccaggagguggaccggacccuggccaaggagggcauuaagcgcggggaaaccgaucaucacgcuguuagcagaggauccgccaaacugcggugguucguggagagaaacauggucacacccgaaggcaaggugguugaccucggcugcgggcgcggaggcuggucuuacuauugugggggacugaaaaaugugcgggaggucaagggccuuaccaaagggggaccgggccaugaggaaccuauccccaugagcacauacggcuggaaccuggugagacuccaauccgggguggauguuuucuuuacgcccccugagaagugcgacacccugcugugugauaucggagaaagcucccccaauccuacaauugaggcgggccgcacccuccggguccuuaaccugguggaaaauuggcugaacaauaacacacaguucugcaucaaggugcucaauccguauaugcccucugucauugagaaaauggaaacccugcagagaaaguacgggggagcccuuguucgcaacccucugagcagaaauuccacgcacgagauguacugggugucuaacgcuaccggcaauaucgugagcuccgucaacaugauuucuagaaugcucaucaaucgcuuuacaaugaaacacaagaaagccaccuaugagcccgacguggaucuggggagcggaacacggaacaucggcauugaauccgagaucccuaaccuggacauuguuggcaagagaaucgaaaagauuaaacaggagcaugaaaccagcuggcacuacgaccaagaucaucccuauaagacaugggcuuaccacgggucuuaugagaccaaacagacgggauccgccagcucuauggugaauggcgucgugcgccuccuuacaaagccgugggacguugugccuauggucacccagauggcuaugaccgauacaacgcccuucgggcagcaacggguguuuaaagagaagguggacaccagaacacaggaaccuaaggagggaaccaaaaagcugaugaaaaucacagccgaauggcuguggaaggagcucggcaaagagaagacaccccgcauguguacaagagaagaguucacccggaaaguccgcuccaacgcggcccugggggcuguuuuuacggaugaaaauaaguggaaaagcgccagagaggcuguggaagacggacgguucugggagcuuguggauagagagcggaaccugcaccucgaaggcaaaugcgagaccugugucuacaauaugaugggcaagcgcgagaagaagcugggggaguuuggaaaagccaagggcucuagagccauuugguauauguggcugggggcgcgguuccucgaauuugaggcucugggauuccuuaacgaggaccauugguuuucccgcggcaauagccuguccgggguggaaggcgagggacuccacagacugggcuacauccuucgggaaguugggaagaaagagggaggcgccauguacgccgaugacacagcugggugggauacccgcaucacacuggaagaccucaagaacgaggagauggugaccaaucauaugaaaggagaacacaagaaacuggccgaggcuauuuucaagcugacguaucagaacaaggucgugagaguucagcggccuacaccccgcggcaccgugauggacaucauuagcagaaaagaucaacgggggucuggccaggucggaacauacggccucaauaccuucacgaacauggaagcccagcugauccgccaaauggagggggagggaauuuuuaagagcauccagcaucuuaccgcgacagaagagaucgccgugcagaauuggcuggcuagaguuggccgggaacgccucuccagaauggccauuucuggggacgauugcguggucaaaccgaucgacgaucgguucgcuagcgcccugaccgcgcuuaacgacaugggaaaggugagaaaagauauucagcaaugggagccuucccgcggcuggaaugacuggacacagguccccuuuugcucucaccacuuccaugaacuggugaugaaggaugggcggguucucgugguccccuguagaaaccaggacgagcugaucggccgcgcccggauuagccagggagcuggcuggucccugaaggagaccgccugccucgggaaaucuuaugcucaaauguggacacugauguacuuucacagacgcgaucuucggcuggccgcuaacgccaucuguagcgcggugccuucccauugggugccgaccagcagaacgacauggucuauccacgccaagcacgaauggaugaccaccgaggacaugcucguuguguggaaucgcgucuggauucaggaaaaccccuggauggaggauaaaacaccuguggaauccugggaggagguucccuaucugggaaagcgggaagaccaguggugcggcagccuuaucgggcugaccucuagagcuacaugggccaaaaauauucagacggccaucaaccaagugcgcucccucauuggaaaugagggcuacaccgacuauaugccuagcaugaagcgguucagacgggaagaggaagaggcugggguccugugguga

SEQ ID NO: 19842 - RNA, 9876 nt, Artificial Sequence
  derived and/or modified CDS sequence (opt5) from DENV-2__KC294214__SS-prME
acagccggagugaucgugaugcugauucccacagcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggagaaauaaggaacucaaaugcggcuccgggaucuucauuacggauaacguucacaccuggacagagcaguacaaguuucaaccugaaagccccuccaagcuggcuucugccauccagaaagcucaugaggaaggcauuuguggaauccgcagcgugacccggcuugagaaucugauguggaagcagaucacaccggagcucaaccacauucuguccgaaaaugaggucaaacugaccaucaugacgggcgacauuaaggggaucaugcaggccggaaaaagaucucuucgcccucaacccaccgaacucaaguauagcuggaaaacauggggcaaggcgaagaugcuguccaccgagagccauaaccagacauuccugauugaugggccugaaaccgccgagugccccaauacaaaccgggcuuggaacucucucgagguggaagacuacggauuuggcguuuucaccacgaacaucuggcugaaacuuagagagaagcaggacguguuuugugauuccaaacugaugagcgccgcuaucaaggacaaucgcgccguccacgcggauaugggcuauuggauugaaucugcccucaacgacacauggaaaauggagaaggcuuccuucaucgaggucaagagcugccacuggccuaaaucucauacccuguggagcaaugggguucuggaauccgagaugauuauccccaagaacuucgccggaccggugagccagcacaacuaccggccuggcuaucauacccaaacagcugggcccuggcaccuuggaaaacucgaaauggauuuugacuucugugagggcaccacggucguggugacagaagauugcgggaauagaggacccucucugcggaccacaaccgccuccggcaagcugauuacagaguggugcugucgcagcugcacccucccuccgcugagauaccggggcgaggacggguguugguacggaauggaaaucagaccccuuaaagagaaggaagagaaccuggucaauucccucguuacggccggccaugggcagauugauaacuuuucucugggagugcugggcauggcucuuuuccucgaagagaugcugcgcacccggguggggacaaagcacgcgauccugcucgucgcccugagcuuugugacccuuaucacaggaaauauguccuucagagaccugggccgcguuauggugauggucggcgcuaccaugacggaugacauugggaugggagugacauaucucgcccugcuggccgcuuuuaaaguuagaccuaccuucgccgcgggccuucugcuccggaagcugacaucuaaagagcucaugauggcuaccaucgggauugcccugcuuagccaguccacccugcccgaaacaauccucgagcugacggaugcccuggcucuuggaaugauggcccugaagauugugcgcaacauggaaaaauaccaacucgcggucaccaucauggcuaucucuugcgugccuaaugccguuauucugcagaacgccuggaaggugagcuguacaauccucgcugccgucuccgugagcccccugcuucugaccucuucccagcagaaggcugacuggauuccucucgcccugacaaucaaaggccugaaucccaccgcgauuuuucuuacgacacugagcagaaccucuaagaaacgguccuggccgcucaacgaggccaucauggcuguggggauggucagcauccuggccucuucccuccugaagaaugacauuccuaugaccggaccccuuguugcuggcggccugcugacagugugcuaugugcucaccgggcgcagcgccgaucuggaacuugagagagccgcugacgucaaaugggaggaucaagcggaaaucuccggaagcucuccuauucugagcaucacaauuuccgaggacggcucuaugagcaucaagaacgaagaggaggaacagacgcucaccauucugauccggacagggcuccuggugaucuccggaguuuuccccgugucuauuccgaucaccgccgcugccugguaccuuugggaggucaaaaagcagcgcgccggcgugcugugggauguuccuucucccccucccguggggaaggcugaacuggaggacggagccuauagaauuaaacagcggggcauccucggcuacucccaaauuggggcgggagucuauaaggaaggcacauuucacaccauguggcaugugacgcgcggggcuguccugaugcacagaggaaaacggaucgagcccuccugggccgaugugaagaaagaccuuaucagcuacggcgggggauggaagcuggagggcgaauggaaggagggcgaagagguucaggugcucgcccuggaaccugggaaaaauccgagagcuguccagaccaagcccggaauuuucaaaacaaacaccggcacaaucggggccgugucccucgauuuuagcccuggaaccucuggcucccccauuguugaccgcaaggggaaaguggucggacuguacggcaauggcguggugacacggagcggggcguauguuucugcuaucgcccagacggagaaguccauugaggauaacccugaaaucgaggacgauaucuucagaaagaaacgccuuaccauuauggaccugcaucccggagccggcaagacaaaacgguaccugccugcuaucgucagagaagccauuaagcgcgggcuccggacccugauccuugcuccgaccagagugguggccgcggagauggaagaggcccugcgcggacuccccauucgguaucaaaccccugcuaucagagccgagcacacgggccgggaaauugucgaccugaugugucaugcuaccuucacaaugcgccuccugagccccgugagaguuccuaacuacaaucuuaucaucauggaugaggcccacuuuaccgaccccgccuccauugcugcgcggggguauaucucuacacgcguggaaaugggcgaggccgcuggaauuuucaugaccgccacgccgccuggcagcagagaucccuuuccccaguccaacgccccuaucauggacgaggaacgggagauucccgaaagaagcuggaacucugggcacgagugggucacagauuucaaaggaaagaccgugugguuuguuccuuccaucaaggcuggcaacgacaucgccgcgugccugcgcaaaaaugggaagaaagugauucagcugagccggaagaccuucgauucugaauacgucaaaacaagagcuaacgacugggauuuugugguuaccacagacaucagcgagaugggagccaauuucaaggccgagcgcgugauugauccgcggagauguaugaagcccgucauccucaccgacggcgaagaaagagugauucuggcugggccuaugcccgugacgcauuccucugccgcgcaacggagaggccgcaucggaagaaacccuaaaaaugaaaacgaccaguauaucuacaugggcgagccccuugaaaaugaugaggacugcgcccacuggaaggaggcuaaaaugcugcucgauaacauuaauacaccggaagggaucauuccuagcauguuugagcccgaacgggagaaggucgacgccaucgauggagaauaccgccugagaggcgaggcucggaaaaccuucguugaccugaugcgcagaggggaucucccuguguggcuugccuauaagguggcugccgagggaauuaacuacgcggaccggaaaugguguuuugauggcaucaagaauaaccagauucuggaagagaacgucgaaguggagaucuggacaaaggagggggaacgcaagaagcugaaaccccgcuggcucgacgcccggaucuauuccgauccucuggcucuuaaggaguucaaagaguucgccgcuggcagaaagucucugacccucaaucugauuacggagaugggacgccugcccaccuuuaugacacagaaggcccggaacgcccucgacaaucuugcuguucugcauaccgcggaagugggcgggaaagccuacacacacgcucugagcgagcucccggagacccuggaaacacuucugcuccugacccugcucgccgccgucacgggaggcaucuuccuuuuucugauguccgggaagggaauuggcaaaaugacacugggcaugugcugcaucauuaccgcuagcauccuccugugguaugcccaaauccagccucacuggauugcggccucuaucauucuugaguucuuucugaucgugcuccugauucccgaacccgagaagcagagaaccccucaggauaaccaacugacauacguugugaucgcuauccucaccgucguggccgcuacaauggccaaugaaaugggguuccuugagaaaacgaagaaggaccugggauuuggcuccauuaccacacaggagagcgaauccaacauccuggacauugaucuccggccggcgucugccuggacccuguaugcugucgccacaaccuucgugacgcccaugcuucgccauagcaucgagaauagcucuguuaacgugagccugaccgcuauugccaaucaggcuacagugcucauggggcugggaaaaggcuggccucuguccaagauggacaucggggucccccuccuugccauuggauguuacagccagguuaacccuaucacccugacagcggcccugcuccugcuuguggcucacuacgccaucauuggccccggccugcaagcuaaagccaccagagaagcccagaagcgggcggcugccgggaucaugaaaaauccuacgguggauggaauuacagucaucgaccucgagccgauucccuaugauccuaaguuugaaaagcagcugggccaggugaugcugcucauccuuugcguuacccaagugcugaugaugcgcacaaccugggcucugugugaggcccucacccuggccacagggcccaucucuacgcuuugggagggaaacccuggcagauucuggaauaccacaauugcugucuccauggccaacaucuuucgggggagcuaccuggcgggagccggccuccuguucucuauuaugaaaaauaccacaaacacccgcagaggcacggggaaugugggagaaacacugggcgagaaguggaaaucccggcucaacgcucuuggaaagagcgaauuucagaucuauaaaaagucuggcauucaggaggucgaccgcacccuggccaaagagggcaucaagagaggggaaaccgaucaucacgcugugagccggggauccgccaagcugagaugguucguugagcgcaacauggugacacccgaaggcaaagucguggaccucggcugcgggcggggaggcuggucuuacuauugugggggacugaagaauguuagagaggugaaaggccuuaccaaagggggaccgggccaugaggagccuauccccaugagcacauacggcuggaaccugguccgccuccaauccgggguggauguguucuuuacgcccccugagaaaugcgacacccugcugugugauauuggagaaagcucccccaauccuacaaucgaggcgggccggacccucagaguucuuaaccuggucgaaaauuggcugaacaauaacacacaguucugcauuaaggugcucaauccguauaugcccucugugaucgagaagauggaaacccugcagcgcaaauacgggggagcccuuguccggaacccucugagcagaaauuccacgcacgagauguacuggguuucuaacgcuaccggcaauauugugagcuccgugaacaugaucucucgcaugcucaucaaucgguuuacaaugaagcacaaaaaggccaccuaugagcccgacgucgaucuggggagcggaacaagaaacauuggcaucgaauccgagauuccuaaccuggacaucgugggcaaacgcauugaaaagaucaagcaggagcaugaaaccagcuggcacuacgaccaagaucaucccuauaaaacaugggcuuaccacgggucuuaugagaccaagcagacgggauccgccagcucuaugguuaauggcgugguccggcuccuuacaaaaccgugggacgugguuccuauggugacccagauggcuaugaccgauacaacgcccuucgggcagcaaagagucuuuaaggagaaaguggacacccgcacacaggaaccuaaggagggaaccaagaaacugaugaagauuacagccgaauggcuguggaaagagcucggcaaggagaaaacccccagaauguguacacgggaagaguucacccgcaaggugagauccaacgcggcccugggggcugucuuuacggaugaaaauaaauggaaaagcgcccgggaggcuguugaagacggaagauucugggagcuuguggaucgggagcgcaaccugcaccucgaaggcaagugcgagaccuguguguacaauaugaugggcaaaagagaaaagaaacugggggaguuuggaaaggccaaaggcucucgggccaucugguauauguggcugggggcgcgcuuccucgaauuugaggcucugggauuccuuaacgaggaccauugguuuuccagaggcaauagccuguccggggucgaaggcgagggacuccaccggcugggcuacauccuucgcgaaguggggaagaaggagggaggcgccauguacgccgaugacacagcugggugggauaccagaauuacacuggaagaccucaaaaacgaggagaugguuaccaaucauaugaagggagaacacaaaaagcuggccgaggcuaucuucaaacugacguaucagaacaaggugguccgggugcagcgcccuacacccagaggcaccguuauggacauuaucagccggaaggaucaacgcgggucuggccaggugggaacauacggccucaauaccuucacgaacauggaagcccagcugauuagacaaauggagggggagggaaucuuuaaaagcauccagcaucuuaccacaaccgaagagauugcgguccagaauuggcuggcccgggugggccgcgaaagacucucccggauggcuaucucuggggacgauugcguugugaagccgauugacgauagauucgccagcgcucugacagcccuuaacgacaugggaaaaguccgcaaggauauccagcaaugggagccuucccggggcuggaaugacuggacccaggugcccuuuugcucucaccacuuccaugaacuggucaugaaagaugggagagugcucguugugcccugucgcaaccaggacgagcugauuggccgggcgagaaucagccagggagccggcuggucccugaaggagacagcuugccucgggaagucuuaugcccaaauguggacccugauguacuuucaccgccgggaucuuagacuggcugccaacgcuaucuguagcgccgucccuucccauugggugccgacgagccgcacaaccuggucuauucacgcgaaacacgaauggaugaccacagaggacaugcucgugguuuggaaucggguguggauccaggaaaaccccuggauggaggauaagaccccugucgaauccugggaggaggugcccuaucugggaaaaagagaagaccaguggugcggcagccuuauugggcugacaucucgcgccacgugggcuaagaauauccagaccgccauuaaccaaguucggucccucaucggaaaugagggcuacacagacuauaugccuagcaugaaaagauuccggagagaagaggaagaggccggggugcugugguga

SEQ ID NO: 19843 - RNA, 9876 nt, Artificial Sequence
  derived and/or modified CDS sequence (opt5) from DENV-2__KC294205__SS-prME
acagccggagugaucgucaugcugauucccacagcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaagacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccaccagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaggcggaaaucuccggaagcucuccuauucugagcaucacaauuuccgaggacggcucuaugagcaucaaaaacgaagaggaggaacaaacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccagauuggggcgggagucuauaaagaaggcacauuucauaccauguggcacgugacgagaggggcuguccugaugcaucgcggaaagagaaucgagcccuccugggccgaugugaaaaaggaccuuaucagcuacggcgggggauggaagcuggagggcgaauggaaagagggcgaagagguucaagugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaccccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucagaccccugcuauccgggccgagcauacgggcagagaaauugucgaccugaugugucacgcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaauccaacgccccuaucauggacgaggaaagagagauucccgaacggagcuggaacucugggcaugagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcacuccucugccgcgcagcgccggggcagaaucggacgcaacccuaagaaugaaaacgaccaauauaucuacaugggcgagccccuugaaaaugaugaggacugcgcccauuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcaacgcccucgacaaucuugcuguucugcacaccgcggaagugggcgggaaggccuacacacacgcucugagcgagcucccggagacccuggaaacacuucugcuccugacccugcucgccgccgucacgggaggcaucuuccuuuuucugauguccgggaaaggaauuggcaagaugacacugggcaugugcugcaucauuaccgcuagcauccuccugugguaugcccagauccaaccucauuggauugcggccucuaucauucuugaguucuuucugaucgugcuccugauucccgaacccgagaaacagcggaccccucaggauaaccagcugacauacguugugaucgcuauccucaccgucguggccgcuacaauggccaaugaaaugggguuccuugagaagacgaagaaagaccugggauuuggcuccauuaccacacaagagagcgaauccaacauccuggacauugaucucagaccggcgucugccuggacccuguaugcugucgccacaaccuucgugacgcccaugcuucggcacagcaucgaaaauagcucuguuaacgugagccugaccgcuauugccaaucaggcuacagugcucauggggcugggaaagggcuggccucuguccaaaauggacaucggggucccccuccuugccauuggauguuacagccagguuaacccuaucacccugacagcggcccugcuccugcuuguggcucauuacgccaucauuggccccggccugcaggcuaaggccacccgcgaagcccagaagcgggcggcugccgggaucaugaagaauccuacgguggauggaauuacagucaucgaccucgagccgauucccuaugauccuaaguuugaaaaacagcugggccaggugaugcugcucauccuuugcguuacccaggugcugaugaugcggacaaccugggcucugugugaggcccucacccuggccacagggcccaucucuacgcuuugggagggaaacccuggccgcuucuggaauaccacaauugcugucuccauggccaacaucuuuagagggagcuaccuggcgggagccggccuccuguucucuauuaugaagaauaccacaaacacccggcgcggcacggggaaugugggagaaacacugggcgagaaauggaaguccagacucaacgcucuugggaaaagcgaauuucaaaucuauaagaaaucuggcauucaggaggucgaccggacccuggccaaggagggcaucaagcgcggggaaaccgaucaccaugcugugagcagaggauccgccaaacugcggugguucguugagagaaacauggugacacccgaaggcaaggucguggaccucggcugcgggcgcggaggcuggucuuacuauugugggggacugaaaaauguucgggaggugaagggccuuaccaaagggggaccgggccacgaggaaccuauccccaugagcacauacggcuggaaccuggucagacuccaguccgggguggauguguucuuuacgcccccugagaagugcgacacccugcugugugauauuggagaaagcucccccaauccuacaaucgaggcgggccgcacccuccggguucuuaaccuggucgaaaauuggcugaacacaaauacccaauucugcauuaaggugcucaacccguauaugcccucugugaucgagaaaauggaaacgcugcagagaaaguacgggggagcccuuguccgcaauccucugagccggaacuccacccacgagauguacuggguuucuaaugcuacaggcaacauugugagcuccgugaauaugaucucuagaaugcucaucaaccgcuuuaccaugaaacauaagaaagccacauaugagcccgacgucgaucuggggagcggaacccggaauauuggcaucgaauccgagauuccuaaccuggacaucgugggcaagagaauugaaaagaucaaacaggagcacgaaacaagcuggcauuacgaccaggaucaccccuauaagaccugggcuuaccacgggucuuaugagacgaaacaaacaggauccgccagcucuaugguuaacggcgugguccgccuccuuaccaagccgugggacgugguuccuauggugacccagauggcuaugacagauacgacccccuucgggcagcagcgggucuuuaaagagaagguggacacaagaacccaagaaccuaaggagggaaccaagaagcugaugaaaauuaccgccgaauggcuguggaaggagcucggcaaagagaagacaccccgcauguguaccagagaagaguucacgcggaaagugcgcuccaaugcggcccugggggcugucuuuaccgaugaaaacaaguggaaaagcgccagagaggcuguugaagacggacgguucugggagcuuguggauagagagcggaaucugcaucucgaaggcaaaugcgagacauguguguacaacaugaugggcaagcgcgagaagaagcugggggaguuuggaaaagccaagggcucuagagccaucugguauauguggcugggggcgcgguuccucgaauuugaggcucugggauuccuuaaugaggaccacugguuuucccgcggcaacagccuguccggggucgaaggcgagggacuccauagacugggcuacauccuucgggaaguggggaagaaagagggaggcgccauguacgccgaugacaccgcugggugggauacacgcauuacccuggaagaccucaagaaugaggagaugguuacgaaccacaugaaaggagaacauaagaaacuggccgaggcuaucuucaagcugacauaucagaauaagguggucagagugcagcggccuacaccccgcggcacaguuauggacauuaucagcagaaaagaucagcgggggucuggccaagugggaaccuacggccucaacacguucaccaauauggaagcccagcugauucgccagauggagggggagggaaucuuuaagagcauccaacaccuuacagcgaccgaagagauugccguccagaacuggcuggcuagagugggccgggaacgccucuccagaauggccaucucuggggacgauugcguugugaaaccgauugacgaucgguucgcuagcgcccugacagcgcuuaaugacaugggaaaggucagaaaagauauccagcagugggagccuucccgcggcuggaacgacuggacccaagugcccuuuugcucucaccauuuccacgaacuggucaugaaggaugggcgggugcucguugugcccuguagaaaucaggacgagcugauuggccgcgcccggaucagccagggagcuggcuggucccugaaggagacagccugccucgggaaaucuuaugcucagauguggacccugauguacuuucauagacgcgaucuucggcuggccgcuaacgccaucuguagcgcggucccuucccacugggugccgacgagcagaacaaccuggucuauucacgccaagcaugaauggaugaccacagaggacaugcucgugguuuggaaccgcguguggauccaagaaaaucccuggauggaggauaaaaccccugucgaauccugggaggaggugcccuaucugggaaagcgggaagaccaguggugcggcagccuuauugggcugacaucuagagcuacgugggccaaaaacauccagaccgccauuaaucagguucgcucccucaucggaaacgagggcuacacagacuauaugccuagcaugaagcgguucagacgggaagaggaagaggcuggggugcugugguga

SEQ ID NO: 19844 - RNA, 9876 nt, Artificial Sequence
  derived and/or modified CDS sequence (opt5) from DENV-2__KC294210__SS-prME
acagccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaugauggagagcucuccccggaccggccuugauuucaacgaaauggugcugcuccaaauggaggacaaggcuuggcugguucaccgccagugguuucuugaucugccgcucccuuggcugcccggggccgacacacagggauccaauuggauccagaaggagacccuggugacguucaagaacccucaugcuaaaaagcaagacgucgugguucucggcagccaggaaggggccaugcacacagcccugaccggcgcuacagagauucagauguccucuggaaaucuucuguuuaccggccaucucaaauguagacugcggauggauaaacuucaacugaaagggaugagcuacuccaugugcaccggaaaguucaagaucgugaaagaaauugcggagacacagcacggcacgaucgucaucagagugcaguaugagggggacggaagccccuguaagauucccuucgaaaucaccgaucucgagaaacgccauguccugggccggcugauuacagugaacccuaucguuaccgaaaaggacucuccggugaacauugaggccgaacccccuuuuggggauuccuacaucauugucggcguggagcccggacagcucaaacugaauugguucaagaagggcagcucuaucgggcaaauguuugagacaaccaugagaggagcuaaacgcauggccauccuuggcgacacggccugggauuucgggagccugggaggcguuuuuacauccauugggaaggcucuccaccagguguucggcgccaucuacggagcggcuuuuucuggcgucagcuggaccaugaaaauucugaucggggugauuaucaccuggaucggaaugaacucccggagcacaucucuguccgugagccuuguucucgucggcguggugacccuguaucugggggccaugguccaggccgacucuggaugcauuguguccuggaagaauaaagaacucaaguguggcagcgggaucuucauuacagauaacguucacacguggaccgagcaguacaaguuucaaccugaaucccccucuaaacuggcuagcgccauccagaaggcucaugaggaaggcauuugcggaaucagauccgugacacgccuugagaaucugauguggaaacagaucaccccggagcucaaccacauucugucugaaaaugaggucaagcugacaaucaugaccggcgacauuaaagggaucaugcaggccggaaagcggagccuuagaccucaacccacggaacucaaauauuccuggaagaccuggggcaaggcgaaaaugcugagcacagagucucauaaccagaccuuccugauugaugggccugaaacagccgagugucccaauaccaaccgcgcuuggaacucccucgagguggaagacuacggauuuggcguuuucacaaccaacaucuggcugaaacuucgggagaaacaggacguguuuugcgauagcaagcugaugucugccgcuaucaaagacaauagagccguccacgcggauaugggcuauuggauugaauccgcccucaacgacacguggaagauggagaaggcuagcuucaucgaggugaaaucuugucacuggccuaagagccauacacugugguccaaugggguucuggaaagcgagaugauuauccccaaaaacuucgccggaccggugucucagcacaacuaccgcccuggcuaucauacccaaaccgcugggcccuggcaccuuggaaagcucgaaauggauuuugacuucugcgagggcacaaccgucguggugacggaagauugugggaaucggggacccucccugagaacaaccacagccagcggcaaacugauuaccgaguggugcugccgguccuguacacucccuccgcugcgcuacagaggcgaggacgggugcugguacggaauggaaauccggccccuuaaggagaaggaagagaaccuggucaauucucucguuaccgccggccaugggcagauugauaacuuuagccugggagugcugggcauggcucuuuuccucgaagagaugcugagaacgcgcguggggaccaaacacgcgauccugcucgucgcccuguccuuugugacacuuaucaccggaaauaugucuuuccgggaccugggcagaguuauggugauggucggcgcuacaaugaccgaugacauugggaugggagugacguaucucgcccugcuggccgcuuuuaagguucgcccuacauucgccgcgggccuucugcucagaaaacugaccagcaaggagcucaugauggcuacaaucgggauugcccugcuuucccagucuacccugcccgaaaccauccucgagcugacagaugcccuggcucuuggaaugauggcccugaaaauugugcggaacauggaaaaguaccaacucgcggucacgaucauggcuaucagcugugugccuaaugccguuauucugcagaacgccuggaagguguccugcaccauccucgcugccgucagcgugucuccccugcuucugacauccagccagcagaaagcugacuggauuccucucgcccugaccaucaagggccugaaucccacagcgauuuuucuuaccacgcugucucgcacauccaaaaagagaagcuggccgcucaacgaggccaucauggcuguggggauggucucuauccuggccuccagccuccugaaaaaugacauuccuaugaccggaccccuuguugcuggcggccugcugaccguguguuaugugcucacagggcgguccgccgaucuggaacuugagcgcgccgcugacgucaagugggaggaucaagcggaaaucagcggaucuagcccuauucuguccaucaccauuucugaggacggcagcauguccaucaaaaacgaagaggaggaacagacacucacgauucugaucagaaccgggcuccuggugaucucuggaguuuuccccgugagcauuccgaucacagccgcugccugguaccuuugggaggucaagaagcagcgggccggcgugcugugggauguuccuucucccccucccguggggaaagcugaacuggaggacggagccuaucgcauuaagcagagaggcauccucggcuacagccaaauuggggcgggagucuauaaagaaggcaccuuucacacaauguggcaugugaccagaggggcuguccugaugcaccgcggaaagagaaucgagcccagcugggccgaugugaaaaaggaccuuaucuccuacggcgggggauggaagcuggagggcgaauggaaagagggcgaagagguucaggugcucgcccuggaaccugggaagaauccgcgggcuguccagacgaaacccggaauuuucaagaccaacacaggcaccaucggggccgugagccucgauuuuucuccuggaacauccggcagccccauuguugacagaaaagggaagguggucggacuguacggcaauggcguggugacccgcucuggggcguauguuuccgcuaucgcccagacagaaaagagcauugaggauaacccugaaaucgaggacgauaucuuccggaaaaagagacuuacgauuauggaccugcaucccggagccggcaaaaccaagcgcuaccugccugcuaucguccgggaagccauuaaaagagggcuccgcacacugauccuugcuccgacccgggugguggccgcggagauggaagaggcccugagaggacuccccauucgcuaucaaaccccugcuauccgggccgagcacacaggcagagaaauugucgaccugaugugccaugcuacguucaccaugcggcuccugucccccgugcgcguuccuaacuacaaucuuaucaucauggaugaggcccacuuuacagaccccgccucuauugcugcgagaggguauaucagcacccggguggaaaugggcgaggccgcuggaauuuucaugacagccaccccgccuggcucccgcgaucccuuuccccagagcaacgccccuaucauggacgaggaaagagagauucccgaacggucuuggaacuccgggcacgagugggucacggauuucaagggaaagacagugugguuuguuccuagcaucaaagcuggcaacgacaucgccgcgugucugagaaagaaugggaaaaaggugauucagcugucucgcaaaaccuucgauagcgaauacgucaagacccgggcuaacgacugggauuuugugguuacaaccgacaucuccgagaugggagccaauuucaaggccgagagagugauugauccgcgccggugcaugaaacccgucauccucacagacggcgaagagagagugauucuggcugggccuaugcccgugacccauucuagcgccgcgcaacgccggggcagaaucggacgcaacccuaagaaugaaaacgaccaguauaucuacaugggcgagccccuugaaaaugaugaggacugugcccacuggaaagaggcuaagaugcugcucgauaacauuaauacgccggaagggaucauuccuuccauguuugagcccgaaagagagaaagucgacgccaucgauggagaauaccggcugcgcggcgaggcuagaaagacauucguugaccugaugcggcgcggggaucucccuguguggcuugccuauaaaguggcugccgagggaauuaacuacgcggacagaaaguggugcuuugauggcaucaagaauaaccagauucuggaagagaacgucgaaguggagaucuggaccaaagagggggaacggaagaaacugaagcccagauggcucgacgcccgcaucuauucugauccucuggcucuuaaagaguucaaggaguucgccgcuggccggaagucccugacacucaaucugauuaccgagaugggaagacugcccacguuuaugacccagaaagcccgcaacgcccucgacaaucuugcuguucugcauacagcggaagugggcgggaaggccuacacccacgcucuguccgagcucccggagacacuggaaacccuucugcuccugacacugcucgccgccgucaccggaggcaucuuccuuuuucugaugagcgggaaaggaauuggcaagaugacgcugggcauguguugcaucauuacagcuucuauccuccugugguaugcccaaauccagccucacuggauugcggccuccaucauucuugaguucuuucugaucgugcuccugauucccgaacccgagaaacagcggaccccucaggauaaccaacugaccuacguugugaucgcuauccucacagucguggccgcuaccauggccaaugaaaugggguuccuugagaagacaaagaaagaccugggauuuggcagcauuacgacccaggaguccgaaucuaacauccuggacauugaucucagaccggcgagcgccuggacacuguaugcugucgccaccacauucgugacccccaugcuucggcauuccaucgaaaauucuagcguuaacgugucccugacggcuauugccaaucaggcuaccgugcucauggggcugggaaagggcuggccucugagcaaaauggacaucggggucccccuccuugccauuggaugcuacucucagguuaacccuaucacacugaccgcggcccugcuccugcuuguggcucacuacgccaucauuggccccggccugcaagcuaaggccacacgcgaagcccagaaaagagcggcugccgggaucaugaagaauccuaccguggauggaauuacggucaucgaccucgagccgauucccuaugauccuaaguuugaaaaacagcugggccaggugaugcugcucauccuuuguguuacacaagugcugaugaugcggaccacaugggcucugugcgaggcccucacccuggccaccgggcccaucuccacacuuugggagggaaacccuggccgcuucuggaauacgaccauugcugucagcauggccaacaucuuuagagggucuuaccuggcgggagccggccuccuguucuccauuaugaagaauacaaccaacacacggcgcggcaccgggaaugugggagaaacgcugggcgagaaauggaaaagcagacucaacgcucuugggaaaucugaauuucagaucuauaagaaaagcggcauucaggaggucgaccggacacuggccaaggagggcaucaagcgcggggaaaccgaucaucacgcuguguccagaggaucugccaaacugcggugguucguugagagaaacauggugacccccgaaggcaaggucguggaccucggcugugggcgcggaggcuggagcuacuauugcgggggacugaaaaauguucgggaggugaagggccuuacaaaagggggaccgggccaugaggaaccuauccccauguccaccuacggcuggaaccuggucagacuccaaagcgggguggauguguucuuuacacccccugagaagugugacacgcugcugugcgauauuggagaauccucucccaauccuaccaucgaggcgggccgcacacuccggguucuuaaccuggucgaaaauuggcugaacaauaacacccaguucuguauuaaggugcucaauccguauaugcccagcgugaucgagaaaauggaaacacugcagagaaaguacgggggagcccuuguccgcaacccucuguccagaaauucuacccacgagauguacuggguuagcaacgcuacgggcaauauuguguccucugugaacaugaucagcagaaugcucaucaaucgcuuuaccaugaaacacaagaaagccacauaugagcccgacgucgaucugggguccggaacccggaacauuggcaucgaaagcgagauuccuaaccuggacaucgugggcaagagaauugaaaagaucaaacaggagcaugaaacaucuuggcacuacgaccaagaucaucccuauaagaccugggcuuaccacggguccuaugagacaaaacagaccggaagcgccucuuccaugguuaauggcgugguccgccuccuuacgaagccgugggacgugguuccuauggugacacagauggcuaugaccgauaccacacccuucgggcagcaacgggucuuuaaagagaagguggacacgagaacccaggaaccuaaggagggaaccaagaagcugaugaaaauuaccgccgaauggcuguggaaggagcucggcaaagagaagacaccccgcaugugcaccagagaagaguucacacggaaagugcgcagcaacgcggcccugggggcugucuuuaccgaugaaaauaaguggaagucugccagagaggcuguugaagacggacgguucugggagcuuguggauagagagcggaaccugcaccucgaaggcaaaugugagacgugcguguacaauaugaugggcaagcgcgagaagaagcugggggaguuuggaaaagccaagggcuccagagccaucugguauauguggcugggggcgcgguuccucgaauuugaggcucugggauuccuuaacgaggaccauugguuuagccgcggcaauucccugagcggggucgaaggcgagggacuccacagacugggcuacauccuucgggaaguggggaagaaagagggaggcgccauguacgccgaugacaccgcugggugggauacacgcauuacccuggaagaccucaagaacgaggagaugguuacaaaucauaugaaaggagaacacaagaaacuggccgaggcuaucuucaagcugaccuaucagaacaagguggucagagugcagcggccuacgccccgcggcacaguuauggacauuaucucuagaaaagaucaacgggggagcggccaggugggaaccuacggccucaauacauucaccaacauggaagcccagcugauucgccaaauggagggggagggaaucuuuaaguccauccagcaucuuacggcgaccgaagagauugccguccagaauuggcuggugagaguuggccgggaacgccucucuagaauggcuaucagcggggacgauuguguggucaaaccgauugacgaucgguucgccuccgcucugacagcccuuaacgacaugggaaaggugagaaaagauauccagcaaugggagccuucucgcggcuggaaugacuggacccagguccccuuuugcagccaccacuuccaugaacuggugaugaaggaugggcggguucucgugguccccugcagaaaccaggacgagcugauuggccgcgcgcggaucucccagggagccggcuggucucugaaggagacagcuugucucgggaaaagcuaugcccaaauguggacccugauguacuuucacagacgcgaucuucggcuggcugccaacgcuaucugcuccgccgugccuagccauugggugccgacaucuagaaccacgugguccauucacgcgaagcacgaauggaugacaaccgaggacaugcucguuguguggaaucgcgucuggauccaggaaaaccccuggauggaggauaaaaccccuguggaaagcugggaggagguucccuaucugggaaagcgggaagaccagugguguggcucucuuauugggcugacauccagagccaccugggcuaaaaauauccagacagccauuaaccaagugcgcagccucaucggaaaugagggcuacacggacuauaugccuuccaugaagcgguucagacgggaagaggaagaggccgggguccugugguga

SEQ ID NO: 19845 - RNA, 9876 nt, Artificial Sequence
  derived and/or modified CDS sequence (opt5) from DENV-2__KC294215__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgaugugaaaaaggaccuuaucagcuacggcgggggauggaagcuggagggcgaauggaaagagggcgaagagguucaggugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaguccaacgccccuaucauggacgaggaaagagagauucccgaacggagcuggaacucugggcacgagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcauuccucugccgcgcaacgccggggcagaaucggacgcaacccuaagaaugaaaacgaccaguauaucuacaugggcgagccccuugaaaaugaugaggacugcgcccacuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcaacgcccucgacaaucuugcuguucugcauaccgcggaagugggcgggaaggccuacacacacgcucugagcgagcucccggagacccuggaaacacuucugcuccugacccugcucgccgccgucacgggaggcaucuuccuuuuucugauguccgggaaaggaauuggcaagaugacacugggcaugugcugcaucauuaccgcuagcauccuccugugguaugcccaaauccagccucacuggauugcggccucuaucauucuugaguucuuucugaucgugcuccugauucccgaacccgagaaacagcggaccccucaggauaaccaacugacauacguugugaucgcuauccucaccgucguggccgcuacaauggccaaugaaaugggguuccuugagaagacgaagaaagaccugggauuuggcuccauuaccacacaggagagcgaauccaacauccuggacauugaucucagaccggcgucugccuggacccuguaugcugucgccacaaccuucgugacgcccaugcuucggcauagcaucgaaaauagcucuguuaacgugagccugaccgcuauugccaaucaggcuacagugcucauggggcugggaaagggcuggccucuguccaaaauggacaucggggucccccuccuugccauuggauguuacagccagguuaacccuaucacccugacagcggcccugcuccugcuuguggcucacuacgccaucauuggccccggccugcaagcuaaggccacccgcgaagcccagaaaagagcggcugccgggaucaugaagaauccuacgguggauggaauuacagucaucgaccucgagccgauucccuaugauccuaaguuugaaaaacagcugggccaggugaugcugcucauccuuugcguuacccaagugcugaugaugcggacaaccugggcucugugugaggcccucacccuggccacagggcccaucucuacgcuuugggagggaaacccuggccgcuucuggaauaccacaauugcugucuccauggccaacaucuuuagagggagcuaccuggcgggagccggccuccuguucucuauuaugaagaauaccacaaacacccggcgcggcacggggaaugugggagaaacacugggcgagaaauggaaguccagacucaacgcucuugggaaaagcgaauuucagaucuauaagaaaucuggcauucaggaggucgaccggacccuggccaaggagggcaucaagcgcggggaaaccgaucaucacgcugugagcagaggauccgccaaacugcggugguucguugagagaaacauggugacacccgaaggcaaggucguggaccucggcugcgggcgcggaggcuggucuuacuauugugggggacugaaaaauguucgggaggugaagggccuuaccaaagggggaccgggccaugaggaaccuauccccaugagcacauacggcuggaaccuggucagacuccaauccgggguggauguguucuuuacgcccccugagaagugcgacacccugcugugugauauuggagaaagcucccccaauccuacaaucgaggcgggccgcacccuccggguucuuaaccuggucgaaaauuggcugaacaauaacacacaguucugcauuaaggugcucaauccguauaugcccucugugaucgagaaaauggaaacccugcagagaaaguacgggggagcccuuguccgcaacccucugagcagaaauuccacgcacgagauguacuggguuucuaacgcuaccggcaauauugugagcuccgugaacaugaucucuagaaugcucaucaaucgcuuuacaaugaaacacaagaaagccaccuaugagcccgacgucgaucuggggagcggaacacggaacauuggcaucgaauccgagauuccuaaccuggacaucgugggcaagagaauugaaaagaucaaacaggagcaugaaaccagcuggcacuacgaccaagaucaucccuauaagacaugggcuuaccacgggucuuaugagaccaaacagacgggauccgccagcucuaugguuaauggcgugguccgccuccuuacaaagccgugggacgugguuccuauggugacccagauggcuaugaccgauacaacgcccuucgggcagcaacgggucuuuaaagagaagguggacaccagaacacaggaaccuaaggagggaaccaaaaagcugaugaaaauuacagccaaguggcuguggaaagaacucggcaaggagaaaacaccccgcauguguacaagagaggaguucacccggaaggugcgcuccaacgcggcccugggggcugucuuuacggaugagaauaaguggaaaagcgccagagaagcuguugaggacggacgguucugggaacuuguggauagagagcggaaccugcaccucgagggcaagugcgaaaccuguguguacaauaugaugggcaaacgcgagaagaaacugggggaauuuggaaaggccaagggcucuagagccaucugguauauguggcugggggcgcgguuccucgaguuugaagcucugggauuccuuaacgaggaccauugguuuucccgcggcaauagccuguccggggucgagggcgaaggacuccacagacugggcuacauccuucgggagguggggaaaaaggaaggaggcgccauguacgccgaugacacagcugggugggauacccgcauuacacuggaggaccucaaaaacgaagagaugguuaccaaucauaugaagggagagcacaaaaagcuggccgaagcuaucuucaagcugacguaucagaacaaaguggucagagugcagcggccuacaccccgcggcaccguuauggacauuaucagcagaaaggaucaacgggggucuggccaggugggaacauacggccucaauaccuucacgaacauggaggcccagcugauucgccaaauggaaggggagggaaucuuuaaaagcauccagcaucuuaccgcgacagaggaaauugccguccagaauuggcuggcuagagugggccgggagcgccucuccagaauggccaucucuggggacgauugcguugugaagccgauugacgaucgguucgcuagcgcccugaccgcgcuuaacgacaugggaaaagucagaaaggauauccagcaaugggaaccuucccgcggcuggaaugacuggacacaggugcccuuuugcucucaccacuuccaugagcuggucaugaaggaugggcgggugcucguugugcccuguagaaaccaggacgaacugauuggccgcgcccggaucagccagggagcuggcuggucccugaaagagaccgccugccucgggaagucuuaugcucaaauguggacacugauguacuuucacagacgcgaucuucggcuggccgcuaacgccaucuguagcgcggucccuucccauugggugccgaccagcagaacgacauggucuauucacgccaaacacgaguggaugaccaccgaagacaugcucgugguuuggaaucgcguguggauccaggagaaccccuggauggaagauaagacaccugucgaguccugggaagaggugcccuaucugggaaaacgggaggaccaguggugcggcagccuuauugggcugaccucuagagcuacaugggccaagaauauccagacggccauuaaccaaguucgcucccucaucggaaaugaaggcuacaccgacuauaugccuagcaugaagcgguucagacgggaggaagaggaagcuggggugcugugguga

SEQ ID NO: 19846 - RNA, 9876 nt, Artificial Sequence
  derived and/or modified CDS sequence (opt5) from DENV-2__KC294216__SS-prME
accgccggagugaucauuaugcugauccccaccgcuauggccuuccaccucacgaccagaaauggggagccucauaugauugugggacggcaggaaaagggaaagagccugcuuuuuaagacggaggacgggguuaauaugugcacccugauggcgaucgaucucggagaacugugugaggacacaauuaccuacaaaugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggaucuugaacugauuaaaacagaggccaagcagccugcuacccucagaaaauauugcaucgaagccaagcugacgaacacaaccaccgagagccgguguccgacacaaggagagcccucucugaaugaggaacaggacaaacgcuucauuugcaagcauuccaugguggauagaggcuggggcaacggguguggacucuuuggcaaagggggaaucgugaccugcgcgauguucacaugcaaaaagaauauggaaggcaaagucguucugccugagaaccuugaauacacgauugugaucacaccccacagcggggaggagcaugccgugggaaaugacacaggcaagcacggcgaagagaucaaaauuaccccucagucuuccaucacagaagcugagcugaccggguauggaacggucaccauggaauguagcccccggacaggccucgauuuuaacgagauggugcugcuucagauggaggaaaaggccuggcugguucaccgccaaugguuccucgaccugccgcugccuuggcuccccggggcugauacccagggaucuaauuggauucagaaagagacacuggugaccuuuaagaacccucaugccaagaaacaggacgucgugguucuuggcucccaagaaggggccaugcacacggcucugacaggcgcgaccgagauccagaugagcuccggaaaucuccuguucacaggccaucuuaagugcagacugcggauggacaaacuccagcugaaggggaugucuuacagcauguguaccggaaaauuuaagauugugaaggagaucgccgaaacccaacacggcacaaucgucauuagagugcaguaugagggggauggaucccccugcaaaauccccuucgaaauuauggaccuggagaagcgccauguccucggccggcugaucacggugaacccuauuguuaccgaaaaagauagcccggugaacaucgaggcugagcccccuuucggggacucuuacauuaucaucggcgucgaacccggacagcuuaagcugaauugguuuaaaaagggcuccagcauugggcagauguucgagacaaccaugagaggagccaagcgcauggccauccucggcgauacagcuugggacuuugggucucugggaggcguguucaccagcauugggaaagcccugcaccaaguuuuuggcgcgaucuacggagcugccuucuccggcgugucuuggacgaugaagauucuuaucggggucaucauuacauggaucggaaugaacagccgguccaccagccucucugugucccuggugcugguuggcgucgugacccucuaucugggggccauggugcaggcugauagcggaugugucgugucuuggaaaaauaaggaacuuaaaugcggcuccgggauuuuuaucacagacaacguucacaccuggacagagcaguacaaguuccagccugaaagccccuccaagcuggccucugcuauucaaaaagcccaugaggagggcaucuguggaaucagaagcgugacgcgccucgaaaaucugauguggaagcagauuaccccggagcugaaccacauccuuuccgaaaaugaggucaaacucacaauuaugaccggcgauaucaaggggauuaugcaggcgggaaaacggucucugagaccucagcccacagaacugaaguauagcuggaaaaccuggggcaaggccaagaugcucuccacggagagccauaaccaaaccuuucugaucgacgggccugagacagcugaaugccccaauaccaaccgcgccuggaacucucuugagguggaagauuacggauucggcguuuuuacaaccaacaucuggcugaaacuccgggagaagcaggacguguucugugacuccaaacugaugagcgcugccauuaaggauaauagagcgguccacgccgacaugggcuauuggaucgagucugcucugaacgauacauggaaaauggaaaaggccuccuuuauugaggucaagagcugccacuggccuaaaucucauacccuuuggagcaaugggguucucgaauccgagaugaucauucccaagaacuucgcuggaccggugagccagcacaacuaccgcccuggcuaucauacgcagacagccgggcccuggcaccugggaaaacuggaaauggacuucgauuuuugugagggcaccaccgucguggugacagaggacugcgggaaucggggacccucucucagaaccacgacagccuccggcaagcugaucaccgaauggugcugucggagcugcacacuuccuccgcugcgcuacagaggcgaggauggguguugguacggaauggaaauucggccccucaaagagaaggaagagaaccuggucaauucccugguuaccgcuggccaugggcaaaucgacaacuucucucuuggagugcucggcauggcgcuguuucuggaggaaaugcucagaacacgcguggggaccaagcacgccauccugcuugucgcugugagcuuccugacgcucauuaccggaaauauguccuuucgggaucugggcagaguuauggugauggucggcguggccaugacagacgauaucgggaugggaguuaccuaucuggcccuucuggcugccuucaaagugcgcccuacauuugcggcuggccuccugcucagaaagcugaccucuaaagagcuuaugauggccacgauugggaucacacugcucagccaguccaccacacccgaaaccauucuggagcugaccgacgcccuugcucugggaaugaugguccucaagaucgugcggaacauggaaaaauaccagcuggccguuacaaucaugacgauuucuugcgugccuaaugcgaugauccucauuaacgcuuggaaggucagcuguaccauccuggccgugguguccgucagcccccuucugcucacaucuucccaacagaagaccgauuggauuccucuggcccugacaaucaaaggccuuaaucccaccgcuaucuuccugacgacacucagccgcaccucuaagaaaagauccuggccgcugaacgaggccguuauggcuguggggauggugagcauucucgccucuucccugcuuaagaaugacaucccuaugaccggaccccuggucgcgggcggccugcucacagugugcuauguucugaccgggcggagcgccgaccuugagcuggaacgcgcugccgaugugaaaugggaggaccaggcugaaauuuccggaagcucuccuauccucagcauuacaaucuccgaggauggcucuaugagcauuaagaacgaggaagaggaacagacgcugaccauccucaucagaacagggcugcuugucauuuccggaguguuucccguuucuaucccgauuaccgccgccgcuugguaccugugggaggugcggaaacaacgcgcgggcguccugugggacgugccuucucccccucccgucgaaaaggccgagcucgaggauggggcuuauagaaucaagcagcggggcauucugggcuacucccagaucggcgccgggguguauaaagaaggaacauuccacaccauguggcauguuacgcgcggcgccgugcuuaugcacagagggaagcggaucgagcccuccugggcugacgucaaaaaggaucugauuagcuacggaggcggguggaaacucgaaggagaguggaaggaaggcgaggaggugcagguucuggcccucgaaccuggcaagaauccgagagcggugcaaaccaaacccgggcuguuuaagacaaacaccggaacaaucggcgcugucucccuugacuucagcccugggaccucuggaucccccauuguggaucgcaaaggcaaggugguugggcuguacggaaauggcgucgugacacggagcggcgccuaugugucugccaucgcucagacggagaaauccauugaagacaacccugagaucgaagaugacaucuuuagaaagaagcgccugaccauuauggaucuccaucccggggccggaaaaacaaagcgguaccugccugcgaucgucagagaggcuauuaaacgcggccuucggacccugauccucgccccgaccagagugguugccgcugagauggaagaggcccugcgcgggcuccccauucgguaucagaccccugcuaucagagccgaacacacgggacgggagauuguggaccugaugugucaugcgaccuucacaaugcgccuucugagccccgucagagugccuaacuacaaucugaucaucauggacgaggcccacuucaccgaucccgcuuccauugccgcucggggcuauaucucuacacgcguugaaaugggggaggccgccggcauuuuuaugaccgcuacgccgccuggaagcagagaccccuucccccaguccaacgcgccuaucauggaugaggaacgggaaauucccgagagaagcuggaacucuggccacgagugggugacagacuuuaaggggaaaaccgucugguucgugccuuccaucaaggccggaaacgauaucgcugccugccuccgcaagaauggcaaaaagguuauucaacugagccggaaaaccuuugacucugaauacgugaagacaagagccaacgauugggacuucgucgugaccacagauaucagcgagaugggggcuaauuuucgcgccgaacgggugauugacccgagacgcuguaugaaacccgucauccuuaccgauggagaggaacggguuauucuggcgggcccuaugcccgugacgcauuccucugcugcccagagacgcgggagagugggccggaacccuaagaaugagaacgaccaguauaucuacaugggagagccccucgaaaaugacgaggauugcgcccacuggaaggaagcuaaaaugcugcuggacaacaucaauacaccggagggcauuaucccuagcauguucgaacccgagcgcgagaaggucgaugccauugacggggaauacagacuccggggagaggcgcgcaaaaccuuuguggaucuuaugagacggggcgaccugccuguuuggcuggccuauagaguggcugccgaagggaucaacuacgcugaucgccggugguguuucgacggaauuaagaauaaccaaauccucgaggagaacgucgaaguggagauuuggacaaaagaaggcgagagaaagaaacugaagccccgcuggcuugaugcccggaucuauuccgacccucuggcucucaaggaauuuaaagaguucgccgcggggagaaagucucugacccugaaucucaucacggagaugggccggcuucccaccuucaugacacagaaagcccgcaacgcucuggauaaucuggccguucuccauaccgcugaagccggaggcagagccuacaaccacgcucugagcgagcuuccggaaacacuggagacccuccugcugcucacacuucuggcgaccgugacagggggaauuuuucuguuccucauguccggcaaggggaucggaaaaaugacacugggcaugugcugcauuaucaccgccagcauucuucugugguaugcucagauccagccucacuggaucgccgccucuauuauccucgaauuuuuccugauuguccugcucauccccgagcccgagaagcaacggaccccucaggacaaucagcuuacauacguggucauugcuauccugaccgugguugccgcgacaauggccaacgaaaugggcuuucuggagaagacgaaacgcgaucucgggcugggauccaucaccacacaggaaagcgaguccaauauucuugacaucgaccugagaccggcuucugccuggacccucuaugcuguggccacaaccuucgugacgcccaugcugcggcauagcauugaaaacuccucugucaauguuagccugaccgcgaucgccaaccaagcuacagugcucaugggccuugggaagggauggccucuguccaaaauggauauuggcgugccccugcucgccaucggguguuacagccaggucaauccuauuacccugacagcugcccuucugcuccugguggcucacuacgccaucaucggacccggccugcaggcgaaggccacccgcgaggcucagaaaagagccgcugccggcauuaugaagaacccuacgguugacgggaucacagugauugaucucgagccgauccccuaugacccuaaguuugaaaaacaacuuggacaggucaugcugcugauucucugcgugacccagguccugaugaugcggacaaccugggcccuuugugaggcgcugacccucgcuacaggccccaucucuacgcugugggaagggaauccuggacgcuucuggaacaccacaaucgccguguccauggcuaauauuuuuagaggcagcuaccuggccggggccggacuccuuuucucuaucaugaagaacaccacaaauacccggagaggcacgggcaacauuggggagacacugggagagaaauggaagucccgccugaacgcucucggcaaaagcgaauuucagaucuauaagcggucugggauucaagagguugauagaacccuggccaaggaaggaaucaaacgcggcgagaccgaccaucacgcggugagccggggguccgccaaacuuagaugguucgucgaacgcaauauggugacacccgagggaaaaguuguggaucugggcugcggcagagggggauggucuuacuauuguggcgggcucaagaacguccgggaggugaaaggacugaccaagggcgggccgggacaugaggaaccuauccccaugagcacauacggcuggaaucuggugcgccuccaguccggcguugacgucuuuuucacgcccccugaaaaaugcgauacccuucugugugacauuggggagagcucccccaacccuacaaucgaagcuggacggacccugagagugcucaaucugguggagaacuggcuuaauaacaauacacaguucugcauuaagguccugaacccguauaugcccucuguuaucgagaagauggaaacccuccaacgcaaauacggcggggcccuggugcggaauccucugagcagaaacuccacgcacgagauguacugggugucuaaugcuaccggaaacauugucagcuccgugaauaugaucucucgcaugcucaucaacagauuuacaaugaagcacaaaaaggccaccuaugaacccgauguugaccuuggcagcgggacacggaacauuggaaucgaguccgaaauuccuaaucuggcgaucauuggcaaacgcaucgagaagauuaagcaggagcaugaaaccagcuggcacuacgaucaggaccaucccuauaaaacaugggccuaccacggcucuuaugagaccaagcagacgggguccgcuagcucuauggugaacggagucgugagacugcucacaaaaccgugggacguugugccuauggucacccaaauggccaugaccgauacaacgcccuucggccagcagcggguguuuaaggaaaaaguggacaccagaacacaggagccuaaggaggggaccaagaaacugaugcggaucacagcugaauggcuuuggaaggagcugggcaagaagaaaacaccccgcauguguacaagagaagaguucacccggaagguccgcuccaaugccgcucucggcgccaucuuuacggaugaaaacaaguggaaaagcgcgagagaggccguugaggacucucgguucugggaacugguggaucgcgagagaaaucugcaccucgaagggaagugcgagaccuguguguacaacaugaugggaaaacgggaaaagaaacugggcgaguuuggcaaggcuaaagggucccgcgccauuugguauauguggcuuggagcuagauuccuggaguuugaagcccucggcuuccugaaugaggaccauugguuuagccgggggaacucccuuagcggagucgaaggcgaggggcugcaccgccucggcuacauccugagagaugugucuaagaaggaaggaggcgccauguacgcggacgauacagcugggugggacacccggauuacacuggaggaucucaaaaaugaggaaaugguuaccaaccauaugaagggagagcacaaaaagcuggccgaagccguguucaaacuuacguaucaaaauaaggucgugcgcguucagagaccuacaccccggggcaccgugauggacaucauuagcagacgcgaccagcggggguccggacaggucggcacauacgggcugaacaccuuuacgaauauggaggcucaacucaucagacagauggagggcgaaggaaucuucaagucuauucagcaucugaccgccacagaggaaaucgcugugcaaaacuggcuugcccgcguuggccgggagagacugagccgcauggcgauuuccggggaugacugcguggucaaaccgcucgaugaccgguucgccucugcucugaccgcccugaaugauaugggaaaggugagaaaagacauccagcagugggaaccuagccgcggcuggaacgauuggacacagguccccuuuugcucccaccacuuccaugagcucgugaugaaggacgggcggguucuggugguccccuguagaaaccaagaugagcuuauuggacgcgcucggaucucucagggcgccggguggagccugaaagaaaccgcgugccucggcaaguccuaugcccagauguggacacugauguacuuucacagacgggaccuuagacuggcugccaaugcuaucuguagcgccgugccuucucauugggugccgaccucccgcacgacauggagcauucacgcuaagcacgaguggaugaccaccgaagauaugcucgccguuuggaaccggguguggauccaggagaaucccuggauggaagacaaaacaccugucgagucuugggaggaagugcccuaucugggaaagagagaggaucaauggugcggcucccugauugggcucaccagccgcgcgacaugggccaaaaacauccagacggcuauuaaucagguuagaucccugaucggaaacgaagaguacaccgacuauaugccuucuaugaagcgguuccgcagagaagaggaggaagccggcgugcuuugguga

SEQ ID NO: 19847 - RNA, 9876 nt, Artificial Sequence
  derived and/or modified CDS sequence (opt5) from DENV-2__KC294218__SS-prME
accgccggagugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugauccuuauucugcucacggccgucgcgccuagcaugaccaugcggugcaucggcauuuccaaccgcgauuucguggaagggguuucuggaggcagcuggguggacaucguccuggagcacggguccugugugacaaccauggccaagaauaagcccacacuugauuuugaacugaucaaaaccgaggcuaagcagccugccacgcucagaaaauauugcauugaagcuaagcugacaaacaccaccacagagagccgguguccgacccaaggagagcccucucugaaugaagaacaggacaaacgcuucaucugcaagcauuccaugguggauagaggcuggggcaacggguguggacucuuuggcaaagggggaauugucacaugcgccauguucacgugcaaaaagaauauggaaggcaaaaucguucagccugagaaccuggaauacaccauugugaucacaccccacagcggggaggagcaugcggugggaaaugacaccggcaagcacggcaaagaaaucaagauuacaccucagucuuccaccacggaggccgaacuuaccggguauggaacagucaccauggaguguagcccccggacaggccuggauuuuaacgaaauggugcuccugcaaauggaggacaaggcuuggcuuguucaccgccagugguuccuggaucucccgcugccuuggcugcccggggccgacacccagggaucuaauuggauccagaaggagacgcucgugacauuuaagaacccucaugcuaaaaagcaagacgucgugguucugggcucccaggaaggggccaugcacaccgcccuuacaggcgcuaccgagauucagaugagcuccggaaaucuccuguucaccggccaucugaaaugcagacuucggauggauaagcugcaacucaaagggaugucuuacagcauguguacaggaaaguuuaagaucgugaaagaaauugcggagacgcagcacggcaccaucgucaucagagugcaguaugagggggacggaucccccugcaagauucccuucgaaaucacagaucuggagaaacgccauguccugggccggcucauuaccgugaacccuaucguuacagaaaaggacagcccggugaacauugaggccgaacccccuuucggggauucuuacaucauugucggcguggagcccggacagcugaaacuuaauugguuuaagaagggcuccagcaucgggcaaauguucgagaccacgaugagaggagcuaaacgcauggccauccugggcgacacagccugggauuuugggucucucggaggcguuuucaccagcauugggaaggcucugcaccagguguuuggcgccaucuacggagcggcuuucuccggcgucucuuggaccaugaaaauucugaucggggugauuaucacauggaucggaaugaacagccgguccaccagccuuucugugucccucguucuggucggcguggugacacuguaucucggggccaugguccaggccgacagcggauguauugugucuuggaagaauaaagaacugaagugcggcuccgggaucuuuauuacggauaacguucacaccuggacagagcaguacaaguuccaaccugaaagccccuccaaacuugcuucugccauccagaaggcucaugaggaaggcauuuguggaaucagaagcgugacccgccuggagaaucucauguggaaacagaucacaccggagcugaaccacauucuguccgaaaaugaggucaaacuuaccaucaugacgggcgacauuaaagggaucaugcaggccggaaagcggucucucagaccucaacccaccgaacugaaauauagcuggaagacauggggcaaggcgaaaaugcuguccaccgagagccauaaccagacauuucucauugaugggccugaaaccgccgagugccccaauacaaaccgcgcuuggaacucucuggagguggaagacuacggauucggcguuuuuaccacgaacaucuggcuuaagcugcgggagaaacaggacguguucugugauuccaagcucaugagcgccgcuaucaaagacaauagagccguccacgcggauaugggcuauuggauugaaucugcccugaacgacacauggaagauggagaaggcuuccuuuaucgaggugaaaagcugccacuggccuaagucucauacccuguggagcaaugggguucuugaauccgagaugauuauccccaaaaacuucgccggaccggugagccagcacaacuaccgcccuggcuaucauacccaaacagcugggcccuggcaccucggaaagcuggaaauggauuucgacuuuugugagggcaccacggucguggugacagaagauugcgggaaucggggacccucucugagaaccacaaccgccuccggcaaacucauuacagaguggugcugucggagcugcacccugccuccgcuucgcuacagaggcgaggacggguguugguacggaauggaaauccggccccugaaggagaaggaagagaaccucgucaauucccugguuacggccggccaugggcagauugauaacuucucucugggagugcuuggcauggcucucuuucuggaagagaugcugagaacccgcguggggacaaaacacgcgauccuccuggucgcccuuagcuucgugacccugaucacaggaaauauguccuuucgggaccucggcagaguuauggugauggucggcgcuaccaugacggaugacauugggaugggagugacauaucuggcccugcuugccgcuuucaagguucgcccuaccuuugccgcgggccugcuccugagaaaacucacaucuaaggagcugaugauggcuaccaucgggauugcccuucugagccaguccacccuccccgaaacaauccuggagcugacggaugcccuugcucugggaaugauggcccucaaaauugugcggaacauggaaaaguaccaacuggcggucaccaucauggcuaucucuugcgugccuaaugccguuauucuccagaacgccuggaaggugagcuguacaauccuggcugccgucuccgugagcccccuucugcucaccucuucccagcagaaagcugacuggauuccucuggcccugacaaucaagggccuuaaucccaccgcgauuuuccugacgacacucagccgcaccucuaaaaagagauccuggccgcugaacgaggccaucauggcuguggggauggucagcauccucgccucuucccugcuuaaaaaugacauuccuaugaccggaccccugguugcuggcggccugcucacagugugcuaugugcugaccgggcggagcgccgaucuugaacuggagcgcgccgcugacgucaagugggaggaucaagcggaaaucuccggaagcucuccuauucucagcaucacaauuuccgaggacggcucuaugagcaucaaaaacgaagaggaggaacagacgcugaccauucucaucagaacagggcugcuugugaucuccggaguuuuucccgugucuauuccgaucaccgccgcugccugguaccugugggaggucaagaagcagcgggccggcgugcugugggauguuccuucucccccucccguggggaaagcugaacucgaggacggagccuaucgcauuaagcagagaggcauccugggcuacucccaaauuggggcgggagucuauaaagaaggcacauuccacaccauguggcaugugacgagaggggcuguccuuaugcaccgcggaaagagaaucgagcccuccugggccgaugugaaaaaggaccugaucagcuacggcgggggauggaagcucgagggcgaauggaaagagggcgaagagguucaggugcuggcccucgaaccugggaagaauccgcgggcuguccagaccaaacccggaauuuuuaagacaaacaccggcacaaucggggccgugucccuggauuucagcccuggaaccucuggcucccccauuguugacagaaaagggaagguggucggacuuuacggcaauggcguggugacacgcagcggggcguauguuucugcuaucgcccagacggagaaguccauugaggauaacccugaaaucgaggacgauaucuuucggaaaaagagacugaccauuauggaccugcaucccggagccggcaaaacaaagcgcuaccucccugcuaucguccgggaagccauuaaaagagggcugcgcacccuuauccuggcuccgacccgggugguggccgcggagauggaagaggcccucagaggacugcccauucgcuaucaaaccccugcuauccgggccgagcacacgggcagagaaauugucgaccucaugugucaugcuaccuucacaaugcggcugcuuagccccgugcgcguuccuaacuacaaucugaucaucauggaugaggcccacuucaccgaccccgccuccauugcugcgagaggguauaucucuacacggguggaaaugggcgaggccgcuggaauuuuuaugaccgccacgccgccuggcagccgcgaucccuucccccaguccaacgccccuaucauggacgaggaaagagagauucccgaacggagcuggaacucugggcacgagugggucacagauuuuaagggaaagaccgugugguucguuccuuccaucaaagcuggcaacgacaucgccgcgugccugagaaagaaugggaaaaaggugauucagcucagccgcaaaaccuuugauucugaauacgucaagacacgggcuaacgacugggauuucgugguuaccacagacaucagcgagaugggagccaauuuuaaggccgagagagugauugauccgcgccgguguaugaaacccgucauccugaccgacggcgaagagagagugauucuugcugggccuaugcccgugacgcauuccucugccgcgcaacgccggggcagaaucggacgcaacccuaagaaugaaaacgaccaguauaucuacaugggcgagccccuggaaaaugaugaggacugcgcccacuggaaagaggcuaagaugcuccuggauaacauuaauacaccggaagggaucauuccuagcauguucgagcccgaaagagagaaagucgacgccaucgauggagaauaccggcugcgcggcgaggcuagaaagaccuuuguugaccucaugcggcgcggggaucuuccuguguggcuggccuauaaaguggcugccgagggaauuaacuacgcggacagaaagugguguuucgauggcaucaagaauaaccagauucuggaagagaacgucgaaguggagaucuggacaaaagagggggaacggaagaaacucaagcccagauggcuggacgcccgcaucuauuccgauccucuugcucugaaagaguuuaaggaguucgccgcuggccggaagucucucacccugaaucugauuacggagaugggaagacuccccaccuucaugacacagaaagcccgcaacgcccuugacaaucuggcuguucugcauaccgcggaagugggcgggaaggccuacacacacgcucucagcgagcugccggagacccuugaaacacugcuccugcugacccuccuugccgccgucacgggaggcaucuuucuguuccugauguccgggaaaggaauuggcaagaugacacucggcaugugcugcaucauuaccgcuagcauccugcuuugguaugcccaaauccagccucacuggauugcggccucuaucauucuggaguuuuuccucaucgugcugcugauucccgaacccgagaaacagcggaccccucaggauaaccaacucacauacguugugaucgcuauccuuaccgucguggccgcuacaauggccaaugaaaugggguuucuggagaagacgaagaaagaccugggauucggcuccauuaccacacaggagagcgaauccaacauccucgacauugaucugagaccggcgucugccuggacccuuuaugcugucgccacaaccuuugugacgcccaugcugcggcauagcaucgaaaauagcucuguuaacgugagccucaccgcuauugccaaucaggcuacagugcugauggggcugggaaagggcuggccucucuccaaaauggacaucggggucccccuucuggccauuggauguuacagccagguuaacccuaucacccugacagcggcccuccugcuucugguggcucacuacgccaucauuggccccggccuccaagcuaaggccacccgcgaagcccagaaaagagcggcugccgggaucaugaagaauccuacgguggauggaauuacagucaucgaccuggagccgauucccuaugauccuaaguucgaaaaacagcugggccaggugaugcuccuuauccugugcguuacccaagugcugaugaugcggacaaccugggcucucugugaggcccugacccuugccacagggcccaucucuacgcugugggagggaaacccuggccgcuuuuggaauaccacaauugcugucuccauggccaacaucuucagagggagcuaccucgcgggagccggccugcuguuuucuauuaugaagaauaccacaaacacccggcgcggcacggggaaugugggagaaacacucggcgagaaauggaaguccagacuuaacgcucuggggaaaagcgaguuccagaucuauaagaaaucuggcauucaggaggucgaccggacccuggccaaggagggcaucaagcgcggggaaaccgaucaucacgcugugagcagaggauccgccaaacuccggugguuuguugagagaaacauggugacacccgaaggcaaggucguggaccugggcugcgggcgcggaggcuggucuuacuauugugggggacuuaaaaauguucgggaggugaagggccugaccaaagggggaccgggccaugaagaaccuauccccaugagcacauacggcuggaaccucgucagacugcaauccgggguggauguguucuucacgcccccugagaagugcgacacccugcucugugauauuggagaaagcucccccaauccuacaaucgaggcgggccgcacccuucggguucugaaccuggucgaaaauuggcucaacaauaacacacaguuuugcauuaaggugcugaauccguauaugcccucugugaucgagaaaauggaaacccuucagagaaaguacgggggagcccugguccgcaacccucucagcagaaauuccacgcacgagauguacuggguuucuaacgcuaccggcaauauugugagcuccgugaacaugaucucuagaaugcugaucaaucgcuucacaaugaaacacaagaaagccaccuaugagcccgacgucgaucuggggagcggaacacggaacauuggcaucgaauccgagauuccuaaccucgacaucgugggcaagagaauugaaaagaucaaacaggagcaugaaaccagcuggcacuacgaccaagaucaucccuauaagacaugggcuuaccacgggucuuaugagaccaaacagacgggauccgccagcucuaugguuaauggcgugguccgccuucugacaaagccgugggacgugguuccuauggugacccagauggcuaugaccgauacaacgcccuuugggcagcaacgggucuucaaagagaagguggacaccagaacacaggaaccuaaggagggaaccaaaaagcugaugaaaauuacagccgaauggcucuggaaggagcugggcaaagagaagacaccccgcauguguacaagagaagaguuuacccggaaagugcgcuccaacgcggcccuuggggcugucuucacggaugaaaauaaguggaaaagcgccagagaggcuguugaagacggacgguuuugggagcugguggauagagagcggaaccuccaccuggaaggcaaaugcgagaccuguguguacaauaugaugggcaagcgcgagaagaagcugggggaguucggaaaagccaagggcucuagagccaucugguauauguggcucggggcgcgguuucuggaguucgaggcucuuggauuucugaacgaggaccauugguucucccgcggcaauagccucuccggggucgaaggcgagggacugcacagacuuggcuacauccugcgggaaguggggaagaaagagggaggcgccauguacgccgaugacacagcugggugggauacccgcauuacacucgaagaccugaagaacgaggagaugguuaccaaucauaugaaaggagaacacaagaaacuggccgaggcuaucuuuaagcucacguaucagaacaagguggucagagugcagcggccuacaccccgcggcaccguuauggacauuaucagcagaaaagaucaacgggggucuggccaggugggaacauacggccugaauaccuucacgaacauggaagcccagcuuauucgccaaauggagggggagggaaucuucaagagcauccagcaucugaccgcgacagaagagauugccguccagaauuggcucgcuagagugggccgggaacgccuguccagaauggccaucucuggggacgauugcguugugaaaccgauugacgaucgguuugcuagcgcccuuaccgcgcugaacgacaugggaaaggucagaaaagauauccagcaaugggagccuucccgcggcuggaaugacuggacacaggugcccuucugcucucaccacuuucaugaacucgucaugaaggaugggcgggugcugguugugcccuguagaaaccaggacgagcugauuggccgcgcccggaucagccagggagcuggcuggucccucaaggagaccgccugccuggggaaaucuuaugcucaaauguggacacuuauguacuuccacagacgcgaucugcggcucgccgcuaacgccaucuguagcgcggucccuucccauugggugccgaccagcagaacgacauggucuauucacgccaagcacgaauggaugaccaccgaggacaugcuggugguuuggaaucgcguguggauccaggaaaaccccuggauggaggauaaaacaccugucgaauccugggaggaggugcccuaucuuggaaagcgggaagaccaguggugcggcagccugauugggcucaccucuagagcuacaugggccaaaaauauccagacggccauuaaccaaguucgcucccugaucggaaaugagggcuacaccgacuauaugccuagcaugaagcgguuuagacgggaagaggaagaggcuggggugcugugguga

SEQ ID NO: 19848 - RNA, 9876 nt, Artificial Sequence
  derived and/or modified CDS sequence (opt5) from DENV-2__KC294220__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgaugugaaaaaggaccuuaucagcuacggcgggggauggaagcuggagggcgaauggaaagagggcgaagagguucaggugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaguccaacgccccuaucauggacgaggaaagagagauucccgaacggagcuggaacucugggcacgagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcauuccucugccgcgcaacgccggggcagaaucggacgcaacccuaagaaugaaaacgaccaguauaucuacaugggcgagccccuugaaaaugaugaggacugcgcccacuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcaacgcccucgacaaucuugcuguucugcauaccgcggaagugggcgggaaggccuacacacacgcucugagcgagcucccggagacccuggaaacacuucugcuccugacccugcucgccgccgucacgggaggcaucuuccuuuuucugauguccgggaaaggaauuggcaagaugacacugggcaugugcugcaucauuaccgcuagcauccuccugugguaugcccaaauccagccucacuggauugcggccucuaucauucuugaguucuuucugaucgugcuccugauucccgaacccgagaaacagcggaccccucaggauaaccaacugacauacguugugaucgcuauccucaccgucguggccgcuacaauggccaaugaaaugggguuccuugagaagacgaagaaagaccugggauuuggcuccauuaccacacaggagagcgaauccaacauccuggacauugaucucagaccggcgucugccuggacccuguaugcugucgccacaaccuucgugacgcccaugcuucggcauagcaucgaaaauagcucuguuaacgugagccugaccgcuauugccaaucaggcuacagugcucauggggcugggaaagggcuggccucuguccaaaauggacaucggggucccccuccuugccauuggauguuacagccagguuaacccuaucacccugacagcggcccugcuccugcuuguggcucacuacgccaucauuggccccggccugcaagcuaaggccacccgcgaagcccagaaaagagcggcugccgggaucaugaagaauccuacgguggauggaauuacagucaucgaccucgagccgauucccuaugauccuaaguuugaaaaacagcugggccaggugaugcugcucauccuuugcguuacccaagugcugaugaugcggacaaccugggcucugugugaggcccucacccuggccacagggcccaucucuacgcuuugggagggaaacccuggccgcuucuggaauaccacaauugcugucuccauggccaacaucuuuagagggagcuaccuggcgggagccggccuccuguucucuauuaugaagaauaccacaaacacccggcgcggcacggggaaugugggagaaacacugggcgagaaauggaaguccagacucaacgcucuugggaaaagcgaauuucagaucuauaagaaaucuggcauucaggaggucgaccggacccuggccaaggagggcaucaagcgcggggaaaccgaucaucacgcugugagcagaggauccgccaaacugcggugguucguugagagaaacauggugacacccgaaggcaaggucguggaccucggcugcgggcgcggaggcuggucuuacuauugugggggacugaaaaauguucgggaggugaagggccuuaccaaagggggaccgggccaugaggagccuauccccaugagcacauacggcuggaaccuggucagacuccaauccgggguggauguguucuuuacgcccccugagaugugcgacacccugcugugugauauuggagaaagcucccccaauccuacaaucgaggcgggccgcacccuccggguucuuaaccuggucgaaaauuggcugaacaauaacacacaguucugcauuaaggugcucaauccguauaugcccucugugaucgagaagauggaaacccugcagagaaaauacgggggagcccuuguccgcaacccucugagcagaaauuccacgcacgagauguacuggguuucuaacgcuaccggcaauauugugagcuccgugaacaugaucucuagaaugcucaucaaucgcuuuacaaugaagcacaaaaaggccaccuaugagcccgacgucgaucuggggagcggaacacggaacauuggcaucgaauccgagauuccuaaccuggacaucgugggcaaaagaauugaaaagaucaagcaggagcaugaaaccagcuggcacuacgaccaagaucaucccuauaaaacaugggcuuaccacgggucuuaugagaccaagcagacgggauccgccagcucuaugguuaauggcgugguccgccuccuuacaaaaccgugggacgugguuccuauggugacccagauggcuaugaccgauacaacgcccuucgggcagcaacgggucuuuaaggagaaaguggacaccagaacacaggaaccuaaggagggaaccaagaaacugaugaagauuacagccgaauggcuguggaaagagcucggcaaggagaaaacaccccgcauguguacaagagaagaguucacccggaaggugcgcuccaacgcggcccugggggcugucuuuacggaugaaaauaaauggaaaagcgccagagaggcuguugaagacggacgguucugggagcuuguggauagagagcggaaccugcaccucgaaggcaagugcgagaccuguguguacaauaugaugggcaaacgcgaaaagaaacugggggaguuuggaaaggccaaaggcucuagagccaucugguauauguggcugggggcgcgguuccucgaauuugaggcucugggauuccuuaacgaggaccauugguuuucccgcggcaauagccuguccggggucgaaggcgagggacuccacagacugggcuacauccuucgggaaguggggaagaaggagggaggcgccauguacgccgaugacacagcugggugggauacccgcauuacacuggaagaccucaaaaacgaggagaugguuaccaaucauaugaagggagaacacaaaaagcuggccgaggcuaucuucaaacugacguaucagaacaagguggucagagugcagcggccuacaccccgcggcaccguuauggacauuaucagcagaaaggaucaacgggggucuggccaggugggaacauacggccucaauaccuucacgaacauggaagcccagcugauucgccaaauggagggggagggaaucuuuaaaagcauccagcaucuuaccgcgacagaagagauugccguccagaauuggcuggcuagagugggccgggaacgccucuccagaauggccaucucuggggacgauugcguugugaagccgauugacgaucgguucgcuagcgcccugaccgcgcuuaacgacaugggaaaagucagaaaggauauccagcaaugggagccuucccgcggcuggaaugacuggacacaggugcccuuuugcucucaccacuuccaugaacuggucaugaaagaugggcgggugcucguugugcccuguagaaaccaggacgagcugauuggccgcgcccggaucagccagggagcuggcuggucccugaaggagaccgccugccucgggaagucuuaugcucaaauguggacacugauguacuuucacagacgcgaucuucggcuggccgcuaacgccaucuguagcgcggucccuucccauugggugccgaccagcagaacgacauggucuauucacgccaaacacgaauggaugaccaccgaggacaugcucgugguuuggaaucgcguguggauccaggaaaaccccuggauggaggauaagacaccugucgaauccugggaggaggugcccuaucugggaaaacgggaagaccaguggugcggcagccuuauugggcugaccucuagagcuacaugggccaagaauauccagacggccauuaaccaaguucgcucccucaucggaaaugagggcuacaccgacuauaugccuagcaugaaacgguucagacgggaagaggaagaggcuggggugcugugguga

SEQ ID NO: 19849 - RNA, 9876 nt, Artificial Sequence
  derived and/or modified CDS sequence (opt5) from DENV-2__KC294221__SS-prME
acagccggagugaucgucaugcugauucccacagcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcggggcaaagaaaucaagauuacaccucagucuuccaccacggaggccgaacugaccggguauggaacagucaccauggaguguagcccccgcacaggccuugauuucaacgaaauggugcugcuccaaauggaggacaaggcuuggcugguucacagacagugguuucuugaucugccgcucccuuggcugcccggggccgacacccagggaucuaauuggauccagaaggagacgcuggugacauucaagaacccucacgcuaaaaagcaagacgucgugguucucggcucccaggaaggggccaugcauaccgcccugacaggcgcuaccgagauucagaugagcuccggaaaucuucuguuuaccggccaccucaaaugccggcugagaauggauaaacuucaacugaaagggaugucuuacagcauguguacaggaaaguucaagaucgugaaagaaauugcggagacgcagcauggcaccaucgucauccgcgugcaguaugagggggacggaucccccugcaagauucccuucgaaaucacagaucucgagaaacggcacguccugggcagacugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugcgcggagcuaaacggauggccauccuuggcgacacagccugggauuucgggucucugggaggcguuuuuaccagcauugggaaggcucuccaucagguguucggcgccaucuacggagcggcuuuuuccggcgucucuuggaccaugaaaauucugaucggggugauuaucacauggaucggaaugaacagcagauccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucacgaggaaggcauuuguggaauccgcagcgugacccggcuugagaaucugauguggaaacagaucacaccggagcucaaccauauucuguccgaaaaugaggucaagcugaccaucaugacgggcgacauuaaagggaucaugcaggccggaaagagaucucuucgcccucaacccaccgaacucaaauauagcuggaagacauggggcaaggcgaaaaugcuguccaccgagagccacaaccagacauuccugauugaugggccugaaaccgccgagugccccaauacaaaccgggcuuggaacucucucgagguggaagacuacggauuuggcguuuucuccaccaacaucuggcugaaacuuagagagaaacaggacguguuuugugauagcaagcugaugucugccgcuaucaaagacaaucgcgccguccaugcggauaugggcuauuggauugaauccgcccucaacgacacguggaagauggagaaggcuagcuucaucgaggugaaaucuugccacuggccuaagagccacacacugugguccaaugggguucuggaaagcgagaugauuauccccaaaaacuucgccggaccggugucucagcauaacuaccggccuggcuaucacacccaaaccgcugggcccuggcaucuuggaaagcucgaaauggauuuugacuucugugagggcacaaccgucguggugacggaagauugcgggaauagaggacccucccugcggacaaccacagccagcggcaaacugauuaccgaguggugcugucgcuccugcacacucccuccgcugagauaccggggcgaggacggguguugguacggaauggaaaucagaccccuuaaggagaaggaagagaaccuggucaauucucucguuaccgccggccacgggcagauugauaacuuuagccugggagugcugggcauggcucuuuuccucgaagagaugcugcgcacgcggguggggaccaaacaugcgauccugcucgucgcccuguccuuugugacacuuaucaccggaaauaugucuuucagagaccugggccgcguuauggugauggucggcgcuacaaugaccgaugacauugggaugggagugacguaucucgcccugcuggccgcuuuuaagguuagaccuacauucgccgcgggccuucugcuccggaaacugaccagcaaggagcucaugauggcuacaaucgggauugcccugcuuucccagucuacccugcccgaaaccauccucgagcugacagaugcccuggcucuuggaaugauggcccugaaaauugugcgcaacauggaaaaguaccaacucgcggucacgaucauggcuaucagcugcgugccuaaugccguuauucugcagaacgccuggaagguguccuguaccauccucgcugccgucagcgugucuccccugcuucugacauccagccagcagaaagcugacuggauuccucucgcccugaccaucaagggccugaaucccacagcgauuuuucuuaccacgcugucuagaacauccaaaaagcggagcuggccgcucaacgaggccaucauggcuguggggauggucucuauccuggccuccagccuccugaaaaaugacauuccuaugaccggaccccuuguugcuggcggccugcugaccgugugcuaugugcucacagggcgcuccgccgaucuggaacuugagagagccgcugacgucaagugggaggaucaagcggaaaucagcggaucuagcccuauucuguccaucaccauuucugaggacggcagcauguccaucaaaaacgaagaggaggaacagacacucacgauucugauccggaccgggcuccuggugaucucuggaguuuuccccgugagcauuccgaucacagccgcugccugguaccuuugggaggucaagaagcagcgcgccggcgugcugugggauguuccuucucccccucccguggggaaagcugaacuggaggacggagccuauagaauuaagcagcggggcauccucggcuacagccaaauuggggcgggagucuauaaagaaggcaccuuucacacaauguggcacgugacccgcggggcuguccugaugcauagaggaaagcggaucgagcccagcugggccgaugugaaaaaggaccuuaucuccuacggcgggggauggaagcuggagggcgaauggaaagagggcgaagagguucaggugcucgcccuggaaccugggaagaauccgagagcuguccagacgaaacccggaauuuucaagaccaacacaggcaccaucggggccgugagccucgauuuuucuccuggaacauccggcagccccauuguugaccgcaaagggaagguggucggacuguacggcaauggcguggugacccggucuggggcguauguuuccgcuaucgcccagacagaaaagagcauugaggauaacccugaaaucgaggacgauaucuuccgcaagaagcgccuuacgauuauggaccugcaccccggagccggcaaaaccaagcgguaccugccugcuaucgucagagaagccauuaaacgcgggcuccggacacugauccuugcuccgaccagagugguggccgcggagauggaagaggcccugcgcggacuccccauucgguaucaaaccccugcuaucagagccgagcauacaggccgggaaauugucgaccugaugugucacgcuacguucaccaugcgccuccugucccccgugagaguuccuaacuacaaucuuaucaucauggaugaggcccauuuuacagaccccgccucuauugcugcgcggggguauaucagcacccgcguggaaaugggcgaggccgcuggaauuuucaugacagccaccccgccuggcuccagagaucccuuuccccagagcaacgccccuaucauggacgaggaacgggagauucccgaaagaucuuggaacuccgggcacgagugggucacggauuucaagggaaagacagugugguuuguuccuagcaucaaagcuggcaacgacaucgccgcgugccugcgcaagaaugggaaaaaggugauucagcugucucggaaaaccuucgauagcgaauacgucaagaccagagcuaacgacugggauuuugugguuacaaccgacaucuccgagaugggagccaauuucaaggccgagcgcgugauugauccgcggagauguaugaaacccgucauccucacagacggcgaagaaagagugauucuggcugggccuaugcccgugacccacucuagcgccgcgcaacggagaggccgcaucggaagaaacccuaagaaugaaaacgaccaguauaucuacaugggcgagccccuugaaaaugaugaggacugcgcccauuggaaagaggcuaagaugcugcucgauaacauuaauacgccggaagggaucauuccuuccauguuugagcccgaacgggagaaagucgacgccaucgauggagaauaccgccugagaggcgaggcucggaagacauucguugaccugaugcgcagaggggaucucccuguguggcuugccuauaaaguggcugccgagggaauuaacuacgcggaccggaagugguguuuugauggcaucaagaauaaccagauucuggaagagaacgucgaaguggagaucuggaccaaagagggggaaagaaagaaacugaagccccgcuggcucgacgcccggaucuauucugauccucuggcucuuaaagaguucaaggaguucgccgcuggcagaaagagccugacacucaaucugauuaccgagaugggacgccugcccacguuuaugacccagaaagcccggaacgcccucgacaaucuugcuguucugcacacagcggaagugggcgggaaggccuacacccaugcucuguccgagcucccggagacacuggaaacccuucugcuccugacacugcucgccgccgucaccggaggcaucuuccuuuuucugaugagcgggaaaggaauuggcaagaugacgcugggcaugugcugcaucauuacagcuucuauccuccugugguaugcccaaauccagccucacuggauugcggccuccaucauucuugaguucuuucugaucgugcuccugauucccgaacccgagaaacagagaaccccucaggauaaccaacugaccuacguugugaucgcuauccucacagucguggccgcuaccauggccaaugaaaugggguuccuugagaagacaaagaaagaccugggauuuggcagcauuacgacccaggaguccgaaucuaacauccuggacauugaucuccggccggcgagcgccuggacacuguaugcugucgccaccacauucgugacccccaugcuucgccacuccaucgaaaauucuagcguuaacgugucccugacggcuauugccaaucaggcuaccgugcucauggggcugggaaagggcuggccucugagcaaaauggacaucggggucccccuccuugccauuggauguuacucucagguuaacccuaucacacugaccgcggcccugcuccugcuuguggcucauuacgccaucauuggccccggccugcaagcuaaggccacaagagaagcccagaaacgggcggcugccgggaucaugaagaauccuaccguggauggaauuacggucaucgaccucgagccgauucccuaugauccuaaguuugaaaaacagcugggccaggugaugcugcucauccuuugcguuacacaagugcugaugaugcgcaccacaugggcucugugugaggcccucacccuggccaccgggcccaucuccacacuuugggagggaaacccuggcagauucuggaauacgaccauugcugucagcauggccaacaucuuucgggggucuuaccuggcgggagccggccuccuguucuccauuaugaagaauacaaccaacacacgcagaggcaccgggaaugugggagaaacgcugggcgagaaauggaagucccggcucaacgcucuugggaaaucugaauuucagaucuauaagaaaagcggcauucaggaggucgaccgcacacuggccaaggagggcaucaagagaggggaaaccgaucaccaugcugugucccggggaucugccaaacugagaugguucguugagcgcaacauggugacccccgaaggcaaggucguggaccucggcugcgggcggggaggcuggagcuacuauugugggggacugaaaaauguuagagaggugaagggccuuacaaaagggggaccgggccacgaggagccuauccccauguccaccuacggcuggaaccugguccgccuccaaagcgggguggauguguucuuuacacccccugagaagugcgacacgcugcugugugauauuggagaauccucucccaauccuaccaucgaggcgggccggacacucagaguucuuaaccuggucgaaaauuggcugaacaauaacacccaguucugcauuaaggugcucaauccguauaugcccagcgugaucgagaaaauggaaacacugcagcgcaaguacgggggagcccuuguccggaacccucuguccagaaauucuacccaugagauguacuggguuagcaacgcuacgggcaauauuguguccucugugaacaugaucagccgcaugcucaucaaucgguuuaccaugaaacacaagaaagccacauaugagcccgacgucgaucugggguccggaaccagaaacauuggcaucgaaagcgagauuccuaaccuggacaucgugggcaagcgcauugaaaagaucaaacaggagcacgaaacaucuuggcauuacgaccaagaucaccccuauaagaccugggcuuaccauggguccuaugagacaaaacagaccggaagcgccucuuccaugguuaauggcgugguccggcuccuuacgaagccgugggacgugguuccuauggugacacagauggcuaugaccgauaccacacccuucgggcagcaaagagucuuuaaagagaagguggacacgcgcacccaggaaccuaaggagggaaccaagaagcugaugaaaauuaccgccgaauggcuguggaaggagcucggcaaagagaagacacccagaauguguacccgggaagaguucacacgcaaagugagaagcaacgcggcccugggggcugucuuuaccgaugaaaauaaguggaagucugcccgggaggcuguugaagacggaagauucugggagcuuguggaucgggagcgcaaccugcaccucgaaggcaaaugcgagacguguguguacaauaugaugggcaagagagagaaaaagcugggggaguuuggaaaagccaagggcucccgggccaucugguauauguggcugggggcgcgcuuccucgaauuugaggcucugggauuccuuaacgaggaccacugguuuagcagaggcaauucccugagcggggucgaaggcgagggacuccaucggcugggcuacauccuucgcgaaguggggaagaaagagggaggcgccauguacgccgaugacaccgcugggugggauacaagaauuacccuggaagaccucaagaacgaggagaugguuacaaaucacaugaaaggagaacauaagaaacuggccgaggcuaucuucaagcugaccuaucagaacaaggugguccgggugcagcgcccuacgcccagaggcacaguuauggacauuaucucucggaaagaucaacgcgggagcggccaggugggaaccuacggccucaauacauucaccaacauggaagcccagcugauuagacaaauggagggggagggaaucuuuaaguccauccagcaccuuacggcgaccgaagagauugccguccagaauuggcuggcucgggugggccgcgaaagacucucucggauggccaucagcggggacgauugcguugugaaaccgauugacgauagauucgcuuccgcccugacagcgcuuaacgacaugggaaagguccgcaaagauauccagcaaugggagccuucucggggcuggaaugacuggacccaggugcccuuuugcagccaucacuuccacgaacuggucaugaaggaugggagagugcucguugugcccugucgcaaccaggacgagcugauuggccgggccagaaucucccagggagcuggcuggucucugaaggagacagccugccucgggaaaagcuaugcucaaauguggacccugauguacuuucaucgccgggaucuuagacuggccgcuaacgccaucuguuccgcggucccuagccacugggugccgacaucucgcaccacgugguccauucaugccaagcacgaauggaugacaaccgaggacaugcucgugguuuggaaucggguguggauccaggaaaaccccuggauggaggauaaaaccccugucgaaagcugggaggaggugcccuaucugggaaagagagaagaccaguggugcggcucucuuauugggcugacaucccgcgcuaccugggccaaaaauauccagacagccauuaaccaaguucggagccucaucggaaaugagggcuacacggacuauaugccuuccaugaagagauuccggagagaagaggaagaggcuggggugcugugguga

SEQ ID NO: 19850 - RNA, 9876 nt, Artificial Sequence
  derived and/or modified CDS sequence (opt5) from DENV-2__KC294223__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgaugugaaaaaggaccuuaucagcuacggcgggggauggaagcuggagggcgaauggaaagagggcgaagagguucaggugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaguccaacgccccuaucauggacgaggaaagagagauucccgaacggagcuggaacucugggcacgagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcauuccucugccgcgcaacgccggggcagaaucggacgcaacccuaagaaugaaaacgaccaguauaucuacaugggcgagccccuugaaaaugaugaggacugcgcccacuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcaacgcccucgacaaucuugcuguucugcauaccgcggaagugggcgggaaggccuacacacacgcucugagcgagcucccggagacccuggaaacacuucugcuccugacccugcucgccgccgucacgggaggcaucuuccuuuuucugauguccgggaaaggaauuggcaagaugacacugggcaugugcugcaucauuaccgcuagcauccuccugugguaugcccaaauccagccucacuggauugcggccucuaucauucuugaguucuuucugaucgugcuccugauucccgaacccgagaaacagcggaccccucaggauaaccaacugacauacguugugaucgcuauccucaccgucguggccgcuacaauggccaaugaaaugggguuccuugagaagacgaagaaagaccugggauuuggcuccauuaccacacaggagagcgaauccaacauccuggacauugaucucagaccggcgucugccuggacccuguaugcugucgccacaaccuucgugacgcccaugcuucggcauagcaucgaaaauagcucuguuaacgugagccugaccgcuauugccaaucaggcuacagugcucauggggcugggaaagggcuggccucuguccaaaauggacaucggggucccccuccuugccauuggauguuacagccagguuaacccuaucacccugacagcggcccugcuccugcuuguggcucacuacgccaucauuggccccggccugcaagcuaaggccacccgcgaagcccagaaaagagcggcugccgggaucaugaagaauccuacgguggauggaauuacagucaucgaccucgagccgauucccuaugauccuaaguuugaaaaacagcugggccaggugaugcugcucauccuuugcguuacccaagugcugaugaugcggacaaccugggcucugugugaggcccucacccuggccacagggcccaucucuacgcuuugggagggaaacccuggccgcuucuggaauaccacaauugcugucuccauggccaacaucuuuagagggagcuaccuggcgggagccggccuccuguucucuauuaugaagaauaccacaaacacccggcgcggcacggggaaugugggagaaacacugggcgagaaauggaaguccagacucaacgcucuugggaaaagcgaauuucagaucuauaagaaaucuggcauucaggaggucgaccggacccuggccaaggagggcaucaagcgcggggaaaccgaucaucacgcugugagcagaggauccgccaaacugcggugguucguugagagaaacauggugacacccgaaggcaaggucguggaccucggcugcgggcgcggaggcuggucuuacuauugugggggacugaaaaauguucgggaggugaagggccuuaccaaagggggaccgggccaugaggaaccuauccccaugagcacauacggcuggaaccuggucagacuccaauccgggguggauguguucuuuacgcccccugagaagugcgacacccugcugugugauauuggagaaagcucccccaauccuacaaucgaggcgggccgcacccuccggguucuuaaccuggucgaaaauuggcugaacaauaacacacaguucugcauuaaggugcucaauccguauaugcccucugugaucgagaaaauggaaacccugcagagaaaguacgggggagcccuuguccgcaacccucugagcagaaauuccacgcacgagauguacuggguuucuaacgcuaccggcaauauugugagcuccgugaacaugaucucuagaaugcucaucaaucgcuuuacaaugaaacacaagaaagccaccuaugagcccgacgucgaucuggggagcggaacacggaacauuggcaucgaauccgagauuccuaaccuggacaucgugggcaagagaauugaaaagaucaaacaggagcaugaaaccagcuggcacuacgaccaagaucaucccuauaagacaugggcuuaccacgggucuuaugagaccaaacagacgggauccgccagcucuaugguuaauggcgugguccgccuccuuacaaagccgugggacgugguuccuauggugacccagauggcuaugaccgauacaacgcccuucgggcagcaacgggucuuuaaagagaagguggacaccagaacacaggaaccuaaggagggaaccaaaaagcugaugaaaauuacagccgaauggcuguggaaggagcucggcaaagagaagacaccccgcauguguacaagagaagaguucacccggaaagugcgcuccaacgcggcccugggggcugucuuuacggaugaaaauaaguggaaaagcgccagagaggcuguugaagacggacgguucugggagcuuguggauagagagcggaaccugcaccucgaaggcaaaugcgagaccuguguguacaauaugaugggcaagcgcgagaagaagcugggggaguuuggaaaagccaagggcucuagagccaucugguauauguggcugggggcgcgguuccucgaauuugaggcucugggauuccuuaacgaggaccauugguuuucccgcggcaauagccuguccggggucgaaggcgagggacuccacagacugggcuacauccuucgggaaguggggaagaaagagggaggcgccauguacgccgaugacacagcugggugggauacccgcauuacacuggaagaccucaagaacgaggagaugguuaccaaucauaugaaaggagaacacaagaaacuggccgaggcuaucuucaagcugacguaucagaacaagguggucagagugcagcggccuacaccccgcggcaccguuauggacauuaucagcagaaaagaucaacgggggucuggccaggugggaacauacggccucaauaccuucacgaacauggaagcccagcugauucgccaaauggagggggagggaaucuuuaagagcauccagcaucuuaccgcgacagaagagauugccguccagaauuggcuggcuagagugggccgggaacgccucuccagaauggccaucucuggggacgauugcguugugaaaccgauugacgaucgguucgcuagcgcccugaccgcgcuuaacgacaugggaaaggucagaaaagauauccagcaaugggagccuucccgcggcuggaaugacuggacacaggugcccuuuugcucucaccacuuccaugaacuggucaugaaggaugggcgggugcucguugugcccuguagaaaccaggacgagcugauuggccgcgcccggaucagccagggagcuggcuggucccugaaggagaccgccugccucgggaaaucuuaugcucaaauguggacacugauguacuuucacagacgcgaucuucggcuggccgcuaacgccaucuguagcgcggucccuucccauugggugccgaccagcagaacgacauggucuauucacgccaagcacgaauggaugaccaccgaggacaugcucgugguuuggaaucgcguguggauccaggaaaaccccuggauggaggauaaaacaccugucgaauccugggaggaggugcccuaucugggaaagcgggaagaccaguggugcggcagccuuauugggcugaccucuagagcuacaugggccaaaaauauccagacggccauuaaccaaguucgcucccucaucggaaaugagggcuacaccgacuauaugccuagcaugaagcgguucagacgggaagaggaagaggcuggggugcugugguga

SEQ ID NO: 19851 - RNA, 9876 nt, Artificial Sequence
  derived and/or modified CDS sequence (opt5) from DENV-2__FJ906959__SS-prME
accgccggcaugaucauuaugcugauccccacagugauggcuuuccaccucacgaccagaaacggggagccucauaugauugucagccggcaggaaaagggaaaaucccugcuuuuuaagacagaggacggcguuaauaugugcacccugauggccauggaucucggggaacugugugaggacacaaucaccuacaaaugcccguuccuuaagcaaaacgaacccgaggauauugacuguuggugcaauucuacaagcaccugggugacguauggaaccuguacaaccacaggcgagcaccgcagagaaaaacgguccguggcgcuggucccucauguggggaugggacucgagacccgcacggaaacauggaugucuagcgagggcgcuuggaagcacgcccagagaaucgagaccuggauccugcggcaucccggcuuuacaauuauggccgcuauccuggccuacaccauugggaccacacacuuccagcgcgcucucaucuuuauucugcuuacggccguugcgccuuccaugaccaugagaugcaucggaauuucuaaccgggauuucguggaaggcgucagcgggggauccuggguggacaucguucuggagcacggcagcugugugacaaccauggccaagaauaaacccacacucgauuuugaacugaucaagaccgaggcuaaacagccugccacgcuucgcaaguauugcauugaagcuaaacugacaaacaccaccacagacucuagauguccgacccaaggggagcccucccucaaugaggaacaggauaagcgguucgucugcaagcauagcaugguggaccgcggauggggcaacggcugugggcuguuuggaaaaggcgggaucgugacaugcgccauguucacgugcaagaaaaauaugaagggaaaagucguucagccugagaaccuggaauacaccauugugaucacaccccacucuggcgaggaacaugcgguggggaaugauaccggaaagcacggcaaagagauuaagaucacaccucaguccagcaucaccgaggccgaacucacgggcuaugggaccgucacaauggaguguucucccagaaccggacuggacuuuaacgaaauggugcuucugcaaauggagaauaaggcuuggcucguucaccggcagugguuccuggaucuuccgcugccuuggcuccccggcgccgacacacagggguccaacuggauucagaaagaaacccuggugacguuuaagaauccucaugcuaaaaagcaagacgucgugguucugggaagccaggagggcgccaugcacacagcccucaccggggcuacagagauccagauguccucuggcaaccugcuuuucaccggacaucugaaaugccgccucagaauggauaagcugcaacuuaagggcaugagcuacuccauguguaccgggaaauucaagguggucaaagaaauugcggagacacagcacggaacgaucgugauucggguccaguaugaaggcgacgggagccccugcaagauccccuuugagaucauggaucuggagaaaagacaugugcucggacgccugauuaccguuaacccuaucgugacagaaaaggacucuccggucaauauugaggccgaacccccuuucggcgauuccuacaucauuaucgggguggagcccggccagcugaagcucaacugguuuaaaaagggaagcucuauuggccaaaugaucgaaaccacaaugcggggggcuaaaagaauggccauccugggagacaccgccugggauuucggcagccuugggggaguuuuuacguccauuggcaaggcucugcaccagguguucggggccaucuacggcgcggcuuuuucuggagucagcuggauuaugaaaauccucauuggcgugaucaucacauggauugggaugaauucccgcagcaccucucuguccgugagccugguucuugucggaguggugacccucuaucugggcgucauggugcaggccgacucuggguguguuguguccuggaagaacaaggagcugaaaugcggaagcggcaucuucauuacagauaauguccacaccuggacagagcaguacaaguuucaaccugaaucccccucuaaacucgccagcgcuauccagaaggcccaugaggaagggauuuguggcauccgguccgugacgagacuggagaaccuuauguggaaacagaucaccccggaacugaaucacauucucucugagaacgagguuaagcugacaaucaugaccggagacauuaaaggcaucaugcaggcugggaagcgcagccugcaaccucagcccacagaacuuaaguauuccuggaaaaccuggggaaaggccaaaaugcucagcacggagucucauaaucagaccuuccugauugauggcccugaaacagcggagugccccaacaccaaucgggccuggaacucccuggaaguggaggacuacggguuuggagucuucacaaccaauaucuggcucaagcugagagagaaacaggacguguuuugugauagcaagcuuaugucugcugccaucaaggacaaccgcgcuguucacgccgauaugggcuauuggauugaauccgcgcugaaugacacauggaaaaucgagaaggccagcuucauugaagugaaaucuugccacuggccuaagagccauacccucugguccaacggcguccuggagagcgagaugaucauucccaaaaacuucgcugggccggugucucaacacaauuaccggccuggauaucauacgcagacagccggccccuggcaccuggggaagcuugaaauggauuuugacuucugugagggaaccaccguggucguuacagaagauugcggcaacagagggcccucccuccgcaccacgacagcuagcggaaagcugaucaccgaguggugcugucgguccugcacacugccuccgcucagauaccggggcgaagacggcuguugguacgggauggagauucgcccccugaaagagaaggaagagaaucuugugaacucucuggugaccgccggacauggccagaucgauaauuuuagccucgggguccugggaauggcccuguuccuugaagagaugcucagaacacgggugggcaccaaacacgcuauccugcugguugcgguguccuuugucacgcucauuaccgggaacaugucuuucagagaccugggacgcgugaugguuauggugggcgccacaaugaccgaugacaucggcaugggggucacauaucuugcucugcucgccgccuuuaaggugcggccuaccuucgcugccggacugcugcuuagaaaacugacgagcaaggaacucaugaugacaaccauuggcaucguucugcucucccaaucuacaauucccgagaccauccuggagcuuaccgaugcgcuggcucucgggaugauggugcugaagaugguccgcaaaauggaaaaguaccagcuggccgugacaaucauggccauucuuugcgugccuaaugcugucauccugcagaacgccuggaaaguuagcuguacgauucucgcggugguguccgucagcccccuguuucucaccucuucccagcaaaaggcugacuggaucccucuggcccuuacaauuaaaggacugaaucccaccgccaucuuccucacaacccugagcagaacgaacaagaaacggucuuggccgcugaaugaggcuaucauggccgugggcaugguuuccauucuugcuagcucucugcucaagaacgacaucccuaugacagggccccugguggccggaggccuccugaccgucugcuaugugcuuaccggccgcuccgcggaucuggaacuggagagagccgcugacguuaagugggaagaucaggccgagauuagcggguccagcccuauccucucuauuacaaucagcgaggacggauccaugucuauuaaaaaugaagaggaagagcagacccugacaauccuuauccggacgggccugcucgugauuagcgggcuguuucccgucuccaucccgauuaccgcugccgccugguaccucugggaggugaagaaacagcgcgcuggaguccugugggaugugccuucucccccucccguuggcaaggcggaacuugaggacggggccuauagaaucaaacaaaagggaauucugggcuacagccagaucggcgcugggguguauaaggaaggaacauuccacaccauguggcaugucacacggggcgccgugcugaugcacaaagggaagcgcaucgagcccuccugggccgauguuaaaaaggaccucauuucuuacggaggcggguggaaacuggaaggagaguggaaggagggcgaagaggugcagguccuugcucuggaaccuggcaagaacccgagagccgugcagaccaaacccgggcucuuuaagacgaaugcgggaaccaucggcgcugugagccuggauuucuccccugggacaagcggaucucccauuaucgacaaaaagggcaaaguugucgggcucuacggaaacggcguggugacccgguccggcgccuaugucagcgccauugcucaaacagagaagucuaucgaagauaacccugagaucgaggacgauauuuuccgcaagagaaaacugaccaucauggaccuucaucccggggccggaaagacaaaacgguaccugccugcgauugugagagaagcuaucaagcgcggccugcggacgcucauucuggccccgaccagaguuguggccgcugagauggaagaggcccuucgcgggcugcccauccgguaucagacaccugcuauuagagccgaacacaccggacgcgagaucgucgaccucaugugucaugcgaccuuuacaaugcggcugcucucccccgugagaguuccuaauuacaaccugaucauuauggaugaggcccacuucacggaccccgcuagcaucgccgcucgcggcuauauuuccacccggguggaaaugggggaggccgccggcaucuuuaugacagcuaccccgccuggaucuagagaucccuucccccagagcaaugcgccuauuauggacgaagagcgggagauccccgaacgcuccuggagcucuggccacgagugggucacagauuuuaaagggaagaccgugugguucguuccuuccaucaaggccggaaacgacauugcugccugccuuagaaaaaauggcaagaaagugauccaacugagccggaagacguuugauucugaauacgucaaaacacgcaccaacgacugggauuucguggugaccacagacauuagcgagaugggggccaauuuuaaggcugaaagagucaucgauccgcggagauguaugaaacccguuauucugaccgacggagaggagcgcgugauccucgccggcccuaugcccgugacacauuccucugcggcucagcggagagggcgcaucggccggaacccuaagaaugaaaacgaccaguauauuuacaugggagagccccuggaaaaugaugaggacugcgcccacuggaaggaagccaaaaugcuucuggauaacaucaauaccccggagggcauuaucccuagcauguucgagcccgaaagagagaaggucgacgcuauugauggggaauaccgccuccggggagaggccagaaaaacguuuguggaccugaugcgcagaggcgaucugccuguuuggcucgcguaucggguggccgcugaagggaucaacuacgccgaccgcagaugguguuucgauggaauuaagaauaaccagauccuugaggagaacgucgaaguggagaucuggacaaaagaaggcgagcggaagaagcugaaaccccgcuggcuggacgcuagaauuuauuccgauccucucgcccugaaggaguucaaagaauuugcugccgggcggaagucucuuacccugaaucucaucacagagaugggcagacugcccaccuucaugacgcaaaaagcgcgcgacgcccuggauaaccucgcuguucuucauaccgccgaagcuggaggccgggccuacaaucacgcccugagcgagcugccggaaacacucgagacccugcuucugcucacacugcuggcuaccgugacagggggaauuuuucucuuccuuauguccggcagagggaucggaaagaugacccugggcaugugcugcauuaucacggcgagcauccugcucugguaugcccagauucagccucacuggaucgcugccucuauuauccuggaguuuuuccuuauuguccugcucauccccgaacccgagaagcagcgcacaccucaagacaaccagcugaccuacguggucaucgccauucugaccgugguugcugccacaauggcgaaugaaaugggcuuucucgagaaaaccaagaaagaccuugggcugggauccaucacaacgcagcagccggaaagcaacauucuggauaucgaccuccggcccgccuccgcuuggacccuguaugccguggcuacaaccuucgugacaccuaugcuuagacauucuauugagaauagcuccgucaacguuucucugaccgccaucgcgaaucaagccacggugcucaugggccuggggaagggauggccccugagcaaaauggauauuggcgugccucuccuugcuaucggguguuacucccaggucaaccccaucacccugacagccgcucuguuucuccugguggcccacuacgcuauuaucggaccuggccuucaggccaaggcgacccgggaggcccagaagcgcgcugccgcuggcauuaugaaaaauccgacaguugacgggaucaccgugauugaucuggaccccaucccuuaugaucccaaguucgaaaaacaacucggacaggucaugcugcuggugcucugcgucacgcaggugcuuaugaugagaacaaccugggcccugugugaggcccugacacucgcgaccggcccuaucagcacccugugggaagggaaccccggacgguuuuggaauacaacgauugcuguuucuauggccaacaucuuccgcggcuccuaccuugcuggggccggacugcucuuuagcauuaugaagaauaccacaaacaccagacggggcacaggcaauaucggggagacccugggagaaaaauggaagucucgccugaacgcccucggcaaauccgaguuccaaauuuauaagaagagcgggauccaggagguggacagaacgcuugcuaaagaaggaaucaagcggggcgagacagaucaucacgccgucucucgcgggagcgcgaaacugagaugguucguggaacggaacaugguuaccccggagggaaagguggucgaccugggcugcggcagagggggaugguccuacuauuguggcgggcucaaaaaugugcgcgaggugaagggacugaccaagggcgggccuggacaugaagagcccauucccaugucuacauacggcuggaaccuuguucggcugcagagcggcgucgauguguuuuucaccccucccgaaaaaugcgacacacuccugugugauaucggggaguccagcccuaauccgacgguggaagccggaagaacccugcgcguccucaaccuuguugagaauuggcugaacaauaacacacaguuuugcauuaaggugcugaaucccuauaugccuuccgugaucgagaaaauggaagcucuccaacggaaguacggcggggcccuggucagaaacccccuuucucgcaauagcacccacgagauguacuggguguccaacgcuucuggaaauauuguuagcuccgugaacaugaucucucggaugcugaucaauagauucacaaugcgccacaaaaaggccaccuaugaaccugacgucgaccucggcagcgggacgcggaacauuggaaucgaguccgaaauucccaaccuggauaucauuggcaagagaaucgagaaaauuaagcaggagcaugaaaccagcuggcacuacgaccaggaucauccguauaaaacaugggcguaccacggcucuuaugagaccaagcagacaggguccgccagcucuauggugaauggaguugugcgccugcucaccaaaccuugggacgucgugcccauggugacacaaauggcuaugaccgauacgacaccuuuuggccagcagcgggucuucaaggaaaagguugacaccagaacccaggagcccaaagaagggacaaagaaacuuaugaagaucacggccgaguggcuguggaaagagcugggaaagaaaaagaccccucgcauguguacaagagaagaguuuacccggaaggugcgcuccaacgcugcccucggcgcuaucuucacagaugaaaauaaauggaagagcgccagagaggcgguggaggacucucgguuuugggaacuggucgauaaagagagaaaccuucaccuggaagggaagugcgagaccuguguguacaauaugaugggaaaacgggaaaagaagcucggcgaguucggcaaagccaaggggucccgcgcuauuugguauauguggcugggagccagauuucuggaguucgaagcucucggcuuucugaacgaggaccauugguucagccgggaaaauucccuuagcgggguugagggagaaggccugcacaaacucggguacauccugcgcgaugugucuaagaaagagggcggagccauguacgccgacgacacagcgggcugggauaccagaauuacgcuugaggaccugaagaacgaagagauggucaccaaucauauggaaggggagcacaagaaacucgcugaagccaucuucaagcugacauaucaaaacaaagugguucgggugcagcgccccaccccgagaggaacagucauggauauuaucagccggcgcgaccagagaggcuccgggcaagugggaaccuacggccugaauacguuuacaaacauggaggcccagcucauccggcagauggagggggaaggcguuuucaagucuauucagcaucugaccgugacagaggaaaucgcuguccaaaauuggcuugcccgcgugggaagagagcggcugagccgcauggcuauuuccggcgaugacugcgucgugaaaccucucgaugacagauuugccucugcgcugaccgcccuuaacgauauggggaagguucggaaggacauccagcagugggagcccagcagaggauggaaugauuggacgcaggugcccuucugcucccaccacuuucaugaacugauuaugaaagacggccgcguccucguggugccuugucggaaccaagaugagcugaucgggagagcucgcaucucucagggagccggcuggagccugcgggaaaccgcuugccucgggaaguccuaugcccagauguggagccugauguacuuccacagacgcgaccuucggcuggcggccaacgcuauuuguucugccguuccgucccauugggugcccacaagcagaaccacauggucuauccacgcuaaacacgaguggaugaccacagaagacaugcucaccgucuggaaucgcguguggauucaggagaacccuuggauggaggauaagacgcccguugaauccugggaggaaaucccuuaucugggcaaacgggaggaccaauggugcggaagccuuauuggccugacauccagagccaccugggcuaagaauauccagaccgccauuaaccaggugcgcucucucaucgggaaugaagaguacacagauuauaugcccagcaugaagcgguuuagacgggaggaagaggaagcgggaguccugugguga

SEQ ID NO: 19852 - RNA, 9876 nt, Artificial Sequence
  derived and/or modified CDS sequence (opt5) from DENV-2__KF360005__SS-prME
accgccggcgugaucauuaugagaauccccacagcuauggccuuccaccugacgacccggaacggggagccucauaugauugucagcaagcaggaaaaaggaaagucccuccuguuuaaaacagaggacggcguuaauaugugcacccuuauggcgauggaucugggggaacucugugaggacacaaucaccuacaacugcccgcugcuucgccaaaaugaacccgaggauauugacuguuggugcaacucuacaagcaccugggugacguauggaaccuguacagcuaccggcgagcacagacgggaaaagcgcuccguggcccuggucccucauguggggaugggacucgagacaagaaccgaaacguggaugucuagcgagggcgccuggaaacacgcucagcggaucgagacauggauccugcgccaucccggcuucaccauuauggccgcuauccuggccuacacaauugggaccaccuauuuucagagaguucucaucuucauucugcuuacagcgguggccccuuccaugacgaugcggugcaucggaauuucuaaucgcgauuuugucgaaggcgugagcgggggauccuggguugacaucgugcuggagcacggcagcugugucaccacaauggcuaagaacaagcccacccucgauuucgaacugaucaaaacagaggccaagcagccugcuacccuuagaaaauacugcauugaagccaagcugacgaauacaaccaccgcgucucgguguccgacacaaggggagcccucccucaacgaggaacaggacaaacgcuuugugugcaagcacagcauggugggaagaggcuggggcgauggguguggacuguucggcaaggggggaaucgucaccugcgccauguuuacaugcaaaaagaauauggagggcaaaauuguucagccugaaaaccuggaguauacgaucguggugaccccccauucuggggaagagaaugcugucggaaacgacacaggcaagcacggcaaagagauuaaggugaccccucaguccagcaucacagaagccgagcucaccggguacggaacgguuaccauggaauguucuccccggacaggccuggauuucaaugagauggugcuucugcaaauggaaaacaaagcuuggcucguccaucgccagugguuucuggaccuuccgcugccuuggcuccccggggccgauauccagggauccaauuggauucagaaggagacccuggugacauucaagaacccucacgccaaaaagcaagacguugugguccugggcagccaggagggggcucuccacaccgcgcugacgggcgccacagaaauccagauguccucuggaaaccuucuguuuaccggccaucucaaaugcagacugcggauggacaagcuucaacugaaagggaugagcuauuccauguguacaggaaaguucaagguggucaaagagauugcugaaacccagcacggcaccaucgugguuagaauucaguacgagggggauggaagccccugcaagauccccuucgagaucauggaccucgaaaaacgccaugugcugggccggcugauuacagucaauccuaucgugacggagaaggauucuccgguuaacauugaagccgagcccccuuuuggggacuccuacaucauuaucggcguggaacccggacagcucaaacugagcugguucaagaagggcucuagcauugggcaaauguuugagaccacaaugagaggagccaaacgcauggcuauccuuggcgauaccgccugggacuucgggucccugggaggcgucuuuacaucuaucgggaaggcgcuccaccagguguucggcgcuauuuauggagccgccuuuagcggcguguccuggaccaugaaaauccugauugggguugucaucacguggauuggaaugaauagccggucuacaucccugagcgugucucuugugcucgucggcgugguuacccuguaccugggggugaugguccaggcugauuccggaugugugguuagcuggagaaacaaggagcucaaaugcggcuccgggaucuucaucaccgacaaugugcauacauggaccgaacaguauaaguuucaaccugagucucccagcaagcuggccuccgcuauucagaaagcccacgaagagggcaucuguggaauucgcucugucacacggcuugaaaaccugauguggaagcagaucacgccggagcucaaucacauucugagcgagaacgaagugaaacuguccaucaugaccggcgauaucaaggggauuaugcaggcgggaaaaagaagccuucgcccucaacccacagagcucaaguacucuuggaaaaccuggggcaaggccaagaugcuguccacagaaccucauaaucagaccuuccugaucgacgggcccgagacggcugaaugcccuaacaccaaucgggccuggaacagccucgagguugaggauuauggauuuggcguguucacaaccaauauuuggcugaaacuuaaggaaagacaggacgucuuuugugacucuaaacugauguccgcugccaucaaggauaaccgcgcggugcacgccgacaugggcuacuggauugagagcgcucucaaugauacauggaaaaucgaaaaggccucuuucaucgaggugaagagcugccauuggcccaaaucccacacccuguggagcaacgggguccuggagucugaaaugauuaucccgaagaacuucgcuggaccuguuucccagcacaauuaucggcccggcuaccauacacaaaccgccgggcccuggcaccuuggaaaacucgagauggacuuugauuucugugaaggcacgacagugguggucaccgaggacugcgggaacagaggaccuagccugcggaccacaaccgccuccggcaagcugauuacggaauggugcugucgcucuugcacacucccgccccugagauaccggggcgaggauggguguugguauggaauggagaucagaccucuuaaagaaaaggaggaaaaucuggugaacagccucguuaccgcuggccaugggcagauugacaauuuuucccugggagugcugggcauggcgcuuuuccucgaggaaaugcugcgcacacgggucgggaccaagcacgccgugcugcucguugcugugucuuuuaugacacugaucaccggaaacaugagcuucagagaucuuggccgcgucauggugaugguuggcgccgccaugacggacgauauugggaugggagugaccuaccuggcucuccuggccgcguuuaaagucagacccacauucgcugccggccugcuucugcggaagcucaccuccaaagagcugaugaugacaaccaucgggaucgugcuccugucucagagcacgacaccugagaccauucuugaacugacagacgcccucgcucugggaaugaugauccugaagauugugcgcaauauggagaaauaucaacuugccgucaccaucauggcgauucugugcguucccaacgcugugauccuccagaaugccuggaagguguccuguaccauccuggccgcugucagcgugucuccucuccugcuuacauccagccagcagaaggccgauuggauuccccuggcucucacgaucaaaggccugaacccgaccgccauuuuucugacaacccuuucuagaacaaauaagaaacgguccuggccucugaacgaagcgaucauggccguugggauggugagcauucucgcuucuucccugcucaagaaugacauccccaugaccggaccucuggucgccggcggccuucugacggugugcuacguucugacagggcgcagcgcugaccucgagcuggaaagagccgccgaugugcggugggaggaccaagcugaggucuccggaagcucucccauccuuagcauuaccaucuccgaagauggcucuaugagcauuaaaaacgaggaagaggagcagacccugacaauccucauucgcaccgggcugcucgugaucuccggacuguucccggucucuauuccuaucacagcggccgcuugguaucuuugggaagugaagaaacagagagccggcguucugagcgccgugcccuccccuccccccgucgggaaggcugagcuggaagacggagccuaccggaucaagcagaaaggcauucucggcuauucucaaaucggggcgggaguguacaaggagggcacguuucauaccauguggcacguuacacgcggggcugugcugaugcacaaaggaaagagaauugaaccuagcugggccgauguccggaaagaccuuaucuccuacggcgggggaagaaagcuggagggcgaguggaaggaaggcgaggaagugcaggugcucgcccuggagccggggaaaaauccccgcgcuguucagaccaagccuggacucuucaaaacaaacaccggcacgauuggggccgucagccuggauuuuucucccggagcguccggcagcccuaucguggacaagaaagggaagguggucggacuuuauggcaacggcgugguuacccggucugggacauacguguccgcuaucgcccagaccgaaaagagcauugaggauaaucccgagaucgaagacgauauuuucagaaaaaagcgccugacaaucauggaccugcauccuggagccggcaaaaccaagcgguaucucccggcuauugucagagaggccaucaaacgcgggcugcggacacuuauccuggcucccacgagagugguugccgcggaaauggaggaagcccuccgcggacugccuauucgguaccaaacccccgcuaucagagccgagcacacaggccgggagauuguggaucucaugugucaugcuaccuucaccaugcgccugcuuuccccugucagagugcccaacuauaaucugaucauuauggacgaagcccacuuuacagacccggccucuaucgcugcgcggggguacauuagcacgcgcguugagaugggcgaagccgcuggaaucuucaugaccgccacaccucccggcuccagagaucccuuuccucagagcaacgcccccaucauggacgaggagcgggaaauuccugagagaucuuggaauuccgggcaugaaugggugaccgauuucaagggaaagacagucugguuugugccgagcaucaaagcuggcaacgacauugccgcgugccugcgcaagaaugggaaaaaggugauccagcucucucggaaaaccuucgauagcgaguauauuaagacgagaacaaacgacugggauuuugucguuaccaccgacaucuccgaaaugggagcuaauuucaaggccgagcgcgugaucgauccccggagauguaugaaaccugugauucugacagacggcgaggaacgcgucauccuugccgggcccaugccugugacccacucuagcgcugcccaacggagaggccgcauuggaagaaaccccaagaaugagaacgaucaguacaucuacaugggcgaaccgcuggagaaugacgaagacugcgcgcacuggaaagaggccaagaugcuccuggauaacauuaauacaccugaggggaucauccccuccauguuugaaccugagcgggaaaaaguugacgcuauugauggagaguaucgccugagaggcgaagcccggaagaccuucguggaccucaugcgcagaggggaucuucccgucuggcuggcuuaccggguggccgcugagggaaucaacuaugccgacagacgcugguguuuugauggcauuaaaaacaaucagauccuggaggaaaacguugagguggaaauuuggacgaaggagggggagcggaagaaacucaagccuagauggcuggacgcgcgcaucuacucugauccccuugcccugaaagaauucaaggaguucgcugccggccggaaaagccucacacugaaucugauuaccgaaaugggaagacucccgacauuuaugacccagaaggcucggaacgcccuugacaaucuggccguccugcauacggcugaggcgggcgggcgcgccuauaaccacgcucucuccgaacugccugagacccuugagacacugcuccugcugacccuccuugccacagugaccggaggcaucuuccuguuucugaugagcgggaagggaaucggcaaaaugacacucggcaugugcugcauuaucaccgccucuauucugcuuugguacgcucaaauccagccccauuggauugccgcguccaucauccuggaauucuuucucauuguccugcugauccccgagccugaaaagcagagaacgccgcaggauaaucaacucacauaugugguuauugccauccuuaccgugguggcugccaccauggcuaacgagaugggguuccuggaaaaaacaaagaaagacuuuggacugggcagcauugccacccagcagcccgaguccaauauccucgauaucgaccugcggccugcgucugccuggacacuuuacgcugucgccacgaccuucauuacacccaugcugcgccacagcaucgagaacuccucuguuaaugugagccucaccgcuauugccaaccaggcuacagugcugauggggcugggaaagggcuggccucucuccaagauggacaucggggucccccuucuggccauuggauguuacagccaagugaauccuaucacccugacggcggcccuccugcuucugguugcucacuaugccauuaucggcccgggccuccaggcuaaagccaccagagaagcccagaagcgggcggcugccgggaucaugaaaaaccccacagcugauggaauuaccgugaucgaccuggauccuauucccuacgacccuaaguuugagaaacagcugggccaagucaugcuccuugugcugugcgucacacaggugcugaugaugcgcaccacgugggcccucugugaagcccugacacuugcuaccgggcccaucucuacacugugggagggauccccgggcagauucuggaauaccaccauugccguuagcauggcgaacaucuuucgggggucuuaucucgccggagcuggccugcuguucuccaucaugaagaauacaacgaacacccgcagaggcacagggaacaccggagaaacacucggcgagaaguggaaaaaucggcuuaacagccuggggaagucugaguuucagauuuacaaaagaagcggaauccaagaaguggaucgcacccuggccaaggagggcauuaaacggggggaaacggaccaucacgcugucuccagaggaucugccaagcuccgcugguucguggagcggaaucugguuacaccugagggcaaaguggucgaucuuggcugcgggagaggaggcuggagcuauuacugugggggacugaagaacgugcgcgaagugcggggccucaccaaggggggacccggccaugaggaacccaucccuauguccaccuauggcuggaaucugguuagacugcagagcggggucgacguguucuuuacacccccugagaaaugcgauacccuccuuugugacauuggagaauccucuccgaaccccacaguggaggcgggccgcacgcugcggguccugaaucucguugagaacuggcugaauaacaauacccaguucugcaucaaggugcuuaacccuuacaugcccagcgugaucgaaaaaauggagacacugcagagaaaguacgggggagcccucguccgcaauccucugucccggaacucuacccacgaaauguauugggugagcaaugcuuccggcaacauuguuucuagcgugaacaugaucuccagaaugcugauuaaucgcuuuacaaugagacauaaaaaggccaccuacgagcccgaugucgaccucgggagcggaacgcggaacaucggcauugaaucugagaccccgaaucuugauaucaucggcaagcgcauugagaaaaucaagcaagaacacgagacauccuggcacuaugaccaggaccauccuuacaaaaccugggcuuaucacgggagcuacgaaacaaagcagaccggaucugccuccagcgugguuaacggcguggucagacugcugacaaaacccugggaugugauuccuauggugacccagauggcuaugacggacacaacccccuucgggcaacagcgggucuuuaaggagaagguugauaccagaacacaggaaccuaaagagggaacgaagaaacucaugaagaucaccgccgaguggcuguggaaagaacuuggcaagaagaaaacaccccggauguguacccgcgaggaauucgcgagaaaggugcggucuaaugccgcucugggggccauuuuuacagacgagaacaaauggaaguccgcucgcgaggccguggaagauagcagauucugggagcucgucgacaaagaacggaaucugcaucuggagggaaagugcgaaaccuguguguauaacaugaugggcaaacgcgagaagaagaucggcgaguuugggaaagccaagggauccagagcgguuugguacauguggcucggcgcucgguuccuggaauuugaggcccuuggguuccugaaugaagaucacugguuuagccgcgagaacucucucagcggaguggaaggcgaggggcugcacaaacuuggcuacauucugagagaggucuccaagaaagaaggaggcgccauguaugcugacgauacagccgggugggacacccggaucacgcucgaggaucugaagaaugaagagauggugaccaaccauauggaaggagagcacaagaaacuggcugaggccaucuucaagcucacauaccagaauaaaguugugcgcguccaaagaccgaccccucggggcacagugauggacauuaucucucgcagagaccagcggagcuccgggcagguuggaaccuauggccugaacacguucacaaauaugggggcgcaacuuauuagacagauggaaggcgagggaguguuuaagggcauccagcaucugaccgccacagaagaggucgcugugcaggauuggcucgcccgcgucgggcgggagagacugucucgcauggcuauuagcggagacgauugcgugguuaaaccccuugacgaucgguucgccuccgcgcugaccgcccucaacgacaugggcaaggugagaaaggauauccaacagugggaacccucucgcggguggaacgacuggacgcaggucccuuuuugcagccaccauuuccacgagcugaucaugaaagauggacgggugcuggugguuccguguagaaaucaggacgaacucauuggccgcgcucggaucucccaaggggccggcuggagccugagagagaccgcuugccuuggaaagucuuacgcccagauguggucccugauguauuuucaccgccggggccucagacuggcugccaacgcgauuuguagcgccgugcccucucauugggucccuacaucccggaccacauggagcauccacgcuagacaugaauggaugaccacagaggauaugcuuaccguguggaaucgcguuuggauucaggagaaccccuggauggaagacaaaacgccuguggaguccugggaagagauccccuaccuggggaagcggggagaucaguggugcggcucucucaucgggcugacaagcagagccaccugggcccgcaauauucaaaccgcuaucaacagaguccggucccugauuggaagcgaaggcuauacagacuacaugccuucuaugaaacgcuucagacgggaggaggacgaagccggggugcucugguga

SEQ ID NO: 19853 - RNA, 9876 nt, Artificial Sequence
  derived and/or modified CDS sequence (opt5) from DENV-2__KJ010185__SS-prME
accgccggagugaucauuaugcugauccccaccgcuauggccuuccaccucacgaccagaaauggggaaccucauaugauuguuagcaagcaggaaaaaggaaagucccugcuuuuuaaaaccgaagacggcguuaauaugugcacccugauggcgauggaucucggggaacugugugaagacacaaucaccuacaacugcccccuucugcggcaaaaugaacccgaggauauugacuguuggugcaacgcuacaucuaccugggugacguauggaaccuguacagccaccggcgagcaccgcagagaaaagcggagcguggcccucgucccucauguggggaugggacuggagacacgcaccgaaacguggauguccucugagggcgcuuggaaacacgcccagagaaucgagacauggauccugcggcaucccggcuucaccauuauggcugccauccucgcguacacaauugggaccaccuauuuucagcgcguucugaucuucauucuucugacagccguggcuccuagcaugacgaugagaugcaucggaauuuccaaucgggauuuugucgaaggcgugucugggggaagcuggguugacaucgugcucgagcacggcuccugugucaccacaauggccaagaacaagcccacccuggauuucgaacuuaucaaaacagaggcuaagcagccugccacccugcgcaaauacugcauugaagcgaagcucacgaauacaaccaccgccagcagauguccgacacaaggggagcccucucugaacgaggaacaggacaaacgguuugugugcaagcacuccaugguggaucgcggauggggcaauggcugugggcuguucggaaagggcgggaucguuaccugcgcuauguuuacaugcaaaaagaacauggagggaaaaauuguccagccugaaaaucucgaguauacgaucguggugacaccccauagcggcgaagagaacgccgucgggaaugacacaggaaagcacggcaaagagauuaaggugaccccucagucuuccaucacagaagcugagcugaccggcuacgggacgguuaccauggaauguagccccagaacaggacuugauuucaacgagauggugcugcuccaaauggaaaauaaagccuggcugguccaucggcagugguuucuugaccugccgcucccuuggcugcccggcgccgauauccaggggucuaacuggauucagaaggagacccuggugacauucaagaacccucacgcuaaaaagcaagacguugugguccucggaucccaggagggcgcgaugcacaccgcccugacgggggcuacagaaauccagaugagcuccggcaauccccuuuuuaccggacaucugaaaugccgccucagaauggacaagcugcaacuuaaaggcaugucuuauagcauguguacagggaaguucaagguggucaaagagauugccgaaacccagcacggaaccaucgugguucggauucaguacgagggcgaugggucccccugcaagaucccuuucgagaucauggaccuggagaagcggcaugugcucggacgccugauuacagucaacccgaucgugacggagaaggauagccccguuaauauugaagccgagccucccuuuggcgacucuuacaucauuaucgggguggaaccuggccagcugaaacucuccugguucaagaagggaagcucuauuggccaaauguuugagaccacaaugagaggggcuaaaagaauggccauccugggagauaccgcgugggacuucggcagccuugggggagucuuuacauccaucggcaaggcucugcaccagguguucggggccauuuauggcgccgcuuuuucuggagugagcuggaccaugaaaauccucauuggcguugucaucacguggauugggaugaacucccgcagcacaucucuguccgugagccuggugcuugucggagugguuacccucuaccugggcgugaugguccaggccgauucugggugugugguuuccuggaagaauaaagagcugaagugcggaagcggcaucuucuuuaccgacaacgugcauacauggaccgaacaguauaaguuccaacccgaguccccgucuaaacucgcuagcgccauccagaaggcgcacgaagaggggauuuguggcauccgguccauuacaagacuggauaaucuuauguggaaacagaucacgccugaacugaaccacauucucucugagaaugaggucaagcugagcaucaugaccggagacaucaaaggcauuaugcaggccgggaagcgcucccugcggccccaaccuacagaacuuaaauacagcuggaagaccuggggaaaggcuaaaaugcucucuacagagccccauaaccagaccuuucugaucgauggcccugaaacggcccagugccccaauaccaacagagcuuggaacucccuggagguggaagacuauggguucggaguuuuuacaaccaacauuuggcucaagcugaaagagcgccaggacguguucugugauagcaaacuuaugucugccgcgaucaaagacaaucgggccguccacgcugauaugggcuacuggauugaguccgcccugaacgacacauggaagaucgaaaaggcuagcuucaucgaggugaaaucuugccauuggcccaagagccacacccucugguccaacggcgugcuggaaagcgagaugauuaucccuaaaaauuuugccgggcccgucucucaacacaacuauagacccggauaccauacacagaccgccggcccuuggcaccuggggaaacuugagauggauuucgacuuuugugaaggaacgacaguuguggugaccgaggauugcggcaaucgcgggccgucccuccggaccacaaccgcuagcggaaaacugauuacggaauggugcuguagauccugcacacugcccccucuccgguaccgcggcgaggacggcuguugguaugggauggaaaucagaccccugaaggagaaggaggaaaaccuugucaauucucuggugaccgcgggacauggccagauugauaacuucagccucgggguucugggaauggcccuguuucuugaggaaaugcuccggacaagagugggcaccaaacacgcuguccugcugguggccguuuccuucaugacacucaucaccgggaauaugucuuuucgcgaccugggacgggugauggucauggugggcgccgcuaugacggaugacauuggcauggggguuaccuaccuugcccugcucgcggcuuucaaggugagaccuacauuugccgccggacugcugcuucgcaaacugaccagcaaggagcucaugaugacaaccaucggcaucguccugcucucccaaucuacgacacccgaaaccauucuggagcuuacagaugcucuggcccucgggaugaugauccugaaaauugugagaaacauggagaaguaucagcuggcggugaccaucauggcuauucuuugcgucccuaaugccguuauccugcagaacgccuggaaggugagcuguaccauccucgcugccguguccgucagcccccugcuccugacaucuucccagcaaaaagcugacuggauuccgcuugcccugacgaucaagggacucaauccuaccgcgauuuuccugacaacccugagccggacaaacaaaaagcgcucuuggccccuuaaugaagccaucauggcugugggcaugguuuccauucuggccagcucucuccugaaaaacgacaucccuaugaccgggccccucguggcuggaggccugcuuacggucugcuacgugcugacaggcagauccgccgaucuggagcucgaacgggccgcugacguucgcugggaggaucaggcggaaaucagcggguccagcccgauucugucuaucaccauuagcgaggacggauccaugucuaucaagaaugaggaagaggaacagacccuuacaauucugaucagaaccggccuccuggugauuagcgggcucuuuccugucuccauccccaucacagccgcugccugguaucugugggaggugaaaaagcagcgggccggaguccuuugggaugugccuucuccgcccccuguuggcaaggcugagcuggaagacggggccuaccgcauuaaacaaaagggaauccugggcuauagccagauuggcgcggggguguacaaagagggaacguuccauaccauguggcacgucacaagaggcgcugugcucaugcacaaggggaaacggaucgaaccguccugggccgauguucgcaaggaccugauuucuuacggaggcggguggaaacuugagggagaauggaaagagggcgaggaagugcagguccuggcccucgagcccggcaagaacccuagagcugugcagaccaaacccgggcuguuuaagacaaacaccggaacgaucggcgccgugagccucgauuucuccccugggaccagcggaucucccaucguugacaaaaagggcaaggucguggggcuguauggaaauggcguggucacacgguccggcaccuacgugagcgcgauugcucaaacagaaaaaucuaucgaggauaacccugaaauugaggacgauaucuucagaaagaaacgccuuaccauuauggaccugcauccgggggccggaaagacaaaacgguaucugcccgccaucguuagagaggcuaucaagcgcggccuccggacgcugauucuugccccuaccagaguggucgcugccgaaauggaggaagcgcugcgcgggcuccccauccgguaccagaccccugccauuagagcugagcacaccggacgcgaaaucguggaccugaugugucaugccaccuuuacaaugcggcuccugucccccguuagagugccgaauuauaaccuuauuaucauggaugaggcucacuucacggacccugccagcauugccgcucggggcuacaucuccacccgcgucgagaugggggaagcggccggcaucuuuaugacagcuacaccgcccggaucuagagauccuuucccccagagcaaugccccuauuauggacgaggaacgggagaucccggagcgcuccuggaacagcggccaugaaugggugacagauuuuaaggggaaaaccguuugguucgugcccucuauuaaggccggaaaugacaucgcugccugccugcgcaaaaacggcaagaaagucauucaacugucccggaagacguuugauagcgaguauaucaagacaagaaccaaugacugggauuucguggugaccacagacaucucugaaaugggggcgaacuuuaaagcugagcgcgucauugauccucggagauguaugaagcccguuauccucaccgacggagaagaaagagugauucuggccggcccuaugcccgugacacacagcuccgccgcucagcggagagggcgcaucggccggaauccgaaaaacgagaaugaccaguacauuuacaugggagaaccucuugagaacgaugaagacugcgcccacuggaaggaggcgaaaaugcugcucgauaauaucaacacccccgaaggcaucauuccuucuauguucgagcccgagagagaaaaggucgacgccaucgauggggaguaucgccugagaggagaagcucggaaaacguuuguggaccugaugcgcagaggcgaucucccuguuuggcuugccuaccggguggcugccgaggggauuaacuaugcugaccgcagaugguguuucgauggaaucaagaauaaccagauucuggaagagaaugucgagguggaaaucuggacaaaggagggcgaacggaaaaagcugaaacccagauggcucgacgcccgcauuuacagcgauccgcuggcgcuuaaggaguucaaagaguuugccgcugggcggaagucccugacccucaaccugaucacagaaaugggcagacugccuaccuucaugacgcaaaaggcccgcaaugcucucgacaaccuugccguucugcauaccgccgaggcuggaggccgggcguauaaucacgcccugucugaacuccccgagacacuggaaacccuucugcuccugacacugcucgcuaccgugacagggggaaucuuucuuuuccugaugagcggcaaagggauuggaaagaugacccugggcaugugcugcaucauuacggccuccauccuccugugguacgcccagauucagccccauuggaucgcugccagcaucauucuugaguuuuuccugaucguccuccugauuccugagccggaaaaacagagaacaccccaagauaaccagcugaccuauguggucaucgcgauucucaccgugguugccgcuacaauggccaaugagaugggcuuucuugaaaagaccaaaaaggacuucgggcugggaucuaucgcuacacagcagccugaguccaacauccuggacauugaucuccggcccgccagcgcguggacgcuguacgccguggcuaccacauuuaucaccccuaugcuucgccacuccauugaaaauucuagcgugaacgucucccugacagccaucgcuaaucaagccaccguucucaugggccuggggaagggauggccccugucuaaaauggacauuggcgugccucuccuugcuaucggguguuacagccaggugaacccgauuacgcugaccgccgcgcugcuccugcuugucgcccacuaugcuaucaucggacccggccugcaggccaaggcuuccagagaggcccagaaacgggccgcggcuggcauuaugaagaauccuacaguggaugggaucaccguuauugaccucgaucccaucccuuacgaccccaaauucgagaagcaacugggacaggugaugcugcucauucuuugcgucacacaggugcugaugaugcgcaccacgugggcccugugugaagcucucacacuggccaccggcccgaucagcacacuuugggaggggaacccuggaagauuuuggaauaccaccaucgccgucucuauggcuaacauuuuccggggcuccuaucuggccggggcgggacuccuguuuagcaucaugaagaacacaacgaauacccgcagaggcacaggcaacaccggggaaacacugggagagaaauggaagaaucgggugucucuccuuggcaaauccgaguuccaaauuuacaagcgcagcgggauccaggagguugauagaacccuggccaaagagggaauuaagcggggcgaaacggaccaucacgcugugucuagagggagcgccaaacugcgcugguucgucgagcggaaccucgugacacccgaaggaaagguuguggaucugggcugcggcagagggggaugguccuauuacuguggcgggcuuaagaauguccgcgaggugaaaggacugaccaagggcgggcccggacaugaggaaccuauccccaugucuaccuauggcuggaaccucgugcggcugcugacaggcgcugacgucuuuuucaccccuccggagaaaugcgauacacuccuuugugacaucggggaaagcucccccaauccuacggucgaggccggaagaacccugcgcgugcugaaccucguggaaaauuggcugaacaauaacacacaguuuugcauuaagguccuuaaucccuacaugccuagcguuaucgagaaaauggagacccugcagcggaaguacggcggggcgcucgugagaaacccccugucccgcaauucuacacacgaaauguauugggugagcaacgccuccggaaacauugucucuagcgugaauaugaucucccggaugcugauuaacagauucaccaugcgccauaagaaagcuacguacgauccggacguugaccucggcucugggacccggaauaucggaaucgagagcgaaacaccuaaccuugauauuaucggcaagagaauugagaaaaucaagcaagaacacgagaccucccgccacuaugaccaggaucaucccuacaaaacaugggccuaucacggcagcuacgagaccaagcagacagggucugcuuccagcaccgugaauggagucgugagacugcugacgaagccuugggacguuauucccauggugacacagauggccaugaccgauaccacaccuuuuggccaacagcgggucuucaaagaaaagguggacacgcgcacccaggagcccaaagaagggacaaagaaacucaugaagaucaccgcugaguggcuguggaaggaacuuggcaagaagaaaacaccgagaauguguacccgggaggaguuugccagaaaggugcggucuaacgcggcccugggcgcuauuuucacagaugaaaauaaauggaaguccgcccgcgaggcugucgaagacagcagauuuugggagcucguugauaaagagcggaaccugcaucuggaagggaagugcgagaccuguguguauaauaugaugggaaagcgcgagaagaagaucggcgaguucggcaaagccaaggggucuagagccaucugguacauguggcucggagcgcgguuucuggaguucgaggcucuuggcuuucugaacgaggaccacugguucucccgcgaaaauagccucuccgggguggagggagaaggccugcacaaacuuggguacauucugagagaggucagcaagaaggaaggcggagccauguaugccgaugacacggcuggcugggacacccggaucacacucgaggaucugaaaaacgaggaaauggugaccaaucauauggagggggaacacaagaaacuggccgaggcuauuuucaagcucacauaccagaacaaaguugugcgcguccaaagaccuacaccccggggaacggugauggacaucauuucucgcagagaucagcggggcagcguucagguggggacauauggacugggcaccuuuacaaauaugggggcccaacuuauccgccagauggaaggcgagggagucuucaagggcauccagcaucugaccgcgacggaggaaguggccguucaggacuggcucgcuagaguggggcgggagagacugucccgcauggccauuucuggagaugacugcgucgugaagccccuugaugaccgguuugcuagcgcccugaccgcgcucaacgauaugggcaaagucagaaaggacauccaacagugggaaccuucccgcggguggaacgauuggacacaggugccguucugcucucaccauuuucacgagcugauuaugaaagacggacggguucuggugguccccuguagaaaucaggaugagcucaucggccgcgcccggauuagccaaggggcuggcuggucccugagagaaaccgccugccuuggaaagucuuacgcucagauguggagccugauguauuuccaccgccgggaccucagacuggccgcuaacgccaucuguuccgcggugccuagccauugggugcccacaucucgcaccacaugguccauccacgccggccaugaguggaugaccacggaagacaugcuuacaguuuggaaucggguguggauucaggagaacccuuggauggaagauaaaacccccgucgagagcugggaggaaaucccuuaccuggggaagagagaggaccaguggugcggaucucucauuggccugaccucccgggcuacaugggccagaaauauccaaaccgccauuaaccaggugcgcagccugaucggguccgaagaguauacagauuacaugcccucuaugaagcgguuuggaagagaagaggaggaagcuggcguucucugguga

SEQ ID NO: 19854 - RNA, 9876 nt, Artificial Sequence
  derived and/or modified CDS sequence (opt5) from DENV-2__KJ010186__SS-prME
accgccggcgugaucauuaugcugauccccaccgcuauggccuuccaccugacgaccagaaauggggagccucauaugauugucagcaagcaggaaaaaggaaagucccugcuuuuuaaaaccgaggacggcguuaauaugugcacccugauggcgauggaucucggggaacugugugaggacacaaucaccuacaauugcccgcuucugcggcaaaaugaacccgaggauauugacuguuggugcaacgcuacaucuaccugggugacguauggaaccuguacagccaccggcgagcaccgccgggaaaagcggagcguggcccucgucccucauguggggaugggacuggagacacgcaccgaaacguggauguccucugagggcgcuuggaaacacgcccagagaaucgagacauggauccugcggcaucccggcuucaccauuauggcugccauccucgcguacacaauugggaccaccuauuuucagcgcguucugaucuucauucuucugacagccguggcuccuagcaugacgaugagaugcaucggaauuuccaaucgggauuuugucgaaggcgugucugggggaagcuggguugacaucgugcucgagcacggcuccugugucaccacaauggccaagaacaagcccacccuggauuucgaacuuaucaaaacagaggcuaagcagccugccacccugcgcaaauacugcauugaagcgagacucacgaauacaaccaccgccagccgguguccgacacaaggggagcccucucugaacgaggaacaggacaagcgcuuugugugcaaacacuccaugguggauagaggauggggcaauggcugugggcuguucggaaagggcgggaucgugacaugcgcuauguuuacaugcaagaaaaacauggagggaaagauuguucagccugaaaaucucgaguauacgaucguggugacaccccauagcggcgaagagaacgccgucgggaaugacacaggaaaacacggcaaggagauuaaagugaccccucagucuuccaucacagaagcugagcugaccggcuacgggacgguuaccauggaauguagcccccggacaggacuugauuucaacgagauggugcugcuccaaauggaaaauaaggccuggcugguccaucgccagugguuucuugaccugccgcucccuuggcugcccggcgccgauauccaggggucuaacuggauucagaaagagacccuggugacauucaagaagccucacgcuaaaaagcaagacguugugguccucggaucccaggagggcgcgaugcacaccgcccugacgggggcuacagaaauccagaugagcuccggcaaccuucuguuuaccggacaucucaaaugcagacugcggauggacaaacuucaacugaaaggcaugucuuauagcauguguacagggaaguucaagguggucaaagagauugccgaaacccagcacggaaccaucgugguuagagugcaguacgagggcgaugggucccccugcaagauucccuucgagaucauggaccucgaaaaacgccauguccugggacggcugaucacagugaauccuauuguuacggagaaggauagcccggugaacaucgaagccgagcccccuuuuggcgacucuuacauuaucauuggggucgaacccggccagcucaaacuguccugguucaagaagggaagcucuaucggccaaauguuugagaccacaaugagaggggcuaaacgcauggccauucuuggagauaccgcgugggacuucggcagccucggagggguguuuacauccaucggcaaggcucuccaccagguguucggggccaucuauggcgccgcuuuuucuggaguuagcuggaccaugaaaauucugaucggcgucgugauuacguggaucgggaugaacucccggagcacaucucuguccgugagccuuguccucgugggaguugugacccuguaccugggcgucauggugcaggccgauucuggguguguuguguccuggaagaacaccgcucucaaaugcggaagcggcauuuucaucacagacaauguccauaccuggacagagcaguauaaguuucaaccugaaucccccucuaagcuggccagcgcgauccagaaagcccacgaggaagggauuuguggcaucagauccgugacgcgccuugagaaccugauguggaagcagauuaccccggaacucaaucacauccugucugagaacgagguuaaacugagcauuaugacaggagauaucaagggcauccuucaggcugggaaacggucccucagaccucaacccaccgaacugaaguacagcuggaaaacauggggaaaggccaagaugcugucuaccgagucccauaaucagacguuccucauugacggcccugaaaccgcugagugccccaacacaaaucgcgccuggaacagccuggaaguggaggauuauggguuuggagucuucaccacaaauaucuggcuuaaacugaaggagcggcaggacguguuuugugacucuaaacucauguccgcggccauuaaggauaacagagcugugcacgccgacaugggcuacuggaucgaaagcgcucugaaugauaccuggaaaauugagaaggccucuuucaucgaagucaagagcugccauuggccuaaaucccacacacuguggagcaacggcguucuugagucugagaugaucauucccaagaacuucgccgggccggugucccagcacaauuaucgcccuggauaccauacccaaacggcuggccccuggcaccucgggaaacuggaaauggacuuugauuucugugagggaacaaccguggucgugaccgaagacugcggcaaccgggggcccagccugagaacaaccacggcguccggaaagcucaucacagaguggugcugucggucuugcacccugccuccgcuucgcuacagaggcgaagauggcuguugguaugggauggagauucggccccugaaagagaaggaagagaaucucguuaacagccuggugacagccggacauggccagaucgacaauuuuucccuggggguccuuggaauggcucucuuccuggaagagaugcugagaacccgcgugggcacaaagcacgccguucuccugguggccgucucuuuuaugacccuuauuacggggaacaugagcuuccgggaucugggaagagugaugguuauggugggcgcugccaugaccgacgauaucggcaugggggucacauaccucgcgcugcuggcugccuuuaaagugcgcccuaccuucgccgcuggacuucugcucagaaagcugacauccaaagaacucaugaugaccacgauuggcaucgugcugcuuucucagagcacaacccccgagacaauccuggagcucaccgacgcccuggcgcuggggaugaugauucuuaagaucguccggaauauggaaaaauaucaacuggcuguuaccauuauggccauccucugcgugccuaacgccgugauucugcagaaugcuuggaaggucuccuguacaauccucgccgcugugagcguuucuccccugcuucugacguccagccagcagaaggccgauuggaucccucucgcgcugaccauuaaaggacugaaccccacagccaucuuucuuaccacacugucucgcaccaauaagaaaagauccuggccgcucaacgaggcuauuauggccgugggcauggucagcauccuggcuucuucccuccugaagaaugacauuccuaugacggggccccuuguggccggaggccugcugacaguuugcuacgugcucaccggccggagcgccgaccuggaacuugagcgcgcugcggaugucagaugggaagaccaagccgagaucuccgggagcucuccuauccugagcauuaccaucuccgaggauggaucuaugagcauuaaaaacgaagaggaagaacagacacucaccauccugauucggacaggccuccuggugaucuccgggcuuuuccccgucucuauuccgaucacggcugccgccugguaucugugggaggugaagaaacagcgcgcuggaguucugugggacgugagaagcuacccucccgucggcaaggccgaacucgaggauggggcguaucggaucaagcagaaagggauucugggcuacucccaaaucggcgcugggguguacaaggaaggaaccuuucauacaauguggcacguuacccgcggcgccgugcuuaugcacaaagggaagagaauugagccuucuugggccgacguccggaaagaucugaucagcuauggaggcggguggaagcucgaaggagaguggaaggagggcgaagagguccaggugcuggcucucgaacccggcaaaaaucccagagccguucagacaaagccugggcuguucaaaaccaacacgggaaccauuggcgcggucucccuugacuuuagcccggggacaucuggaucccccaucguggauaagaaaggcaagguggucgggcuguacggaaacggcgugguuacccgcagcggcacauaugugucugcuaucgcccagaccgagaaguccauugaagacaauccugagaucgaggaugacauuuuccggaaaaagagacugacaaucauggaucuccaucccggggccggaaaaacgaagcgcuaccugccugcuauuguccgggaagccaucaaaagaggccuucgcacccugauccucgcucccacacgggugguugccgcggagauggaagaggcccugagagggcucccuauucgcuaucaaaccccggcuauccgggccgaacacaccggaagagagauuguggaccugaugugucaugcuacauucacgaugcggcuucugagccccguccgcgugccuaacuacaaucugaucauuauggacgaggcccacuuuaccgaucccgccuccaucgcugcgagaggcuauauuucuacacggguugaaaugggggaggccgcuggcaucuucaugaccgccacaccucccggaagccgcgacccguuuccucaguccaacgcccccaucauggaugaagagagagagauucccgaacggagcuggaacucuggccaugagugggugaccgacuucaaggggaagacggucugguuugugccuuccaucaaagcuggaaacgauauugccgcgugccucagaaagaauggcaaaaaggugauccagcugagccgcaaaacauucgacucugaauacauuaagacccggaccaacgauugggacuuugucguuacaaccgauaucagcgagaugggggcuaauuucaaggccgaaagagugaucgacccccgccgguguaugaaaccugugauucuuacagauggagaggagagagucauccuggccggcccgaugcccgugacccacuccucugcugcccaacgccgggggagaauuggccgcaacccuaagaaugaaaacgaccaguacaucuauaugggagagccccucgaaaaugacgaggauugcgcgcacuggaaagaagccaagaugcugcuggacaacauuaauacgccugagggcaucauccccagcauguuugagccggaaagagagaaaguugaugcuauugacggggaauaccggcuccgcggagaggccagaaagacauucguggaucuuaugcggcgcggcgaccugccugucuggcuggcuuauagaguggccgcugaagggaucaacuacgccgaucggagaugguguuuugacggaauuaaaaacaaucagauccucgaggagaacguugaaguggagauuuggaccaaggaaggcgagcgcaagaaacugaagccccgguggcuugaugcgagaaucuauuccgacccucuggcccucaaagaguucaaggaguucgcugccgggcgcaaaucucugacacugaaucucauuaccgagaugggccggcuucccacguuuaugacccagaaggcuagaaacgcccuggauaaucuggccguccuccauacagcugaagcgggaggccgggccuacaaccacgcucugagcgagcuuccugaaacccuggagacacuccugcugcucacccuucuggccacagugaccgggggaaucuuccuguuucucauguccggcaaggggaucggaaaaaugacgcugggcaugugcugcauuaucacagccagcauucuucugugguaugcucaaauccagccccauuggauugccgcgucuaucauccucgaguucuuucugauuguccugcucaucccggaaccugagaagcagcgcacaccccaggacaaucaacuuaccuacgugguuauugccauccugacagugguggcugccaccauggcuaacgaaaugggcuuccuggagaaaacaaagaaagauuuugggcucggauccauugccacgcagcagcccgaaagcaauauccuggacaucgaccuuagaccugcguccgccuggacccuguacgcugucgccacaaccuucauuacaccgaugcuccggcacucuaucgagaacagcuccguuaaugugucucugaccgcuauugccaaccaggcuacggugcugaugggccucgggaagggauggccccuuagcaagauggauaucggcgucccucugcuggccauuggguguuauucccaagugaaucccaucacccucacagcggcccugcuucugcucguugcucacuacgccauuaucggaccuggccugcaggcuaaagccacccgcgaggcccagaagagagcggcugccggcaucaugaaaaaccccacaguggacgggauuaccgucaucgaucuggacccuauuccguaugaucccaaguuugaaaaacagcucggacaagugaugcuucugguccugugcgugacgcagguucucaugaugcggacaaccugggcucugugugaggcccuuacacuggccaccggcccuaucagcacccucugggaagggaaucccggacgcuucuggaacacaacgauugcugugucuauggccaauaucuuuagaggcuccuaccuggcgggggccggacugcuguucagcaucaugaagaacaccacaaacacccggcgcggcacaggcaauaccggggagacgcuuggagaaaaguggaaaaacagacucaauucucugggcaaguccgaguuucagauuuauaaacggagcgggauccaagaggucgacagaacacucgcuaaggaaggaauuaaacgcggcgagaccgaucaucacgccgugucucgggggagcgcuaagcugagaugguucguugaacgcaaccuugugaccccugagggaaaagucguggaccugggcugcggcagagggggaugguccuacuauuguggcgggcucaagaaugugagagagguuaagggacugacaaaaggcgggcccggacaugaggaacccaucccuaugucuaccuacggcuggaaccugguccgccuccagagcggcguggauguguucuuuacaccgcccgaaaagugcgacacgcuucugugugauauuggggaguccagcccuaaucccaccgucgaagccggacggacacugagaguucucaaccugguggagaauuggcuuaacaauaacacccaguucugcaucaaagugcugaauccuuacaugccguccgucaucgagaagauggaaacacuccagcgcaaauauggcggggcgcuggugcggaacccccugucuagaaauagcacccacgagauguacuggguuuccaacgccucuggaaacauugugagcuccgucaauaugaucucucgcaugcucauuaaccgguuuacgaugagacauaagaaggcuaccuaugaaccugacguggaucuuggcagcgggacacgcaauaucggaauugaguccgaaacccccaaccuggacaucaucggcaaaagaauugagaagaucaaacaagagcacgaaacaagcuggcacuacgaccaggaucauccuuauaagaccugggccuaccacggcucuuaugagacaaaacagaccggguccgcuagcucuaugguuaauggagugguccggcugcucacgaagcccugggacgugauuccgauggugacacagauggccaugaccgauaccacaccuuucggccaacagcgcgucuuuaaggaaaaaguugacacgagaacccaggagcccaaggaagggaccaagaagcugaugaaaaucaccgcugaguggcuuuggaaggagcugggaaagaaaaagacaccucggauguguaccagagaagaguucgcccggaaagugcgcuccaacgcggcccucggcgcuauuuuuacagaugaaaauaaguggaaaagcgccagagaggcuguggaggacucucgguucugggaacuggucgauaaggagcgcaaccugcaucucgaagggaaaugcgagaccuguguguacaauaugaugggaaagagagaaaagaaaaucggcgaguuuggcaaggccaaagggucccgggccauuugguacauguggcugggagcgcgcuuccuugaguuugaagcucugggcuuccucaacgaggaccacugguuuagcagagaaaauucccugagcgggguugagggagaaggccuucacaagcugggguauauccuccgggaggugucuaaaaaggagggcggagccauguacgccgaugacacggcuggcugggauacccgcaucacacuggaagaccugaagaacgaggaaauggucaccaaucauauggagggggaacacaaaaagcucgccgaggcuauuuucaaacugacauaucagaacaaggugguuagagugcaacggcccaccccucgcggaacggucauggacaucauuagcagacgggaucagcgcggcuccggacaggugggaacauacggccuuaauaccuucacaaacaugggggcccaacugaucagacagauggagggcgaaggaguuuuuaaaggcauucagcaucucaccgcgacggaggaaguggccguccaggacuggcuggcucggguggggagagagcgccuuucucggauggccaucagcggagaugacugcgucgugaagccccuggaugacagauucgcuaacgcccucaccgcgcugaaugauaugggcaagguucgcaaagacauccaacagugggagccgucccggggguggaacgauuggacacaggugccuuuuugcucucaccauuuccacgaacugauuaugaaggacggaagaguccucguggugcccugucgcaaucaggaugagcugaucggccgggccagaauuagccaaggggcuggcuggucccuucgcgaaaccgccugccugggaaaaucuuaugcucagauguggagccucauguacuuucaccggagagaccugcgccuugccgcuaacgccaucuguuccgcgguucccagccauugggugccuacaucucggaccacaugguccauucacgccagacaugaguggaugaccacggaagauaugcugacagucuggaaucggguguggauccaggagaacccguggauggaggacaagacccccguugaaagcugggaggaaaucccuuaucucggcaaaagagaggaccaguggugcgggucucugauuggacugaccucccgcgcuacaugggcccggaauauccaaaccgccauuaaccaggugagaagccucaucggcuccgaagaguacacagauuacaugcccucuaugaagcgcuucagacgggaggaagaggaagcugggguccugugguga

SEQ ID NO: 19855 - RNA, 9876 nt, Artificial Sequence
  derived and/or modified CDS sequence (opt5) from DENV-2__KF955364__SS-prME
accgcuggagugaucauuaugcugauccccacagcuauggccuuccaccucacgaccagaaauggggaaccucauaugauugucggacggcaggaaaagggcaagagccugcuuuuuaagacagaagacgggguuaauaugugcacccugauggcgaucgaucucggagaacugugugaagacacaauuaccuacaaaugcccgcuucugcgccaaaacgaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaauggcgugaaacuuacaauuaugaccggggacaucaaaggaauuaugcaggcuggcaagcggucccucagaccucagcccacggagcugaaauauucuuggaagaccugggggaaggccaaaaugcugagcacagaaucccauaaccaaaccuuccucaucgauggaccugagacagcggaaugccccaauaccaaccgcgccuggaauagccuggagguugaggacuacggcuuuggcguguucucuacaaacaucuggcuuaagcugcgggaaaaacaggacguccucugugauuccaagcugaugagcgcugccauuaaagacaauagagcugugcacgccgauaugggguauuggaucgagucugcgcugaacgacaccuggaagauggaaaaggccuccuuuauugagaucaaaagcugccacuggccuaagucucauacgcuuuggagcaauggaguucucgaguccgaaaugauuauccccaaaaacuucgcuggcccggugagccagcacaacuaccgcccuggguaucauacacagaccgccggacccuggcaccugggcaagcuggagauggauuucgacuuuugugaagggaccacagucguggugaccgaggauugcggaaaucggggccccucucucagaacgacaaccgcuuccggcaaacugauuacagaauggugcugucggagcugcacccuuccuccgcugcgcuacagaggggaggacggauguugguacggcauggagauccggccccucaaggaaaaggaggaaaaccuggucaauucccugguuacagccgggcauggacaaaucgauaacuucucucuuggcgugcucgggauggcccuguuucuggaggaaaugcucagaacccgcgugggaacgaaauaugcuauucugcuugucgcggugagcuucguuacccugaucacaggcaauauguccuuucgggaccucggcagagugauggucauggugggggccaccaugacagaugacauuggaaugggcguuaccuaccuggcucugcuugccgccuucaaggugcgcccuacguuugcugccgggcugcuccugagaaaacucacaucuaaggagcugaugauggcgaccaucggaauugcccuucugagccaguccacaauccccgagaccauccucgaacugaccgaugcccuggcccuuggcaugaugguccugaaaauugugcggaacauggagaaguaucagcucgcuguuacaaucauggccauuucuugcgugccuaaugcggucauccugcaaaacgcuuggaaggugagcuguacgauucucgccgccguguccgucagcccccugcuucugaccucuucccagcagaaagcugacuggaucccucucgcccugacaaucaaggggcugaaucccaccgcuauuuuccuuacaacccugagccgcacgucuaaaaagagauccuggccgcucaacgaagccguuauggcggugggaauggugagcauccuggccucuucccuccugaaaaaugacauuccuaugacaggcccccuugucgcuggcgggcugcugaccgugugcuacguucucaccggacggagcgccgaucuggagcuugaacgcgcugccgacgugaagugggaggaucaggccgagaucuccggcagcucuccuauucugagcaucacaauuuccgaagacgggucuaugagcaucaaaaacgaggaagaggagcacacccucacaauccugauuagaacgggacuccuggucaucuccggcguguuucccguuucuauuccgaucaccgcugcggccugguaucuuugggaagugaagaagcaacgggcugggguccugugggaugugccuucucccccucccgucggaaaagccgagcuggaagacggcgccuaccgcauuaagcagagaggcaucuucggguauucccagaucggagcuggcguguacaaagaggggacauuucacaccauguggcauguuacacggggagccgugcucaugcaccgcggcaagagaauugaacccuccugggcggaugucaaaaaggaccugaucagcuacgggggaggcuggaaacuugagggcgaguggaaagaaggggaggaagugcagguucuggcucucgagccuggaaagaauccgcgggccgugcaaaccaaacccggccuguucaagacgaacaccgggacaauuggagccgucucccucgauuuuagcccuggcaccucugggucccccaucguggacagaaaaggaaaggugguuggccuguauggcaauggggucgugacacgcagcggagcuuacgugucugccauugcgcagaccgaaaaguccaucgaggauaacccugagaucgaagacgauauuuuccggaaaaagagacuuacaaucauggaccugcaucccggcgcugggaaaacgaagcgcuaucugccugccauuguccgggaggccaucaaaagaggacuccgcacccugauucuugcuccgacacgggugguugccgcugaaauggaggaagcccugagaggccuccccauccgcuaccagaccccugcgauucgggccgagcacaccgggagagagaucguggaccugaugugucaugcuacauucacgaugcggcuccugagccccguccgcgugccuaacuauaaucuuaucauuauggaugaagcccacuuuaccgaccccgcuuccaucgccgccagaggcuacauuucuacacggguugagaugggagaagcugcgggcaucuucaugaccgccacaccgccugggagccgcgaucccuuuccccaguccaacgcuccuauuauggacgaggagagagaaauccccgagcggagcuggaacucuggacacgaaugggugaccgauuucaagggcaagacggucugguuugugccuuccaucaaagccgggaacgacauugccgcuugccugagaaagaauggcaagaagguuauccaacugagccgcaaaacauucgauucugaguaugugaagacccgggccaacgacugggauuuugucgugaccacagacauuagcgaaaugggcgcgaauuucagagcugagcgcgugaucgauccgcggagauguaugaagcccgucauucucaccgacggggaggaacgcguuauccuggccggcccuaugcccgugacacauuccucugccgcucagcggagaggacgcaucggcagaaacccuaaaaaugagaacgaccaguacauuuacaugggggaaccccuugagaaugaugaagacugcgcccacuggaaggaggcgaaaaugcugcucgauaacaucaauaccccggagggaauuaucccuagcauguuugaacccgagcgggaaaagguggacgccauugauggcgaguaucgccugagaggggaagcucggaaaacguucgucgaccugaugcgcagaggagaucucccuguguggcuugccuaccggguugcugccgagggcaucaacuaugcugacagacgcugguguuuugaugggauuaagaauaaccaaauccuggaggaaaacguggaggucgaaaucuggacaaaagagggcgagcggaagaagcugaaacccagauggcucgacgcccgcauuuacuccgauccucuggcgcuuaaggaguucaaagaguucgccgcuggacggaagucucugacccucaaucugaucacagaaaugggcagacugcccaccuuuaugacgcagaaagcccgggacgcucucgauaaccuugccgugcugcauaccgccgagguugggggacgcgcuuauaaucacgcgcugagcgaacucccggagacacuggagacccuucugcuccugacacugcucgccaccgugacaggcgggauuuuccuuuuucugauguccggaaagggcaucggcaagaugacccuggggaugugcugcauuaucacggcuagcauccuccugugguacgcccagauucagccucacuggaucgccgcuucuauuauccuugaguucuuucugauuguccuccugauccccgagcccgaaaaacaaagaacaccucaggacaaccagcugaccuauguggucaucgccauucucaccgugguugcggccacaauggcuaaugagaugggauuccuugaaaagaccaaaaaggaccugggccugggguccaucacaacgcaggagagcgaguccaacauucucgauaucgaccugcggccggccucugcuuggacccuuuacgccguggcgacaaccuuugugacacccaugcugcgccauagcauugaaaauuccucugucaacguuagccucaccgccaucgcuaaucaagccacggugcugaugggacugggcagaggguggccucucuccaaaauggauauuggagugccccuucuggcuaucggcuguuacagccaggucaacccuaucacccugacagccgcucuccugcuucugguggcccacuaugcgauuaucggccccgggcuccaggccaaggcuacccgggaggcccagaagcgcacagcugccggaauuaugaaaaauccuaccguugacggcaucacggugauugaucuggaaccgauccccuacgacccuaaguucgagaaacaacuggggcaggucaugcuccuugugcugugcgucacacaggugcugaugaugagaaccacaugggcccucugugaagcgcugacccuugcuaccggacccaucucuacacugugggagggcaacccugggcgguuuuggaauacgaccauugccguuuccauggcuaacaucuuccgcggaagcuaucucgccggcgccggccugcuguuuucuauuaugaagaauacaaccaacacaagacgggggaccggaaauaucggcgagacgcucggggaaaaauggaaguccagacuuaacgcucugggaaagagcgaguuccagauuuacaaaaagucuggcauccaagaaguggaucgcacacuggccaaagaggggaucaagcggggagagaccgaccaucacgcggucagcagaggcuccgccaaacuccgcugguuuguggaacggaacaugguuacccccgagggcaagguggucgaucuggggugcggaagaggcggguggucuuauuacuguggaggccuuaaaaaugugcgcgaagugaaggggcugacaaagggaggcccgggccaugaggaaccuauucccaugagcaccuauggguggaaccucguucggcugcaguccggagucgacguguucuucacacccccugagaaaugcgauacgcugcucugugacaucggcgagagcucccccaauccuaccauugaagcugggagaacacuucgcgugcugaaccuggucgagaauuggcucaacaauaacacccaguuuugcguuaaggugcugaauccguacaugcccucugugaucgagaagauggagacacuucaacggaaguacggaggcgcccuggucagaaacccucucagccgcaauuccacccacgaaauguauugggugucuaacgcuacggggaauauuguuagcuccgugaacaugaucucucggaugcugaucaauagauucaccaugaaacacaagaaggccacauacgagcccgaugucgaccugggaagcggcacccgcaacauuggcaucgagaacgaaauuccuaaucucgacaucauugggaaaagaaucgagaagauuaaacaggaacaugagacauccuggcacuaugaucaggaccaucccuacaagaccugggcguaucacggaagcuacgaaacaaaacagaccggcucugccuccagcauggugaacgggguugugaaacuucugacgaagccgugggaugucgugccuauggugacacaaauggcuaugaccgacaccacacccuuuggacagcagcgggucuucaaagagaagguugauacgcgcacccaggagccuaaagaaggcacaaagaaacugaugagaaucaccgccgaguggcucuggaaggaacuggggaagaaaaagacaccccggauguguaccagagaggaguuuacacggaaagugcgcucuaaugcugcccuuggagcuaucuucaccgacgaaaacaaguggaaauccgccagagaggcgguggaagauagccgguuuugggagcuggucgaccgcgaaagaaaucuccaccuggagggcaagugcgagacguguguguauaacaugaugggcaaacgggaaaagaagcugggggaguucggaaaagccaagggcucucgcgcuauuugguacauguggcucggggccagauuucuggaguucgaggcucuuggauuucugaaugaagaucauugguucucccggggcaacagccucuccgggguugagggcgagggacugcacaaacuuggcuacauccugcgcgacgugagcaagaaagaagggggagccauguaugccgaugacaccgcgggcugggacacaagaauuacccucgaggaucugaagaaugaagagauggucacaaaccauaugaagggggaacacaaaaagcuggcugaggccaucuuuaaacucaccuaccaaaauaaggugguucgggugcagcgcccuacgcccagaggaacagucauggacauuaucucucggaaagaucagcgcggcagcggacaggugggcaccuauggacugaacacauucaccaauauggaggcccaacuuaucagacagauggaaggcgaggggauuuucaaguccauccagcggcugacgguuaccgaagagauugcugugcaaaacuggcucgccagagucggacgcgagcggcugucuagaauggcuaucagcggcgacgauugcguggucaagccgcuugacgaucgcuuugccuccgcgcugacagcccucaaugacauggggaaagugcggaaggauauucagcagugggaaccuucuagaggauggaacgacuggacccagguucccuucugcagccaucacuuucacgagcuggugaugaaagauggccgcguccugguggugcccugucggaaccaagacgaacucaucgggagagcucgcaucucccagggcgccggauggucucugaaggagacagcuugccuuggcaaaagcuacgcccagauguggacccugauguauuuccaucggagagaucuccgccuggcggccaaugcuauuuguuccgccguuccuagccacugggugccgacaucucggaccacgugguccauccaugcuaagcacgaauggaugacaaccgaggacaugcuugccgucuggaacagaguguggauucaggagaaucccuggauggaagacaagaccccuguugagagcugggaagaggugcccuaccuggggaaacgggaagaucaauggugcggaucucucaucggccugacauccagagcuaccugggccaagaacauucagacagcgaucaaucagguccgcagccugauugggaacgaggaguauacggacuacaugccuuccaugaaacgguuuagaaaggaagaggaagaggccggagugcucugguga

SEQ ID NO: 19856 - RNA, 9876 nt, Artificial Sequence
  derived and/or modified CDS sequence (opt5) from DENV-2__KF955372__SS-prME
accgccggagugaucauuaugcugauccccaccgcuauggccuuccaccucacgacccggaauggggagccucauaugauugugggacggcaggaaaagggcaagagccugcuuuuuaagacggaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggaguaugcggugggaaaugacaccggcaagcauggcaaagaaaucaagauuacaccucagucuuccaucaccgaggccgaacuuacgggguacggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucacgcuaaaaagcaggacgucgugguucugggcucccaagaaggggccaugcauacagcccuuaccggcgcuacagagauccagaugagcuccggaaaucugcucuuuaccggccaccugaaaugcagacuucggauggauaagcugcagcucaaagggaugucuuauagcauguguaccggaaaguucaagauugugaaagaaaucgcggagacacaacauggcacgaucgucauuagagugcaguacgagggggacggaucccccugcaagauccccuucgaaauuauggaucuggagaaacgccacguccugggccggcucaucaccgugaacccuauuguuacagaaaaggacagcccggugaacgucgaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaucaaguguucggcgccauuuauggagcggcuuuuuccggcgucucuuggacaaugaaaauccugauuggggugaucaucaccuggauuggaaugaacagccgguccaccagccuuucugugucccucguucuggucggcguggugacacuguaccucggggucauggugcaggccgacagcggauguguugugucuuggaagaauaaagaacugaagugcggcuccgggaucuucauuaccgauaacguccacacauggacggagcaguauaaguuucagccugaaagccccuccaaacuugccucugcuauccaaaaggcccacgaggaaggcauuuguggaaucagaagcgugacccgccuggagaaucucauguggaaacagaucacaccggagcugaaccauauucuguccgaaaaugagguuaaacuuaccaucaugacaggcgacauuaaagggaucaugcaggcuggaaagcggucucucagaccucagcccaccgaacugaaauacagcuggaagacguggggcaaggccaaaaugcuguccaccgagagccacaaccaaacauuccucauugaugggccugaaaccgcggagugccccaauacaaaccgcgccuggaacucucuggagguggaagacuauggauuuggcgucuucuccaccaacaucuggcuuaagcugcgggagaaacaggacguguuuugugauagcaagcucaugucugcugccaucaaagacaauagagcuguucaugccgauaugggcuacuggauugaauccgcgcugaacgacacauggaagauggagaaggccagcuucaucgaggugaaaucuugccacuggccuaagagccacacccugugguccaaugggguccuugaaagcgagaugauuauccccaaaaacuucgcuggaccggugucucagcauaacuaucgcccuggcuaccacacgcagacagccgggcccuggcaucucggaaagcuggaaauggauuuugacuucugugagggcaccaccguggucguuacagaagauugcgggaaucggggacccucccugagaaccacgacagcuagcggcaaacucauuaccgaguggugcugucgguccugcacacugccuccgcuucgcuacagaggcgaggacggguguugguauggaauggaaauccggccccugaaggagaaggaagagaaccucgucaauucucuggugaccgccggccacgggcaaauugauaacuuuagccugggaguccuuggcauggcccucuuccuggaagagaugcugagaacacgcguggggaccaaacaugcuauccuccugguugcgguguccuuugucacgcuuaucaccggaaauaugucuuuccgggaccugggcagagugaugguuauggugggcgccacaaugaccgaugacauugggaugggagucacauaccucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauucuggagcucaccgaugcccuggcccugggaaugaugguucuuaaaaucgugcggaacauggaaaaguaucagcuggcugucaccaucauggccauuagcugcgugccuaaugcggugauccuccaaaacgcuuggaaggucuccuguacaauucuggccgccguuagcgugucuccccuccugcuuacguccagccagcagaaagcugacuggaucccucuggcccucaccauuaagggccugaaucccacagcuaucuuucugaccacacuuucucgcaccuccaaaaagagaagcuggccgcugaacgaggccgugauggcggucgggauggugucuauccucgccuccagccugcucaaaaaugacauuccuaugacgggaccccugguugcuggcggccuucugacagugugcuacguccugaccgggcgguccgccgaucucgaacuggagcgcgcugccgacgugaagugggaggaucaggccgaaaucagcggaucuagcccuauucuuuccaucaccauuucugaggacggcagcauguccaucaaaaacgaagaggaggaacaaacacugaccauucucaucagaacagggcugcucguuaucucuggaguguuccccgucagcauuccgaucacggcugcggccugguaucugugggaggugaagaagcagcgggcuggcguccuuugggaugugccuucucccccucccguugggaaagccgaacuggaggacggagccuaccgcauuaagcagagaggcaucuuuggcuauagccagauuggggcuggaguguacaaagaaggcaccuuccacacaauguggcacgucaccagaggggccgugcugaugcaucgcggaaagagaaucgagcccagcugggcggauguuaaaaaggaccucaucuccuacggcgggggauggaagcuggagggcgaauggaaagagggcgaagaggugcaaguccuugcucuggaaccugggaagaauccgcgggccgugcagacaaaacccggacucuuuaagaccaacacgggcaccauuggggccgugagccuggauuucucuccuggaacauccggcagccccaucguugacagaaaagggaaggucgugggacucuauggcaauggcguggucacccgcucuggggcuuacguguccgccauugcgcagacagaaaagagcaucgaggauaacccugaaauugaggacgauaucuuccggaaaaagagacugaccaucauggaccuucaccccggagcuggcaaaacaaagcgcuaucugccugccauuguucgggaagccaucaaaagagggcugcgcacgcucauucuggcuccgacccggguggucgccgcugagauggaagaggcccuuagaggacugcccauccgcuaccagaccccugcgauucgggccgagcauaccggcagagaaaucguggaccucaugugucacgcuaccuuuacaaugcggcugcucucccccguucgcgugccuaacuauaaucugauuaucauggaugaggcccauuucacggaccccgcuucuaccgccgccagaggguacaucagcacacgggucgaaaugggcgaggcugcgggaauuuuuaugaccgccacaccgccuggcucccgcgaucccuucccccaaagcaacgcuccuaucauggacgaggaaagagagauucccgaacggucuuggaacuccgggcacgagugggugaccgauuuuaagggaaagacgguuugguucgugccuagcaucaaagccggcaacgacauugccgcuugccuuagaaagaaugggaaaaaggucauccagcugucucgcaaaacauuugauagcgaauaugugaagacccgggccaacgacugggauuucguggucaccacagacaucuccgagaugggagcgaauuuuagagcugagcgcguuauugauccgcggagauguaugaagcccgugauccugaccgacggcgaggaacgcgugauucucgccgggccuaugcccgucacacacucuagcgccgcucagcggagaggccgcaucggaagaaacccuaaaaaugaaaacgaccaauacauuuacaugggcgagccccuggaaaaugaugaggacugcgcccauuggaaggaggcgaaaaugcuucuggauaacaucaauaccccggaagggaucauuccuuccauguucgagcccgaacgggagaagguggacgccaucgauggagaauaucgccucagaggcgaggcucggaaaacguuuguugaccugaugcgcagaggggaucugccuguguggcucgccuaccgggucgcugccgagggaauuaacuaugcugacagacgcugguguuucgauggcaucaagaauaaccagauucuugaagagaacguggaaguugagaucuggacaaaagagggggaacggaagaagcugaaacccagauggcuggacgcccgcauuuacucugauccucucgcgcugaaggaguucaaagaauuugccgcuggccggaagucccuuacccugaaucucaucacagagaugggaagacugcccaccuucaugacgcagaaagcccgggacgcucuggauaaccucgccgugcuucacaccgccgaagucggcgggcgcgcuuauaaucaugcgcuguccgagcugccggagacacucgaaacccugcuucugcucacacugcuggccaccgugacaggaggcaucuuucucuuccuuaugagcgggaagggaauuggcaagaugacccugggcaugugcugcaucauuacggcuucuauccugcucugguacgcccagauucaaccucacuggaucgccgcuuccaucauucuggaguuuuuccuuaucguccugcucauucccgaacccgagaaacagagaacaccucaggacaaccagcugaccuaugugguuaucgccauucugaccgugguggcggccacaauggcuaaugaaaugggguuucucgagaagaccaaaaaggaccuuggacugggcagcaucacaacgcaagaguccgaaucuaacauccuggauauugaccuccggccggccagcgcuuggacccuguacgccgucgcgacaaccuucguuacacccaugcuucgccacuccaucgaaaauucuagcgugaacgugucccugaccgccauugcuaaucaggccacgguccucauggggcugggaagaggcuggccucugagcaaaauggauaucggggugccccuccuugcuauuggauguuacucucagguuaacccuaucacccugacagccgcucugcuccugcuuguggcccauuaugcgauuaucggccccggccugcaggccaaggcuacccgggaagcccaaaagcgcgcugccgccgggaucaugaaaaauccuacagucgacggaauuaccgugaucgaucucgagccgauucccuacgacccuaaguuugaaaaacagcugggccaggucaugcugcucgugcuuugcguuacacaggugcugaugaugagaacaaccugggcgcugugugaggcucucacacuggccaccgggcccaucuccacccuuugggagggaaacccuggccgguucuggaauacaacgauugcugucagcauggccaacaucuuucgcgggucuuaucuggccggagcuggccuccuguucuccaucaugaagaauaccacaaacaccagacggggcacagggaauauuggagaaacccugggcgagaaauggaaaagcagacucaacgcccuugggaagucugaauuucaaaucuacaaaaagagcggcauucaggagguggaucgcacgcuggcgaaagagggcaucaagagaggggaaacagaccaccaugccguuuccagaggaucugcuaaacugcgcugguucguggagcggaacauggucacccccgaaggcaaggugguggaucucggcugcgggagaggaggcuggagcuauuacugugggggacugaaaaauguucgcgaggucaagggccuuaccaaagggggaccgggccacgaggagccuauucccauguccacauauggcuggaaccuggugcggcuccagagcgggguggacgucuucuuuacacccccugagaaaugcgauacacugcugugugacaucggagaauccucucccaauccuacgaucgaggccggcagaacccuccgcguucuuaaccugguggaaaauuggcugaacaauaacacacaauucugcauuaaggugcucaauccguacaugcccagcgucaucgagaaaauggaaacccugcagcggaaguacgggggagcucuugugagaaacccucugucccgcaauucuacacaugagauguauuggguuagcaacgccaccggcaauauuguguccucugucaacaugaucagccggaugcucauuaauagauuuacgaugaaacacaagaaggcgaccuacgagcccgauguggaccugggguccggaacacgcaacaucggcaucgaaaacgagauuccuaaucuggacaucauuggcaaaagaaucgaaaagauuaaacaggagcacgaaaccagcuggcauuaugaucaggaccaccccuacaagacaugggccuaucaugggucuuacgagaccaaacaaacaggauccgcuagcucuaugguuaacggcgugguccggcuccuuaccaagccgugggauguggugccuauggucacgcagauggccaugacagacaccacccccuucgggcagcagcgcguuuuuaaggagaaaguggauacaagaacgcaagaaccuaaggagggaaccaaaaagcugaugcggaucacagcugaauggcuguggaaagagcucggcaagaagaaaacccccagaauguguacacgggaggaguucacccgcaaggugagauccaaugccgcucugggggccauuuuuacagacgagaacaaauggaaaagcgcgcgggaagccgucgaggauucucgcuucugggaacuuguggacagagagcggaaucugcaccucgagggaaaaugcgaaaccuguguuuauaacaugaugggcaagcgcgagaaaaagcugggcgaauuugggaaggcuaaaggauccagagccaucugguacauguggcugggcgcucgguuccucgaguuugaagcccugggguuccuuaaugaggaucacugguuuagccgcggaaacucccugagcggcguggagggggaaggccuccauaagcugggauacauccuuagagacgucucuaaaaaggagggcggggccauguaugcggaugacacggcuggaugggacacccggauuacacuggaagaucucaaaaaugaggaaauggugaccaaccacaugaagggcgagcauaagaaacuggccgaggccaucuucaagcugacauaccagaauaaaguugugcgcguccagagaccuacaccccgggggacggugauggacauuaucagccgcaaggaucagagaggauccggccaaguugggacauauggccucaacaccuucacaaauauggaagcucagcugauucggcagauggagggagaaggcaucuuuaaaucuauccaaagacuuaccgugacggaggagauugccguccagaacuggcuggcucgcguggggcgggaaagacucagccgcauggccaucuccggagacgauugcgucgugaagccgcuggacgaucgguucgcgucugcccuuaccgcucugaaugacaugggcaagguuagaaaagauauucagcagugggagccuagccgcggguggaacgacuggacacaagugcccuuuugcucccaccauuuccacgaacucgucaugaaggauggacgggugcuggugguucccuguagaaaccaggacgagcugaucggccgcgcccggauuucucagggggcuggcuggagccucaaagaaaccgccugccugggaaaguccuacgcgcagauguggacacuuauguauuuucacagacgcgaucugcggcucgccgcuaaugccaucuguagcgcugugccuucucauugggucccgaccuccagaacaaccuggagcauccacgccaaacaugaguggaugacgacagaggacaugcuggcuguguggaaccggguuuggauucaagaaaaucccuggauggaggacaagaccccuguggaaucuugggaggaaguccccuaccuuggcaagagagaggaucaguggugcgggucccugaucggacucaccagccgcgccacaugggcgaaaaacauucagaccgccaucaaucaggugcggucccugauuggcaacgaggaauauacagacuacaugccuucuaugaagagauuccgcaaagaggaagaggaagcugggguccugugguga

SEQ ID NO: 19857 - RNA, 9876 nt, Artificial Sequence
  derived and/or modified CDS sequence (opt5) from DENV-2__KF955373__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacacacacugaccauccucaucagaacagggcugcucgugauuucuggaguuuucccccugagcaucccgauuacggcugcggccugguaccuuugggaggugaagaagcaacgggcuggcguccugugggaugugccuucucccccucccgucgggaaagccgaacuggaggacggagccuaucgcaucaagcagagaggcauuuuuggcuacagccagaucggggcuggaguguauaaagaaggcaccuuccauacaauguggcacguuaccagaggggccgugcucaugcaucgcggaaagagaaucgagcccagcugggcggaugucaaaaaggaccugauuuccuacggcgggggauggaaacuugagggcgaauggaaagagggcgaagaggugcagguucuggcucucgaaccugggaagaauccgcgggccgugcaaacaaaacccggacuguuuaagaccaacacgggcaccaucggggccgucagccucgauuucucuccuggaacauccggcagccccauuguggacagaaaagggaaggugguuggacuguacggcaauggcgucgugacccgcucuggggcuuauguguccgccaucgcgcagacagaaaagagcauugaggauaacccugaaaucgaggacgauaucuuccggaaaaagagacuuaccauuauggaccugcaccccggagcuggcaaaacaaagcgcuaccugccugccaucguccgggaagccauuaaaagagggcuccgcacgcugauccuugcuccgacccgggugguugccgcugagauggaagaggcccugagaggacuccccauucgcuaucagaccccugcgauccgggccgagcauaccggcagagaaauuguggaccugaugugucacgcuaccuuuacaaugcggcuccugucccccguccgcgugccuaacuacaaucuuaucaucauggaugaggcccacuucacggaccccgcuucuauugccgccagaggguauaucagcacccggguugaaaugggcgaggcugcgggaauuuuuaugacagccaccccgccuggcucccgcgaucccuucccccagagcaacgcuccuaucauggacgaggaaagagagauucccgaacggucuuggaacuccgggcaugagugggugacagauuuuaagggaaagaccgucugguucgugccuagcaucaaagccggcaacgacaucgccgcuugccugagaaagaaugggaaaaagguuauucaacugucucgcaaaacguuugauagcgaauacgugaagacacgggccaacgacugggauuucgucgugaccaccgacaucuccgagaugggagcgaauuuuagagcugagcgcgugauugauccgcggagauguaugaagcccgucauccucacagacggcgaggaacgcguuauucuggccgggccuaugcccgugacccacucuagcgccgcucagcggagaggccgcaucggaagaaacccuaaaaaugaaaacgaccaguauaucuacaugggcgagccccuugaaaaugaugaggacugcgcccauuggaaggaggcgaaaaugcugcucgauaacauuaauacaccggaagggaucauuccuuccauguucgagcccgaacgggagaagguggacgccaucgauggagaauaccgccugagaggcgaggcucggaaaaccuuugucgaccugaugcgcagaggggaucucccuguguggcuugccuaucggguugcugccgagggaauuaacuacgcugacagacgcugguguuucgauggcaucaagaauaaccaaauucuggaagagaacguggaagucgagaucuggacgaaagagggggaacggaagaagcugaaacccagauggcucgacgcccgcaucuauucugauccucuggcgcuuaaggaguucaaagaauuugccgcuggccggaagucccugacacucaaucugauuaccgagaugggaagacugcccacauucaugacccagaaagcccgggacgcucucgauaaccuugccgugcugcacacggccgaaguuggcgggcgcgcuuacaaucacgcgcuguccgagcucccggagacccuggaaacacuucugcuccugacccugcucgccacagugaccggaggcaucuuucuuuuccugaugagcgggaagggaauuggcaagaugacacugggcaugugcugcaucauuaccgcuucuauccuccugugguaugcccagauccagccucauuggauugccgcuuccaucauucuugaguuuuuccugaucguccuccugauucccgaacccgagaaacaaagaacgccucaggacaaccagcugacauacguggucaucgccauccucaccgugguugcggccaccauggcuaaugaaaugggguuucuugagaagaccaagaaggaccugggacugggcagcauuaccacacaggaguccgaaucuaacauccucgauauugaccugcggccggccagcgcuuggacgcuuuaugccguggcgaccacauucgugacccccaugcugcgccacuccaucgaaaauucuagcgucaacguuucccucacagccauugcuaaucaagccaccgugcugauggggcugggaagaggcuggccucucagcaaaauggauaucggggugccccuucuggcuauuggauguuacucucaggucaacccuaucacgcugaccgccgcucuccugcuucugguggcccauuacgcgaucauuggccccggccuccaggccaaggcuacacgggaagcccagaagcgcgcugccgccgggaucaugaaaaauccuaccguugacggaauuacagugaucgaucuggagccgauucccuaugacccuaaguuugaaaaacaacugggccaggucaugcuccuugugcugugcgucacccaggugcugaugaugagaacgacaugggcgcucugugaggcucugacccuugccacagggcccaucuccacccugugggagggaaacccuggccgguucuggaauaccacaaucgcuguuagcauggccaacauuuuucgcgggucuuaccucgccggagcuggccugcuguucuccaucaugaagaauacgaccaacacaagacggggcaccgggaauauuggagaaacacucggcgagaaauggaaaagcagacuuaacgcccuggggaagucugaauuucagaucuauaaaaagagcggcauucaagagguggaucgcacccuggcgaaagagggcaucaagagaggggaaacggaccaccaugccgucuccagaggaucugcuaaacuccgcugguucguggagcggaacaugguuacacccgaaggcaagguggucgaucugggcugcgggagaggaggcuggagcuacuauugugggggacuuaaaaaugugcgcgaggugaagggccugaccaaagggggaccgggccacgaggagccuauccccauguccaccuacggcuggaaccucguucggcugcagagcggggucgacguguucuuuacacccccugagaaaugcgauacccugcucugugacauuggagaauccucucccaauccuacaaucgaggccggcagaacgcuucgcgugcugaaccuggucgaaaauuggcucaacaauaacacccaguucugcauuaagguucugaauccguauaugcccagcgugaucgagaaaauggaaacacuucaacggaaguacgggggagcucuggugagaaacccucucucccgcaauucuacccacgagauguacugggucagcaacgccacaggcaauauuguguccucuguuaacaugaucagccggaugcugaucaauagauuuaccaugaaacauaagaaggcgacguaugagcccgauguggaccugggguccggaacccgcaacauuggcaucgaaaacgagauuccuaaucucgacaucauuggcaaaagaaucgaaaagauuaaacaggagcacgaaacaagcuggcauuacgaucaggaccaccccuauaagaccugggccuaccacgggucuuaugagacaaaacagaccggauccgcuagcucuauggucaacggcgugguuaaacuucugacaaagccgugggauguggucccuauggugacccaaauggccaugacggacacaacccccuucgggcagcagcggguguuuaaagagaaggucgauacccgcacacaggaaccuaaagagggaacgaagaaacugaugagaaucaccgcugaauggcucuggaaggagcugggcaagaaaaagacaccccggauguguaccagagaggaguucacacggaaaguucgcuccaaugccgcucuuggggccaucuuuaccgacgagaacaaguggaaaagcgcgagagaagccguggaggauucucgguucugggaacugguggaccgcgagagaaaucuccaucuggagggaaagugcgaaacaugugucuacaacaugaugggcaaacgggagaagaagcugggcgaauuugggaaagcuaagggaucccgcgccauuugguauauguggcucggcgcuagauuccuggaguuugaagcccuuggguuccugaaugaggaucacugguuuagccggggaaacucccucagcggcguggagggggaaggccugcauaaacuuggauacauccugcgcgacguuucuaagaaagagggcggggccauguacgcggaugacaccgcuggaugggacacgagaauuacccucgaagaucugaagaaugaggaaauggugacaaaccacaugaagggcgagcauaaaaagcuggccgaggccaucuucaaacucaccuaucaaaauaaggucgugcggguucagcgcccuacacccagagggaccgugauggacauuaucagccggaaagaucagcgcggauccggccaggucgggacguacggccugaacacauucaccaauauggaagcucaacuuaucagacagauggagggagaaggcauuuuuaagucuauccagcggcugacagugaccgaggagauugccguucaaaacuggcucgcuagaguggggcgcgaacggcugagcagaauggccaucuccggagacgauugcgucgugaagccgcuugacgaucgcuucgcgucugcccugacggcucucaaugacaugggcaaaguccggaaggauauucagcagugggagccuagcagaggguggaacgacuggacccaggugcccuuuugcucccaccacuuccaugaacugguuaugaaagauggacgcgugcuggucgugcccugucggaaccaagacgagcucaucggcagagcccgcaucucucagggggcuggcuggagccugaaggaaacagccugccuuggaaaauccuaugcgcagauguggacccugauguacuuucaccggagagaucuccgccuggccgcuaaugccauuuguagcgcugugccuucucauuggguuccgacaucccggaccacauggagcauccacgccaagcacgaguggaugaccacggaggacaugcuugcuguguggaacagagucuggauucaggaaaaucccuggauggaggacaagacaccuguggaaucuugggaggaaguucccuaucugggcaaacgggaggaucaauggugcgggucccucaucggacugaccagcagagccaccugggcgaagaacauucagacagccaucaaucaggugcgcucccugauuggcaacgaggaauacaccgacuauaugccuucuaugaaacgguucagaaaggaggaagaggaagcugggguccucugguga

SEQ ID NO: 19858 - RNA, 9876 nt, Artificial Sequence
  derived and/or modified CDS sequence (opt5) from DENV-2__GQ868600__SS-prME
accgccggcaugaucauuaugcugauccccacagugauggcuuuccaccucacgaccagaaacggggagccucauaugauugucagccggcaggaaaagggaaaaucccugcuuuuuaagacaaaagacggcaccaauaugugcacacugauggccauggaucucggggagcugugugaagacaccaucacauacaagugcccguuccuuaaacaaaacgagcccgaagauauugacuguuggugcaauucuaccagcacguggguuaccuauggaacauguaccacaaccggcgagcaccgcagagagaagcgguccguggcgcuggugccucaugucgggaugggacucgaaacgcgcacagagaccuggaugucuagcgaaggcgcuuggaagcacgcccagagaaucgagacauggauccugcggcaucccggcuuuaccauuauggccgcuauccuggccuacaccauugggacaacgcacuuccagcgcgugcucaucuuuauucugcuuaccgcuaucgccccuuccaugacaaugagaugcauuggaaucucuaaccgggauuucguugagggcgugagcgggggauccugggucgacaucgugcuggaacacggcagcuguguuaccacaauggcgaaaaauaagcccacccucgauuuugagcugauuaaaacggaagccaagcagccugcuacacuucgcaaauauugcaucgaggccaagcugaccaacaccacaaccgacucuagauguccgacacaaggggaacccacgcucaaugaggagcaggauaagcgguucgugugcaaacauuccauggucgaccgcggauggggcaacggcugugggcuguuuggaaagggcgggauugugaccugcgcuauguucacaugcaaaaagaauauggaaggaaaaaucgugcagccugagaaccuggaauacaccgucguuauuacaccccacagcggcgaggaacaugccguggggaaugauaccggaaagcacggcaaagaggugaagaucacgccucagucuuccaucaccgaggcggaacucacaggcuaugggaccgucacaauggaguguagccccagaaccggacuggacuuuaacgaaauggugcuucugcaaauggaggauaaggccuggcucguucaccggcagugguuccuggaccuuccgcugccuuggcuccccggcgcugacacgcaggggucuaauuggauucagaaagaaacacuggugaccuuuaagaacccucaugccaaaaagcaagaugucgugguucugggaucccaggagggcgcuaugcacacagcccucaccggggccaccgagauccagaugagcuccggcaaucugcuuuucacaggacaucugaaaugccgccucagaauggacaagcugcaacuuaagggcaugucuuacagcauguguacggggaaauucaagauugugaaagaaaucgcugagacccagcacggaacaauugucauccgggugcaguaugaaggcgaugggucccccugcaagauccccuuugagauuauggaccuggagaaaagacauguccucggacgccugaucaccgugaacccuauuguuacagaaaaggauagcccggugaacaucgaggcggaacccccuuucggcgacucuuacauuaucauuggggucgagcccggccagcugaagcucgauugguuuaaaaagggauccagcaucggccaaauguucgaaaccacgaugcggggggccaaaagaauggcuauccugggagacacagccugggauuuuggcucucuugggggaguguucaccagcauuggcaaggcccugcaccagguuuuuggggcuaucuacggcgccgcguucuccggagugucuuggaccaugaaaauucucaucggcgucauuaucacauggaucgggaugaauagccgcuccaccagccugucugugucccuggugcuuguuggaauugucacacucuaucugggcgugauggugcaggcugacagcgggugugucgugucuuggaagaacaaggagcugaaaugcggauccggcaucuuuguuacggauaaugugcacaccuggacagagcaguacaaguuccaaccugaaagccccuccaaacucgccucugccauucagaaggcucaugaggaagggaucuguggcauucggagcgucaccagacuggagaaccuuauguggaaacagaucacauccgaacugaaucacauccucucugagaacgaggugaagcugaccauuaugacgggagacaucaaaggcauuaugcagguugggaagcgcagccugcggccgcaaccuaccgaacuuagauauuccuggaagacauggggaaaagccaagaugcucagcaccgagcugcauaaucagacauuucugaucgacggccccgaaaccgcugagugcccuaacacaaaucgcgccuggaacucucucgaaguggaggauuacggguucggagucuuuaccacgaauauuuggcugcggcuuagagagaaacaggacgcguucugugauuccaagcugaugagcgccgcuaucaaagacaaccgcgccgugcacgcugauaugggcuauuggaucgaaucugcccucaaugacacauggaagauugagaaggcguccuucaucgaaguuaaaagcugccacuggcccaagucucauacccuguggagcaacggcgugcuggaguccgagauggucauuccuaaaaauuuugccgggcccgugagccagcacaacaaccggccgggauaccauacccaaacagcuggcccuuggcaccuugggaagcucgaaauggauuucgacuuuugugagggaaccacgguggucguuacagaagauugcggcaauagagggcccucucugcggaccacaaccgccuccggaaaacugaucacagaguggugcugucgcagcugcacccuccccccucugagauaucggggcgaagacggcuguugguacgggauggagauuagaccgcuuaaggagaaggaagagaaccugguguccucucucgugacggcuggacauggccagaucgauaauuucagccuggggauucugggaauggcccuuuuucucgaagagaugcugcgcacccgggucggcacaaaacacgccauccugcucguggcuguuuccuucgugacccugaucacagggaacaugucuuuuagagaccuuggacgcgucauggugaugguuggcgcgaccaugacggaugacauuggcaugggggugacauaccuggcccuccuggcugccuucaaggucagacccaccuuugccgcuggacugcuucugcggaaacucacaagcaaggaacugaugaugaccaccaucggcauugugcuccugucccagucuagcaucccugagacaauucuugagcugacggacgcccucgcgcuggggaugaugguucugaaaauggugcgcaauauggaaaaguaucaacuugcugucaccaucauggccauccugugcgugcccaacgccgugauucuccagaaugcuuggaaggucuccuguacaauccuggccguugugagcgugucuccucuccugcuuaccuccagccagcagaaagcggauuggauuccccuggcucucacaaucaagggacugaacccuaccgccauuuuccugacgacacuuucuagaaccuccaaaaagcggagcuggccccugaaugaggccaucauggcugucggcauggugucuauccucgccuccagccugcucaaaaacgacauuccgaugaccgggccucugguugcuggaggccuucugacagugugcuacguccugaccggccgcuccgccgaucucgaacuggagagagcgacagacgugaagugggaugaccaagccgaaaucagcgggucuagccccauucuuuccaucacgauuucugaggauggaagcauguccaucaaaaaugaggaagaggaacagacccugacaauucucauccggaccggccugcucguuaucucugggcuguuuccugugagcauucccaucacagcugccgcuugguaucuuugggaggucaagaagcagcgcgccggagugcugugggacgucccguccccucccccugugggcaaagccgagcuggaagauggggcuuacagaauuaagcagaaaggaauccucggcuauucucaaauuggcgcggggguuuacaaggagggaaccuuccacacgauguggcaugugacccggggcgccguccugaugcacaaagggaagcgcaucgaacccagcugggcugacgugaagaaagaucuuaucuccuauggaggcggguggaagcuggagggagaauggaaagagggcgaggaaguucaggugcucgcccuggagcccggcaagaacccuagagccguccagacaaaaccggggcucuuucggaccaauacaggaaccauuggcgcugugagccuggacuucucucccgggacauccggaagcccuaucguggauaagaagggcaaaguugucgggcuuuacggaaacggcguggugacgagaucuggcgccuacgucuccgcgauugcucagaccgaaaagagcaucgaggacaaucccgaaauugaggacgauaucuuccgcaaacggagacugacaaucauggaccugcauccuggggccggaaagaccaaacgcuaucuccccgccauugugcgggaggcuaucaagagaggccugcgcacccuuauucuggccccuacacggguuguggcggcugaaauggaggaagcccucagagggcugccgauccgcuaccaaacgcccgccauucgggcugagcacaccggaagagaaaucgucgaucucaugugucaugccacauuuaccaugcggcugcuuuccccuauucgcgugcccaacuauaaccugaucaucauggacgaggcucacuucacagauccugccucuauugcggccagaggcuacaucagcacccggguugagaugggggaagcugccggcauuuuuaugacggcuacacccccgggaucccgcgacccuuucccccagagcaaugcccccaucauggaugaggaaagagagauuccugagcggucuuggaacuccggccacgaaugggugaccgacuuuaaggggaaaaccgucugguucgugcccagcaucaagacaggaaaugauaucgccgcuugccugagaaaaaacggcaagcgcguuauucagcucucucggaaaaccuuugacagcgaguaugugaagacaagaaccaaugauugggacuucgucgugacgacagacaucuccgaaaugggggcgaacuuuaaggccgagcgcgugauugauccucggagauguaugaaaccggucauccugaccgacggagaagagcgcguuauucuugcuggccccaugccugugacacauucuagcgccgcccaacggagagggcgcaucggcagaaauccccggaacgagaaugaucaguacaucuauaugggagaaccucuggagaacgacgaagauugcgcucacuggaaggaggccaaaaugcuccuggacaauauuaacacccccgaaggcaucauuccguccauguucgagccugagcgcgaaaagguggaugcgaucgacggggaguacagacugcggggagaagcucgcaaaacguuugucgaucucaugagacggggcgaccuucccguguggcuggccuacaagguugccgcugaggggauuaauuaugccgauagacgcugguguuucgacggaacccggaacaaucagauccuggaagagaacguggaggucgaaauuuggacaaaagagggcgaaagaaagaagcucaaaccucgcuggcuggaugcgcggaucuacucugacccccuugcccugaaggaguucaaagaguuugcugccgggagaaagagccucacccugaaccugaucacagaaaugggccggcucccuaccuucaugacacagaaagcucgcgacgcccuugauaaucuggcugugcugcauaccgccgaggcgggaggcaaggccuauaaccacgcucucuccgaacugcccgagacgcuugaaacacugcuccugcugacccuccuugccaccguuacagggggaauuuuucuguuccugaugagcggcagagggaucggaaagaugacccucggcaugugcugcauuaucacagcuucuauucugcuuugguacgcccaaauccagccgcacuggaucgccgcuuccauuauccuggaguuuuuccucauugugcugcugaucccugagcccgaaaaacagcggacgccccaggacaaucaacucaccuaugucauuaucgcgauccuuacaguggucgccgcuaccauggccaacgagaugggcuuucuggaaaagacaaaaaaggaucuggggcucggaaauauugccacccagcagccugagagcaacauccuggacauugaucuucgcccggcuuccgccuggacgcuguacgcgguggccaccacauucaucacccccaugcucagacauucuauugaaaauagcuccguuaacgugucucugacagcuaucgccaaucaggcuaccgugcugaugggccucgggaaaggauggccucuuagcaagauggacauuggcgucccccugcuggccaucggguguuauucccaaguuaacccuaucacgcucacagcggcccugcuucugcucguggcucacuacgccauuaucggacccggccugcaggcuaaggccacccgggaggcucagaaacgcgccgcggccggcauuaugaagaauccuacaguggaugggaucaccgucauugaccuggauccgauccccuacgacccuaaauuugagaagcagcucggacaagugaugcuucugguucugugcgugacccagguccucaugaugagaacaacgugggcucugugugaagcccuuacccuggcuacaggccccgugagcacccucugggaggggaacccuggacgguucuggaauacaaccaucgccgucucuauggccaacauuuuucgcggcuccuaucuggcgggggcuggacugcucuucagcaucaugaaaaauacgacaucuaccagacggggcaccggcaacauuggggaaacacuuggagagaaguggaaguccagacugaaugcccugggcaaaagcgaauuucagaucuacaagaaaucugggauucaagagguggaucgcacccucgcuaaggagggaaucaaacggggcgaaacagaccaucacgccguuagcagaggguccgccaagcugcgcugguucguggagcggaaccuugucacgcccgaaggaaaagugguugaucugggcugcggcagagggggauggucuuauuacuguggcgggcucaagaacgugcgcgaggucaagggacugaccaaaggcgggccgggacaugaggaaccuauccccaugagcacauauggcuggaaucuggugcggcuccaguccggcguggacguuuucuuuguccccccugagaagugcgacacccuucugugugauauuggggaaagcucccccaacccuacaguggaggcuggaagaacccugcgcgugcucaaucuggucgaaaacuggcuuaauaacaauacgcaguucugcguuaaagugcugaacccguacaugcccucugugaucgagcggauggagacccuccagagaaaguauggcggggcccugguccgcaauccucugagccggaacuccacacacgaaauguacugggugucuaaugcgagcggaaacauuguuuccucugugaauaugaucagcagaaugcucauuaaccgcuuuaccaugagacacaaaaaggccacauacgagcccgacgucgaucuuggcuccgggacccggaauaucggaaucgaaagcgagacaccuaaccuggacauuaucggcaagcgcauugaaaaaaucaagcaagagcaugagaccucuuggcacuaugaucaggaccaucccuacaaaacgugggcuuaucacggcuccuacgaaacaaagcagaccgggagcgccucuuccauggugaacggaguugugagacugcucaccaaaccgugggaugucgugccuauggugacacagauggcuaugacggacaccacacccuucggccaacagcgggucuuuaaggagaagguugauaccagaacacaggaaccuaaagaggggaccaagaaacugaugaagauuacagccgaauggcuuuggaaagagcugggaaagaagaaaaccccccggauguguacgcgcgaggaauucaccaagaaagugagaagcaaugcggcccucggcgcuaucuuuacagacgagaacaaguggaaaucugcccgggaagcuguggaggauucccgcuucugggagcuggucgacaaggaaagaaaucugcaccucgaggggaaaugcgaaaccuguguguauaacaugaugggaaagcgggagaagaaacugggcgaauuuggcaaggccaaagggagccgcgcuauuugguacauguggcuuggagccagauuccuggaguuugaggcgcucggcuuccugaaugaagaccauugguuuucccgggagaacagccuuucugggguugaaggagagggccugcacaagcucggguauauccugcgcgaagugagcaaaaaggagggcggagccauguacgcugaugacacagccggcugggauaccagaaucacgauugaggaccugaagaaugaagagaugaucacaaaccauauggcuggggaacacaaaaagcucgccgaggccauuuucaaacugaccuaccagaauaaggucgugcggguucaacgcccuacacccagaggaaccgugauggauaucauuucccggcgcgaccagagaggcucugggcaggucggaacguauggccuuaacaccuucacaaauauggaagcgcaacugauccggcagauggagggggagggcaucuuuaaaagcauucagcaucucaccgcuuccgaagagaucgccgugcaggauuggcugguuagagugggacgcgaacggcuuucuagaauggccauuagcggcgacgauugcgucgugaagccgcuggacgaucgcuucgcucgggcccucacagcucugaacgacauggggaaggucagaaaagauauccaacagugggagccuucccgcggauggaaugacuggacccaggugcccuuuugcucucaccacuuccaugagcugauuaugaaggacggccggacacucguugugcccuguagaaaccaggaugaacugaucgggcgcgcccggaucagccaaggagcgggcuggucccuuagagagaccgccugccuggggaaaagcuacgcucagauguggucucucauguauuuucaccgccgggaccugagacuugccgcuaaugccauuuguuccgcggucccuagccauugggugccgacgucucggacaaccugguccauccacgccagccacgaauggaugaccacagaggauaugcugaccguguggaacaagguuuggauucucgaaaaccccuggauggaggacaaaacaccuguggaguccugggaagagauccccuaccugggcaagagagaagaucaguggugcggaucucugauuggccucacgagccgcgcuaccugggccaagaauauccagacagcuauuaaccaaguccggucccugaucgggaaugaggaauauaccgacuacaugccuagcaugaaaagauuccgcagagaggaggaagaggccggagugcuuugguga

SEQ ID NO: 19859 - RNA, 9876 nt, Artificial Sequence
  derived and/or modified CDS sequence (opt5) from DENV-2__KF955359__SS-prME
acagccggcgugaucauuaugcugauccccacagcuauggccuuccaccucacgaccagaaauggggagccucauaugauuguuggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaccauggccgcuauccucgccuacaccauuggaacaacgcacuuucagagagcucugaucuucauucuucugaccgccguggcgccuagcaugacaaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacggaggcuaagcagccugccauucugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugccucccucgugcuggugggcauuguuacacuguaucucggggucauggugcaggccgacaccggauguguggucagcuggaagaauaaagaacugaagugcggcucugggaucuucauuacagauaacgugcacacguggaccgagcaguacaaguuucagccugaaucccccagcaaacuugcuuccgccauccaaaaggcucaugaggaaggcaucuguggaauuagaucuguuacacgccuggagaaucucauguggaaacagaucaccccggagcugaaccacauucugagcgaaaaugaggugaaacuuacaaucaugaccggcgacauuaaagggaucaugcaggccggaaagcggucccucagaccucagcccacggaacugaaauauucuuggaagaccuggggcaaggcgaaaaugcugagcacagagucccauaaccaaaccuuccucaucgaugggccugaaacagccgagugccccaauaccaaccgcgcuuggaauagccuggaggucgaagacuacggauuuggcguguucucuacaaacauuuggcuuaagcugcgggagaaacaggacgucuuuugugauuccaagcucaugagcgccgcuaucaaagacaauagagccgugcacgcggauaugggcuauuggauugaaucugcccugaacgacaccuggaagauggagaaggcuuccuucaucgagauuaaaagcugccacuggccuaagucucauacgcuguggagcaaugggguccuugaauccgagaugaucauucccaaaaacuucgccggaccggugagccagcacaacuaccgcccuggcuaucauacacagaccgcugggcccuggcaccucggaaagcuggaaauggauuuugacuucugugagggcaccacaguuguggucaccgaagauugcgggaaucggggacccucucugagaacgacaaccgccuccggcaaacucaucacagaguggugcugucggagcugcacccugccuccgcuucgcuacagaggcgaggacggguguugguacggaauggaaauccggccccugaaggagaaggaagagaaccucgugaauagccuggugacagccggccaugggcaaauugauaacuuuucucugggaguccuuggcauggcucucuuccuggaagagaugcugagaacccgcguugggacgaaacacgcgauccuccugguggccgugagcuuugucacccuuauuacaggaaauauguccuuccgggaccugggcagagugaugguuauggugggcgcuaccaugacagaugacaucgggaugggagucaccuaucucgcccugcuggccgcuuuuaaggugcgcccuacguucgccgcgggccuucugcucagaaaacugacaucuaaggagcucaugauggcuaccauugggaucgcccugcuuagccaguccacaauccccgaaaccauucuggagcucaccgaugcccuggcucugggaaugaugguucuuaaaaucgugcggaacauggaaaaguaccagcuggccgucacaauuauggcgaucucuugcgugccuaaugcuguuauucuccaaaacgccuggaaggugagcuguacgauccuggccgcugucuccgugagcccccuccugcuuaccucuucccagcagaaagccgacuggaucccucuggcucucacaauuaagggccugaaucccaccgccaucuuucugacaacccuuagccgcacgucuaaaaagagauccuggccgcugaacgaggcggugauggccgucgggaugguuagcauucucgcuucuucccugcucaaaaaugacaucccuaugacaggaccccugguggccggcggccuucugaccgugugcuauguccugaccgggcggagcgcugaucucgaacuggagaaggccgccgacgugaaaugggaggaucaggcugaaauuuccggaagcucuccuauccuuagcauuacaaucuccgaggacggcucuaugagcaucaagaacgaagaggaggaacacacccugacaauucucauccgcacggggcugcucguuauuuccggaguguuccccgucucuaucccgauuaccgcggccgcuugguaccugugggaggugaagaaacaaagagccggcguucuuugggaugugccuucucccccucccgucgggaaggccgaacuggaggacggagcuuaucggaucaaacagcgcggcaucuuuggcuacucccagauuggggccggaguguauaaggaaggcacauuccauaccauguggcacgucacaagaggggcggugcugaugcaucggggaaaacgcaucgagcccuccugggcugauguuaagaaggaccucauuagcuacggcgggggauggaaacuggagggcgaauggaaggagggcgaagaggugcagguccuugcccuggaaccugggaaaaauccgagagccgugcaaaccaagcccggacucuuuaaaacgaacaccggcacaaucggggcuguuucccuggauuucagcccuggaaccucuggcucccccauuguggaccggaaggggaaggucgugggacucuacggcaauggcgugguuacaagaagcggggccuaugucucugcgaucgcucagaccgagaaauccaucgaggauaacccugaaauugaggacgauaucuuccgcaagaaacggcugacaauuauggaccuucaccccggagccggcaagacgaaaagauaccugccugccaucgugcgcgaagcuauuaagcgggggcugagaacccucauccuggccccgacacgcguggucgcugccgagauggaagaggcgcuucggggacugcccauuagauaucagaccccugccauccgcgcugagcauaccggccgggaaaucguggaccucaugugucacgccacauuuacgaugagacugcucagccccguucgggugccuaacuacaaucugauuaucauggaugaggcucacuucaccgaccccgccuccauugccgcucgcggguauaucucuacaagagucgaaaugggcgaggcggccggaauuuuuaugaccgcuacaccgccuggcagccgggaucccuucccccaguccaacgccccuaucauggacgaggaacgcgagauccccgaaagaagcuggaacucugggcaugagugggugaccgauuuuaagggaaaaacgguuugguucgugccuuccauuaaggccggcaacgacaucgcugccugccuucggaaaaaugggaagaaagucauucaacugagcagaaagacauuugauucugaauacgugaagacccgcgcgaacgacugggauuucguugugaccacagacaucagcgagaugggagcuaauuuucgggccgagagagucauugauccgcgccgguguaugaaacccgugauccugaccgacggcgaagagagagugauccucgccgggccuaugcccgucacacacuccucugcugcccagcgccggggcagaauuggacgcaacccuaagaaugaaaacgaccaguauaucuacaugggcgagccccuggaaaaugaugaggacugcgcgcauuggaaagaggccaagaugcuucuggauaacauuaauaccccggaagggaucauuccuagcauguucgagcccgaaagagagaaaguugacgcuaucgauggagaauaccggcuccgcggcgaggccagaaagacguuuguggaccugaugcggcgcggggaucugccuguguggcucgcuuauagagucgccgcugagggaauuaacuacgccgaccggagaugguguuucgauggcaucaaaaauaaccaaauccuugaagagaacguggaaguugagauuuggacaaaggagggggaacgcaagaaacugaagccccgguggcuggacgcgagaaucuauuccgauccucucgcccugaaagaguucaaggaauuugcugccggccgcaaaucucuuacccugaaucucauuacagagaugggacggcugcccaccuucaugacgcagaaggcuagagacgcccuggauaaccucgccgugcuucacaccgcugaagucggcgggcgggcguacaaucacgcccugagcgagcugccggagacacucgaaacccugcuucugcucacacugcuggcuaccgugacaggaggcaucuuucucuuccuuauguccgggaagggaauuggcaaaaugacccugggcaugugcugcaucaucacggccagcauucugcucugguaugcccagauccagccucauuggauugcugccucuaucauucuggaguuuuuccuuaucguucugcucauccccgaacccgagaagcaacgcacaccucaggacaaccagcugaccuacguggucauugcgauccugaccguggucgccgcuacaauggccaaugaaaugggguuucucgagaaaaccaagaaagaccuuggacugggcuccauuacaacgcaggagagcgaauccaacauccuggauauugaccucagaccggcuucugccuggacccuguaugcgguggccacaaccuucguuacacccaugcuucggcacagcaucgaaaauuccucugugaacgugagccugaccgcuauugccaaucaagcuacgguccucauggggcugggacgcggcuggccucuguccaagauggauaucgggguuccccuccuugccaucggauguuacagccaggugaacccuauuacccugacagcugcccugcuccugcuuguggcgcauuacgccaucauuggccccggccugcaggcuaaggccaccagagaagcucagaaacggacagccgccgggaucaugaagaauccuaccgucgacggaauuacggugaucgaucucgagccgauccccuaugacccuaaauuugaaaagcaacugggccagguuaugcugcucgugcuuugcgucacacaggugcugaugaugcgcaccacaugggcgcugugugaggcucucacccuggccaccgggcccauuucuacacuuugggagggaaacccuggcagauucuggaauacgaccaucgcugucuccauggccaacauuuuucgggggagcuaccuggccggagcuggccuccuguucucuaucaugaaaaauacaaccaacacacgcagaggcaccgggaauauuggagaaacgcugggcgagaaguggaagucccggcucaacgcccuugggaaaagcgaauuucagaucuauaagaaaucuggaauccaagagguggauagaacacuggcgaaggagggcauuaaacgcggggaaaccgaccaccaugccguuagccggggauccgcuaagcugagaugguucguggagcgcaacauggucacccccgaaggcaaagugguugaucucggcugcgggcggggaggcuggucuuacuauugugggggacugaagaaugugagagaggucaagggccuuacaaaagggggaccgggccacgaagaaccuauccccaugagcaccuacggcuggaaccuggugcgccuccaguccgggguggacguuuucuuuacacccccugagaagugcgauacgcugcugugugacauuggagaaagcucccccaauccuaccaucgaggccggccggacacucagaguccuuaaccugguggaaaauuggcugaacaauaacacccaguucugcgugaaaguccucaauccguauaugcccucuguuauugagaagauggaaacacugcaacgcaaauacgggggagcucuugugcggaacccucugagcagaaauuccacccacgagauguacugggugucuaacgccacgggcaauaucgucagcuccgugaacaugaucucucgcaugcucauuaaucgguuuaccaugaagcauaagaaagcgacauaugagcccgauguugaccuggggagcggaaccagaaacaucggcauugaaaacgagaucccuaaucuggacauuaucggcaagcgcauugagaagaucaagcaggagcacgaaacauccuggcauuacgaucaggaccaccccuauaaaaccugggccuaccacgggagcuaugagacaaagcagaccggaucugcuuccagcauggugaacggcgucgugaagcuccuuacgaaaccgugggauguugugccuauggucacacaaauggccaugaccgacaccacacccuucgggcagcagagaguguuuaaggagaaaguggauacgcggacccaggaaccuaaggagggaaccaaaaagcugaugcgcaucaccgcugaauggcuguggaaggagcucggcaaaaagaaaacacccagaauguguacccgggaggaguucacaagaaagguccggucuaaugccgcucugggggccauuuuuaccgacgagaacaaauggaaguccgcgcgcgaagccguugaggauagcagauucugggaacuuguggaccgggagcgcaaucugcaucucgagggaaaaugcgaaacguguguguacaacaugaugggcaagagagagaagaaacugggcgaauuugggaaggcuaaaggaucucgggccaucugguauauguggcugggcgcucgcuuccucgaguuugaagcccugggguuccuuaaugaggaucacugguuuuccagaggaaacagccuguccggcgucgagggggaaggccuccauaagcugggauacauucuucgggacgugagcaaaaaggagggcggggccauguacgcggaugacaccgcuggaugggacacacgcaucacccuggaagaucucaagaaugaggaaaugguuacaaaccacaugaaaggcgagcauaagaaacuggccgaggccauuuucaagcugaccuaucaaaauaaaguggucagagugcagcggccuacgccccgcgggacaguuauggacaucaucucuagaaaggaucagcggggaagcggccagguggggaccuacggccucaacacauucaccaauauggaagcucaacugauucgccagauggagggagaaggcaucuuuaaguccauucagagacuuacggucaccgaggagaucgccgugcaaaacuggcuggcucggguugggagagaacgccucucucggauggccauuagcggagacgauugcguggucaaaccgcuggacgauagauucgcguccgcccuuacagcucugaaugacaugggcaaggugcgcaaagauauccagcagugggagccuucucggggguggaacgacuggacccagguccccuuuugcagccaccacuuccaugaacucgugaugaaggauggaagaaugcugguugugcccugucgcaaccaagacgagcugaucggccgggccagaauuucccagggggcuggcuggucucucaaagaaacagccugccugggaaagagcuaugcgcagauguggacccuuauguacuuucaccgccgggaucugagacucgccgcuaaugccaucuguuccgcugucccuagccauugggugccgacaucucgcaccacgugguccauucacgccaagcacgaguggaugacaaccgaggacaugcuggcuguguggaaccggguuuggauccaggaaaaucccuggauggaggacaaaaccccuguggaaagcugggaggaaguccccuaucuuggcaagagagaggaucaauggugcgggucucugauuggacucacaucccgggccaccugggcgaaaaacauccagacagccauuaaucaggugagaagccugaucggcaacgaggaauacacggacuauaugccuuccaugaagcgcuuccggaaagaggaagaggaagcugggguucugugguga

SEQ ID NO: 19860 - RNA, 9876 nt, Artificial Sequence
  derived and/or modified CDS sequence (opt5) from DENV-2__KF955360__SS-prME
accgccggcgugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccugugcuacaaccggggagcaccggcgggaaaagcgcagcguggcccucgucccucaugugggaaugggccuggagacaagaaccgaaacguggauguccucugagggcgccuggaagcacguucagcggaucgagacauggauucugcgccaucccggguucaccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaagacagaggccaagcagccugcuacccugagaaaauauugcaucgaagccaagcucacgaacacaaccaccgagagccgguguccgacacaaggagagcccucucugaaugaggaacaggacaaacgcuuuauuugcaagcauuccaugguggauagaggcuggggcaacggguguggacuguucggcaaagggggaaucgugaccugcgcgauguuuacaugcaaaaagaauauggaaggcaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggacaaagccuggcuuguucaccgccaaugguuucuggaucucccgcugccuuggcugcccggggcugacacccagggaucuaauuggauucagaaggagacacucgugaccuucaagaacccucaugccaaaaagcaggacgucgugguucugggcucccaagaaggggccaugcacacggcucuuacaggcgcgaccgagauccagaugagcuccggaaaucugcucuuuacaggccaucugaaaugcagacuucggauggauaagcugcagcucaaagggaugucuuacagcauguguaccggaaaguucaagauugugaaagaaaucgccgagacccaacacggcacaaucgucauuagagugcaguaugagggggacggaucccccugcaagauccccuucgaaauuauggaucuggagaaacgccauguccugggccggcucaucacggugaacccuauuguuaccgaaaaggacagcccggugaacaucgaggcugaacccccuuuuggggauucuuacauuaucaucggcgucgagcccggacagcugaaacuuaauugguucaagaagggcuccagcauugggcagauguuugagacaaccaugagaggagccaaacgcauggccauccugggcgacacagcuugggauuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggugaugguccaggccgacagcggaugugugguuucuuggaagaauaaagaacugaagugcggcuccgggauuuucaucacagauaacgugcacaccuggacagagcaguacaaguuucagccugaaagccccuccaaacuugcuucugccauucaaaaggcucaugaggaaggcaucuguggaaucagaagcgucacgcgccuggagaaucucauguggaaacagauuaccccggagcugaaccacauccuguccgaaaaugaggugaaacuuacaauuaugaccggcgacaucaaagggauuaugcaggccggaaagcggucucucagaccucagcccacagaacugaaauauagcuggaagaccuggggcaaggcgaaaaugcuguccacggagagccauaaccaaaccuuccucaucgaugggccugaaacagccgagugccccaauaccaaccgcgcuuggaacucucuggagguugaagacuacggauuuggcguguucuccacaaacaucuggcuuaagcugcgggagaaacaggacgucuuuugugauagcaagcucaugucugccgcuauuaaagacaauagagccgugcacgcggauaugggcuauuggaucgaauccgcccugaacgacaccuggaagauggagaaggcuagcuucauugagaucaaaucuugccacuggccuaagagccauacacugugguccaaugggguucuugaaagcgagaugauuauccccaaaaacuucgccggaccggugucucagcacaacuaccgcccuggcuaucauacccagacggcugggcccuggcaccucggaaagcuggaaauggauuuugacuucugugagggcacaaccgucguggugaccgaagauugcgggaaucggggacccucccugagaacaaccacggccagcggcaaacucauuacagaguggugcugucgguccugcacccugccuccgcuucgcuacagaggcgaggacggguguugguacggaauggaaauccggccccugaaggagaaggaagagaaccucgucaauucucugguuacagccggccaugggcaaaucgauaacuuuagccugggagugcuuggcauggcucucuuccuggaagagaugcugagaacccgcguggggacaaaacacgcgauucuccuggucgccguguccuuuguuacccuuaucacgggaaauaugucuuuccgggaccugggcagagugauggucauggugggcgcuaccaugacagaugacauugggaugggaguuaccuaucucgcccugcuggccgcuuuuaaggugcgcccuacauucgccgcgggccuucugcucagaaaacugaccagcaaggagcucaugauggcuacgaucgggauugcccugcuuucccagucuacaauccccgaaaccauccuggagcucacagaugcccuggcucugggaaugaugguccuuaaaauugugcggaacauggaaaaguaccagcuggccguuaccaucauggcgauuagcugcgugccuaaugcugucauccuccaaaacgccuggaagguguccuguaccauucuggccgcugugagcgucucuccccuccugcuuacauccagccagcagaaagccgacuggaucccucuggcucucacgaucaagggccugaaucccaccgccauuuuucugacaacccuuucucgcacauccaaaaagagaagcuggccgcugaacgaggcgguuauggccguggggauggugucuauccucgcuuccagccugcucaaaaaugacauuccuaugaccggaccccuggucgccggcggccuucugacggugugcuauguucugacagggcgguccgcugaucucgaacuggagcgcgccgccgacgugaagugggaggaucaggcugaaaucagcggaucuagcccuauucuuuccaucaccauuucugaggacggcagcauguccaucaaaaacgaagaggaggaacacacccugacaauccucauuagaaccgggcugcucgucaucucuggaguguuccccguuagcauuccgaucacagcggccgcuugguaccugugggaggugaagaagcaacgggccggcguccuuugggaugugccuucucccccucccgucgggaaagccgaacuggaggacggagcuuaucgcauuaagcagagaggcaucuuuggcuacagccagaucggggccggaguguauaaagaaggcacguuccauaccauguggcacguuacaagaggggcggugcugaugcaucgcggaaagagaauugagcccagcugggcugaugucaaaaaggaccucaucuccuacggcgggggauggaagcuggagggcgaauggaaagagggcgaagaggugcagguucuugcccuggaaccugggaagaauccgcgggccgugcaaaccaaacccggacucuuuaagacaaacaccggcacgauuggggcugucagccuggauuucucuccuggaaccuccggcagccccaucguggacagaaaagggaaggugguuggacucuacggcaauggcgucgugacacgcucuggggccuauguguccgcgauugcucagaccgaaaagagcaucgaggauaacccugaaaucgaggacgauauuuuccggaaaaagagacugacaaucauggaccuucaccccggagccggcaaaaccaagcgcuaccugccugccauuguccgggaagcuaucaaaagagggcugcgcacacucauucuggccccgacgcgggugguugcugccgagauggaagaggcgcuuagaggacugcccauccgcuaucagaccccugccauucgggcugagcauacaggcagagaaaucguggaccucaugugucacgccaccuuuaccaugcggcugcucucccccguccgcgugccuaacuacaaucugaucauuauggaugaggcucacuucacagaccccgccucuaucgccgcuagaggguauauuagcacgcggguugaaaugggcgaggcggccggaaucuuuaugaccgcuacaccgccuggcucccgcgaucccuucccccagagcaacgccccuauuauggacgaggaaagagagauccccgaacggucuuggaacuccgggcaugagugggugaccgauuuuaagggaaagacagucugguucgugccuagcaucaaagccggcaacgacauugcugccugccuuagaaagaaugggaaaaagguuauccaacugucucgcaaaaccuuugauagcgaauacgugaagacgcgggcgaacgacugggauuucgucgugacaaccgacauuuccgagaugggagcuaauuuuagagccgagcgcgugaucgauccgcggagauguaugaagcccgucauucugaccgacggcgaggaacgcguuauccucgccgggccuaugcccgugacacacucuagcgcugcccagcggagaggccgcaucggaagaaacccuaaaaaugaaaacgaccaguauauuuacaugggcgagccccuggaaaaugaugaggacugcgcgcauuggaaggaggccaaaaugcuucuggauaacaucaauaccccggaagggauuaucccuuccauguucgagcccgaacgggagaagguggacgcuauugauggagaauaccgccucagaggcgaggcccggaaaacauuugucgaccugaugcgcagaggggaucugccuguguggcucgcuuaucggguugccgcugagggaaucaacuacgccgacagacgcugguguuucgauggcauuaagaauaaccaaauccuugaagagaacguggaagucgagaucuggaccaaagagggggaacggaagaagcugaaacccagauggcuggacgcgcgcauuuauucugauccucucgcccugaaggaguucaaagaauuugcugccggccggaagucccuuacgcugaaucucaucacagagaugggaagacugcccaccuucaugacacagaaagcucgggacgcccuggauaaccucgccgugcuucacaccgcugaaguuggcgggcgcgcguacaaucacgcccuguccgagcugccggagacgcucgaaacccugcuucugcucacacugcuggcuaccgugacaggaggcauuuuucucuuccuuaugagcgggaagggaaucggcaagaugacccugggcaugugcugcauuaucacagccucuauccugcucugguaugcccagauucagccucauuggaucgcugccuccauuauccuggaguuuuuccuuauuguccugcucauccccgaacccgagaaacaaagaaccccucaggacaaccagcugacguacguggucaucgcgauucugacagugguugccgcuaccauggccaaugaaaugggguuucucgagaagaccaaaaaggaccuuggacugggcagcaucacaacccaggaguccgaaucuaacauucuggauaucgaccuccggccggcuagcgccuggacacuguaugcgguggccacgaccuucgugacacccaugcuucgccacuccauugaaaauucuagcgucaacguuucccugaccgcuaucgccaaucaagcuacagugcucauggggcugggaagaggcuggccucugagcaaaauggauauuggggugccccuccuugccaucggauguuacucucaggucaacccuaucacccugacggcugcccugcuccugcuuguggcgcauuacgccauuaucggccccggccugcaggcuaaggccacccgggaagcucagaagcgcacagccgccgggauuaugaaaaauccuaccguugacggaaucacagugauugaucucgagccgauccccuaugacccuaaguuugaaaaacaacugggccaggucaugcugcucgugcuuugcgucacccaggugcugaugaugagaacgacaugggcgcugugugaggcucucacccuggccacagggcccaucuccacccuuugggagggaaacccuggccgguucuggaauaccacaauugcuguuagcauggccaacaucuuucgcgggucuuaccuggccggagcuggccuccuguucuccauuaugaagaauacgaccaacacaagacggggcaccgggaauaucggagaaacacugggcgagaaauggaaaagcagacucaacgcccuugggaagucugaauuucagauuuauaaaaagagcggaauccaagagguggaucgcacccuggcgaaagagggcaucaagagaggggaaacggaccaccaugccgucuccagaggaucugcuaaacugcgcugguucguggagcggaacaugguuacacccgaaggcaagguggucgaucucggcugcgggagaggaggcuggagcuacuauugugggggacugaaaaaugugcgcgaggugaagggccuuaccaaagggggaccgggccacgaggagccuauucccauguccaccuacggcuggaaccugguucggcuccagagcggggucgacguguucuuuacacccccugagaaaugcgauacccugcugugugacaucggagaauccucucccaauccuacaauugaggccggcagaacgcuccgcgugcuuaaccuggucgaaaauuggcugaacaauaacacccaguucugcaucaagguucucaauccguauaugcccagcgugauugagaaaauggaaacacugcaacggaaguacgggggagcucuugugagaaacccucugucccgcaauucuacccacgagauguacugggucagcaacgccacaggcaauaucguguccucuguuaacaugaucagccggaugcucauuaauagauuuaccaugaaacauaagaaggcgacguaugagcccgauguggaccugggguccggaacccgcaacaucggcauugaaaacgagaucccuaaucuggacauuaucggcaaaagaauugaaaagaucaaacaggagcacgaaacaagcuggcauuacgaucaggaccaccccuauaagaccugggccuaccacgggucuuaugagacaaaacagaccggauccgcuagcucuauggucaacggcgugguuaagcuccuuacaaagccgugggauguggucccuauggugacccaaauggccaugacggacacaacccccuucgggcagcagcggguguuuaaagagaaggucgauacccgcacacaggaaccuaaagagggaacgaagaaacugaugagaaucaccgcugaauggcuguggaaggagcucggcaagaaaaagacaccccggauguguaccagagaggaguucacacggaaaguucgcuccaaugccgcucugggggccauuuuuaccgacgagaacaaguggaaaagcgcgagagaagccguggaggauucucgguucugggaacuuguggaccgcgagagaaaucugcaucucgagggaaagugcgaaacaugugucuacaacaugaugggcaaacgggagaagaagcugggcgaauuugggaaagcuaagggaucccgcgccaucugguauauguggcugggcgcuagauuccucgaguuugaagcccugggguuccuuaaugaggaucacugguuuagccggggaaacucccugagcggcguggagggggaaggccuccauaaacugggauacauucuucgcgacguuucuaagaaagagggcggggccauguacgcggaugacaccgcuggaugggacacgagaaucacccuggaagaucucaagaaugaggaaauggugacaaaccacaugaagggcgagcauaaaaagcuggccgaggccauuuucaaacugaccuaucaaaauaaggucgugcggguucagcgcccuacacccagagggaccgugauggacaucaucagccggaaagaucagcgcggauccggccaggucgggacguacggccucaacacauucaccaauauggaagcucaacugauuagacagauggagggagaaggcaucuuuaagucuauucagcggcuuacagugaccgaggagaucgccguucaaaacuggcuggcuagaguggggcgcgaacggcucagcagaauggccauuuccggagacgauugcgucgugaagccgcuggacgaucgcuucgcgucugcccuuacggcucugaaugacaugggcaaaguccggaaggauauccagcagugggagccuagcagaggguggaacgacuggacccaggugcccuuuugcucccaccacuuccaugaacucguuaugaaagauggacgcgugcuggucgugcccugucggaaccaagacgagcugaucggcagagcccgcauuucucagggggcuggcuggagccucaaggaaacagccugccugggaaaauccuaugcgcagauguggacccuuauguacuuucaccggagagaucugcgccucgccgcuaaugccaucuguagcgcugugccuucucauuggguuccgacaucccggaccacauggagcauucacgccaagcacgaguggaugaccacggaggacaugcuggcuguguggaacagagucuggauccaggaaaaucccuggauggaggacaagacaccuguggaaucuugggaggaaguucccuaucuuggcaaacgggaggaucaauggugcgggucccugauuggacucaccagcagagccaccugggcgaagaacauccagacagccauuaaucaggugcgcucccugaucggcaacgaggaauacaccgacuauaugccuucuaugaaacgguucagaaaggaggaagaggaagcugggguccugugguga

SEQ ID NO: 19861 - RNA, 9876 nt, Artificial Sequence
  derived and/or modified CDS sequence (opt5) from DENV-2__KF955363__SS-prME
accgccggagugaucauuaugcugauccccaccgcuauggccuuccaccucacgacccggaauggggaaccucauaugauugucggacggcaggaaaagggcaagagccugcuuuuuaagaccgaggacgggguuaauaugugcacccugauggcgaucgaucucggagaacugugugaggacaccauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaagggggaauugugacaugcgccauguuuacgugcaaaaagaauauggaaggcaaagucguucagccugagaaccuggaauacaccaucgugauuacaccccacagcggggaggagcaugcggugggaaaugacaccggcaagcacggcaaagaaaucaagaucacaccucagucuuccauuaccgaggccgaacuuacgggguauggaaccgucacaauggaguguagcccccggaccggccuggauuucaacgaaauggugcuccugcaaauggaggacaaggcuuggcuuguucaccgccagugguuucuggaucucccgcugccuuggcugcccggggccgacacacagggaucuaauuggauccagaaggagacccucgugacguucaagaacccucaugcuaaaaagcaagacgucgugguucugggcucccaggaaggggccaugcacacagcccuuaccggcgcuacagagauucagaugagcuccggaaaucugcucuuuaccggccaucugaaaugcagacuucggauggauaagcugcaacucaaagggaugucuuacagcauguguaccggaaaguucaagaucgugaaagaaauugcggagacacagcacggcacgaucgucaucagagugcaguaugagggggacggaucccccugcaagauucccuucgaaaucauggaucuggagaaacgccauguccugggccggcucauuaccgugaacccuaucguuacagaaaaggacagcccggugaacauugaggccgaacccccuuuuggggauucuuacaucauuaucggcgucgagcccggacagcugaaacuuaauugguucaagaagggcuccagcaucgggcaaauguuugagaccacaaugagaggagcuaaacgcauggccauucugggcgacaccgccugggauuucgggucucucggaggcguguuuacgagcaucgggaaggcucugcaccagguuuucggcgccauuuacggagcggcuuuuuccggcgugucuuggacaaugaaaauccugauuggggucaucaucaccuggauuggaaugaacagccgguccaccagccuuucugugucccucgugcugguuggcgucgugacacuguaucucggggccauggugcaggccgacagcggaugugucgugucuuggaagaauaaagaacugaagugcggcuccgggaucuucauuaccgauaacguucacacauggacggagcaguacaaguuucaaccugaaagccccuccaaacuugcuucugccauccagaaggcucaugaggaaggcauuuguggaaucagaagcgugacccgccuggagaaucucauguggaaacaggucacaccggagcugaaccacauccuguccgaaaaugaggugaaacuuaccauuaugacaggcgacaucaaagggauuaugcaggccggaaagcggucucucagaccucaacccaccgaacugaaauauagcuggaagacguggggcaaggcgaaaaugcuguccaccgagagccauaaccagacauuccucaucgaugggccugaaaccgccgagugccccaauacaaaccgcgcuuggaacucucuggagguugaagacuacggauuuggcguguucaccacaaacauuuggcuuaagcugcgggagaaacaggacgucuuuugugauuccaagcucaugagcgccgcuaucaaagacaauagagccgugcacgcggauaugggcuauuggaucgaaucugcccugaacgacaccuggaagauggagaaggcuuccuucauugagguuaaaagcugccacuggccuaagucucauacgcuguggagcaauggggugcuugaauccgagaugaucauucccaaaaacuucgccggaccggucagccagcacaacuaccgcccuggcuaucauacacaaaccgcugggcccuggcaccucggaaagcuggaaauggauuuugacuucugugagggcaccacagugguggucaccgaagauugcgggaaucggggacccucucugagaacgacaaccgccuccggcaaacucaucacagaguggugcugucggagcugcacccugccuccgcuucgcuacagaggcgaggacggguguugguacggaauggaaauucggccccugaaggagaaggaagagaaccucguuaauucccuggugacagccggccaugggcagaucgauaacuuuucucugggagugcuuggcauggcucucuuccuggaagagaugcugagaacccgcgucgggacgaaacacgcgauucuccugguggccguuagcuuugugacccuuaucacaggaaauauguccuuccgggaccugggcagagucauggugaugguuggcgcuaccaugacagaugacaucgggaugggagugaccuaucucgcccugcuggccgcuuuuaagguccgcccuacguucgccgcgggccuucugcucagaaaacugacaucuaaggagcucaugauggcuaccauugggaucgcccugcuuagccaguccacaauucccgaaaccauccuggagcucaccgaugcccuggcucugggaaugauggugcuuaaaauuguucggaacauggaaaaguaccaacuggccgugacaaucauggcgaucucuugcgucccuaaugcugugauucuccagaacgccuggaaggugagcuguacgauccuggccgcugucuccguuagcccccuccugcuuaccucuucccagcagaaagccgacuggauuccucuggcucucacaaucaagggccugaaucccaccgccauuuuucugacaacccuuagccgcacgucuaaaaagagauccuggccgcugaacgaggcgaucauggccguggggauggugagcauccucgcuucuucccugcucaaaaaugacauuccuaugacaggaccccuggucgccggcggccuucugaccgugugcuauguucugaccgggcggagcgcugaucucgaacuggagcgcgccgccgacgugaagugggaggaucaagcugaaaucuccggaagcucuccuauucuuagcaucacaauuuccgaggacggcucuaugagcaucaaaaacgaagaggaggaacagacccugacaauucucaucagaacggggcugcucgucaucuccggaguguuccccguuucuauuccgaucaccgcggccgcuugguaccugugggaggugaagaagcagcgggccggcguccuuugggaugugccuucucccccucccgucgggaaagccgaacuggaggacggagcuuaucgcauuaagcagagaggcauccugggcuacucccaaauuggggccggaguguauaaagaaggcacauuucacaccauguggcauguuacaagaggggcggugcucaugcaccgcggaaagagaaucgagcccuccugggcugaugucaaaaaggaccugaucagcuacggcgggggauggaaacuugagggcgaauggaaagagggcgaagaggugcagguucuggcccucgaaccugggaagaauccgcgggccgugcagaccaaacccggacuguucaagacgaacaccggcacaauuggggcugucucccucgauuuuagcccuggaaccucuggcucccccaucguggacagaaaagggaaggugguuggacuguacggcaauggcgucgugacacgcagcggggccuaugugucugcgauugcucagaccgagaaguccaucgaggauaacccugaaauugaggacgauaucuuccggaaaaagagacuuacaaucauggaccugcaucccggagccggcaaaacgaagcgcuaccugccugccauuguccgggaagcuaucaaaagagggcuccgcacccugauucuugccccgacacgggugguugcugccgagauggaagaggcgcugagaggacuccccauccgcuaucaaaccccugccauucgggcugagcacaccggcagagaaaucguggaccugaugugucaugccacauucacgaugcggcuccugagccccguccgcgugccuaacuacaaucuuauuaucauggaugaggcucacuuuaccgaccccgccuccaucgccgcuagaggguauauuucuacacggguugaaaugggcgaggcggccggaaucuucaugaccgcuacaccgccuggcagccgcgaucccuuuccccaguccaacgccccuauuauggacgaggaaagagagauccccgaacggagcuggaacucugggcacgagugggugaccgauuucaagggaaagacggucugguuugugccuuccauuaaagccggcaacgacaucgcugccugccugagaaagaaugggaaaaagguuauccagcugagccgcaaaacauucgauucugaauacgugaagacccgggcgaacgacugggauuuugucgugaccacagacauuagcgagaugggagcuaauuucaaggccgagagagugaucgauccgcgccgguguaugaaacccgucauucucaccgacggcgaagagagaguuauccuggccgggccuaugcccgugacacauuccucugcugcccaacgccggggcagaauuggacgcaacccuaagaaugaaaacgaccaguauaucuacaugggcgagccccuugaaaaugaugaggacugcgcgcacuggaaagaggccaagaugcugcucgauaacaucaauaccccggaagggauuaucccuagcauguuugagcccgaaagagagaaaguggacgcuauugauggagaauaccggcugcgcggcgaggccagaaagacguucgucgaccugaugcggcgcggggaucucccuguguggcuugcuuauagaguugccgcugagggaaucaacuacgccgaccggagaugguguuuugauggcauuaaaaauaaccagauccuggaagagaacguggaagucgagauuuggacaaaggagggggaacgcaagaaacugaagccccgguggcucgacgcgagaaucuauuccgauccucuggcccuuaaagaguucaaggaguucgcugccggccgcaaaucucugacccucaaucugaucacagagaugggacggcugcccaccuuuaugacgcagaaggcuagagacgcccucgauaaccuugccgugcugcauaccgcugaagcgggcgggaaggccuacaaucacgcucugagcgagcucccggagacacuggaaacccuucugcuccugacacugcucgccaccguuacaggaggcauuuuccuuuuucugauguccgggaaaggaaucggcaagaugacccugggcaugugcugcauuaucacggccagcauucuccugugguaugcucaaauccagccucacuggaucgccgcgucuauuauccuugaguucuuucugauugugcuccugauccccgaacccgagaaacagcggacaccucaggacaaccaacugaccuacgucgugauugccauccucaccgucguggcugccacaauggcuaaugaaaugggguuccuugagaagaccaaaaaggaccugggacugggcuccaucacaacgcaggagagcgaauccaacauucucgauaucgaccugcgcccggccucugcguggacccuuuaugccguugcuacaaccuuugugacacccaugcugagacauagcauugaaaauagcucugugaacgucagccucaccgccaucgcuaaucaggccacgguucugauggggcugggaaagggcuggccucucuccaaaauggauauuggggugccccuucuggcuaucggauguuacagccaggugaacccuauuacccugacagccgcgcuccugcuucuggucgcccacuacgcuaucaucggccccggccuccaagccaaggcuacccgggaagcccagaaacgcgccgcggcugggauuaugaagaauccuacaguggacggaaucaccguuauugaucuggagccgauccccuaugacccuaaauucgaaaagcagcugggccaggugaugcuccuuauucugugcgucacgcaagugcugaugaugagaacaaccugggcccucugugaggcucugacacuugccaccgggcccaucucuacccugugggagggaaacccuggccgguuuuggaauacaacgaucgccgucuccauggcuaacauuuuccgcgggagcuaccucgccggagcgggccugcuguuuucuaucaugaagaauaccacaaacaccagacggggcacagggaauauuggagaaacccucggcgagaaauggaagucccgccuuaacgcccuggggaaaagcgaguuccagaucuauaagaaaucuggcauucaggagguggauagaacgcuggcuaaggagggcaucaaaagaggggaaacagaccaucacgccguuagcagaggauccgcuaagcuccgcugguuuguggagcggaacauggucacccccgaaggcaaggugguugaucugggcugcgggagaggaggcuggucuuacuauugugggggacuuaaaaaugugcgcgaggucaagggccugaccaaagggggaccgggccaugaagaaccuauccccaugagcacauacggcuggaaccucgugcggcugcaauccgggguggacguuuucuucacacccccugagaagugcgauacacugcucugugacauuggagaaagcucccccaauccuacgaucgaggccggcagaacccuucgcguccugaaccugguggaaaauuggcucaacaauaacacacaguuuugcauuaaagugcugaauccguauaugcccucugucaucgagaagauggaaacccuucagcggaaguacgggggagcgcugguuagaaacccucucagccgcaauuccacacacgagauguacugggugucuaacgccaccggcaauauugugagcuccgucaacaugaucucucggaugcugaucaauagauucacgaugaaacacaagaaagcuaccuaugagcccgauguggaccuggggagcggaacacgcaacauuggcaucgaauccgagauuccuaaccucgacaucauuggcaagcggaucgagaagauuaagcaggagcaugaaaccagcuggcacuacgaucaagaccaucccuauaagacaugggccuaccacgggucuuaugagaccaaacagacaggauccgcuagcucuaugguuaauggcguggucagacuucugaccaagccgugggaugugguuccuauggugacgcagauggccaugacagacaccacccccuuugggcagcaacgcgucuucaaagagaagguggauacaagaacgcaggaaccuaaagagggaaccaagaagcugaugaaaaucacagcugaauggcucuggaaggagcugggcaaaaagaaaacaccccggauguguacacgcgaggaauuuaccagaaaggugcgguccaacgccgcgcuuggggccaucuucacagacgagaauaaauggaaaagcgcuagagaagccgucgaggauucucgguuuugggaacugguugaccgcgagagaaaccuccaccuggagggaaagugcgaaaccuguguguacaauaugaugggcaaacgggagaagaaacugggcgaguucgggaaggcuaaaggaucccgcgccauuugguauauguggcucggcgccagauuucuggaguucgaagcgcuuggguuucugaacgaggaucauugguucagccggggaaauucccucagcggcguggagggggaaggccugcaccgccuuggauacauccugagagacgucucuaagaaggagggcggggcuauguacgccgaugacacggccggaugggacacccggauuacacucgaagaucugaaaaacgaggaaauggugaccaaucauaugaagggcgagcacaaaaagcuggcugaggccaucuuuaaacucacauaucagaacaagguugugcgcguccagagaccuacaccccgggggacggugauggacauuaucagccgcagagaucaacggggauccggccagguugggacauacggccugaauaccuucacaaacauggaagcucagcuuauccgccaaauggagggagaaggcauuuucaagucuauccagcaucugaccgugacggaggagauugccguccagaauuggcucgcgagaguggggcgggaaagacugagccgcaugguuaucuccggagacgauugcguggucaaaccgcuugacgaucgguuugccucugcucugaccgcccucaacgacaugggcaaggugagaaaagauauucagcaaugggagccuagccgcggguggaaugacuggacacagguccccuucugcucccaccacuuucaugaacuggugaugaaggauggacggguucuggugguccccuguagaaaccaggacgagcucaucggccgcgcucggaucucucagggggccggcuggagccugaaagaaaccgcgugccuuggaaaguccuaugcccaaauguggacacugauguacuuccacagacgcgaucuccggcuggcugccaacgcuauuuguagcgccgugccuucucauugggugccgaccuccagaacaaccuggagcauccacgcuaagcacgaguggaugacgacagaggacaugcuugccguuuggaaucgcguguggauucaggaaaaccccuggauggaggacaaaaccccugucgaaucuugggaggaagugcccuaucugggcaagcgggaggaucaguggugcgggucccucaucggacugaccagcagagcgacaugggccaaaaauauucagaccgcuaucaaccaaguucggucccugauuggcaaugaggaauacacagacuauaugccuucuaugaagagauuucgccgggaggaagaggaagccggggugcucugguga

SEQ ID NO: 19862 - RNA, 9876 nt, Artificial Sequence
  derived and/or modified CDS sequence (opt5) from DENV-2__EU726767__SS-prME
agcgcuggcaugaucauuaugcugauccccaccgugauggcuuuccaccugacaacgagaaauggggagccucauaugauugucucccggcaggaaaagggaaaaucucugcuuuuuaagaccgaggacggcguuaauaugugcacacugauggccauggaucucggggaacugugugaggacaccaucacauacaaaugcccgcuucugcgccaaaacgaacccgaggauauugacuguuggugcaauagcaccuccacaugggugaccuauggaacgugugcgaccacaggcgagcacagacgggaaaagcgcucuguggcucucgucccucauguggggaugggacuggagaccagaacagaaaccuggaugagcuccgagggcgccuggaaacacgcccagcggaucgagacguggauccugcgccaucccggcuucacaauuauggcugccauccucgcuuacaccauugggacaacccacuuucagagagcccugaucuucauucuucugaccgcgguugccccuucuaugacaaugcggugcaucggaauuagcaaccgcgauuuuguggaaggcgucuccgggggaagcuggguggacaucguucucgagcacggcucuugugugacgaccauggcuaagaauaagcccacacuggauuucgaacuuaucaaaaccgaggccaagcagccugcuacacugagaaaauauugcauugaagccaagcucaccaacacgacaaccgagucccgguguccgacccaaggggagcccagccugaaagaagaacaagacaagcgcuuugucugcaagcauucuaugguggauagaggauggggcaauggcugugggcuguucggaaaaggcgggaucgugacaugcgcgauguuuaccugcaagaaaaacauggaaggaaagauuguccagccugagaaucucgaauacacaaucguugugacgccccacuccggcgaggagcaugccguggggaacgacaccggaaaacacggcaaggaaauuaaagucacaccucagagcucuaucaccgaggcugaacugacaggcuaugggaccgugacgauggaguguagcccccggaccggacuugauuucaaugaaaugguucugcuccaaauggagaacaaggccuggcuggugcaccgccagugguuucuugaccugccgcucccuuggcugcccggcgcugauacacaggggagcaauuggauccagaaggagacccuggucacauucaaaaacccucaugccaagaaacaagacgugguugugcucggaucccaggaaggcgccaugcacaccgcucugacgggggcgacagagauucagaugucuagcggcaaucuucuguuuaccggacaucucaagugcagacugcggauggacaaacuucaacugaagggcauguccuacagcauguguacagggaaguucaaagucgugaaggaaaucgccgagacccagcacggaaccauugucaucagagugcaguaugagggcgaugggucucccugcaaaauucccuucgaaaucauggaccucgagaagcgcuacguucugggacggcugaucacagugaacccuauugucacggaaaaagauuccccggugaacaucgaggcugaacccccuuuuggcgacagcuacauuaucauugggguugagcccggccagcucaagcugaauugguucaagaaaggaucuagcaucggccaaauguuugagaccacaaugagaggggccaagcgcauggccauucuuggagauaccgcuugggacuucggcucccucgggggaguguuuacaucuaucggcaaagcccuccaucaggucuucggggcgaucuauggcgcugccuuuagcggaguguccuggaccaugaagauucugaucggcgugauuaucacguggauugggaugaacagccggucuacaucccugagcguuucucuuguccucgugggaaucgugacccuguaccugggcgucauggugcaggccgauuccggguguguugugagcuggaaaaauaaggaacucaagugcggauccggcaucuucauuaccgacaacguccacacauggaccgagcaguauaaauuucaaccugaaucucccagcaagcuggcuuccgccauccagaaagcucaggaggaagggauuuguggcaucagaucugugacacgccuugagaaucugauguggaagcagauuacgccggagcucaaccacauccuggccgaaaaugagguuaaacugaccaucaugacaggagaugugaagggcauuaugcaagcggggaaacggagccuuagaccucagcccaccgaacucaaguacuccuggaagacauggggaaaagccaagaugcugagcaccgagucucauaaccagacguuccugaucgacggcccugaaaccgcugagugccccaauacaaaccgcgccuggaacucccucgaggucgaagauuauggguuuggaguguucaccacaaacauuuggcugaaacuuaaggagaaacaggacgcuuuuugugacagcaagcugaugucugccgcgaucaaggauaaucgggccguucacgcugacaugggcuacuggauugaauccgcccucaacgauaccuggaaaaucgagaaggcuagcuucaucgaggugaaaaauugccauuggccuaagucucacacacuguggagcaacggcguccuggaauccgagaugauuauccccaaaaaccuugccgggccggugagccaacacaauuauagaccuggauaccauacccagauugccggccccuggcaccucgggaagcuggaaauggacuucgauuuuugugagggaacgacaguggucguuaccgaagacugcggcaaccgcgggcccucucugcggaccacaaccgcuuccggaaagcucaucacggaguggugcuguagaagcugcacacugccuccgcuucgguaccgcggcgaggauggcuguugguaugggauggaaauuagaccccugaaagagaaggaagagaaucucgugaacucccuggugaccgcgggacauggccaggucgacaauuucucucugggggugcuuggaauggcccucuuucuggaagagaugcugcggacaagaguuggcaccaaacacgcuauccuccugguggccgucagcuucaugacacuuauuaccgggaacauguccuuuaaggaucugggacgcgugguugugauggucggcgccgcuaugacggacgauaucggcaugggggugaccuaccucgcccugcuggcggcuuucaaaguucggccuacauuugccgccggacuucugcucagaaagcugaccucuaaggagcucaugaugacaaccaucggcauugcucugcuuagccaauccacgauccccgaaacaauucuggagcucaccgacgcccuggcgcuggggaugauggugcuuaaaaugguccgcaauauggaaaaguaucagcuggcugugacaaucauggccauucucugcgugccuaacgccgucauccugcagaaugcuuggaaaguuucuuguaccauccucgccguggugagcgucagcccccugcuucugaccagcucucagcaaaagacagauuggauuccucucgcucugacgaucaaaggacugaaccccaccgccauuuuccuuacaacccuguccagaacaagcaagaaacggucuuggccgcucaaugaggcgaucauggccgugggcaugguuuccauucuggcuagcucucuccugaagaacgacaucccuaugaccgggccccuuguggccggaggccugcugacggucugcuacgugcucacaggccgcuccgcugaccuggaacuugagagagccaccgauguuaagugggaggaccaggccgaaaucagcggguccagcccuauucugucuaucaccauuagcgaggauggauccaugucuaucaaaaaugaagaggaggaacagacacucaccauucugauccggacaggccuccuggugauuagcgggcuuuuucccgucuccaucccgaucacggcugcggccugguaucugugggaggugaagaaacagcgcgcuggaguccugugggacgugccuucucccccucccaugggcaaggccgaacucgaggauggggccuacagaauuaaacaaaagggaauccugggcuauagccagauuggcgcugggguuuacaaggaaggaaccuuccauacaauguggcacgugacccggggcgccguccuuaugcacaaagggaagcgcaucgagcccuccugggcggacgugaaaaaggaucugauuucuuacggaggcggguggaaacucgagggagaauggaaggagggcgaagagguucaggugcuggcucucgaaccuggcaagaacccgagagccguccagacaaaacccgggcuguuuaagaccaaugccggaacgaucggcgcugugagccuugacuucuccccugggaccagcggaucucccaucauugauaaaaagggcaaagugguugggcuguauggaaacggcgucgugacacgguccggcgccuacgugagcgcgaucgcucaaaccgagaagucuauugaggacaacccugaaaucgaggaugacauuuuucgcaagagacggcugacaaucauggaucuccaucccggggccggaaaaaccaagagauaucugccugccaucguccgcgaagcuauuaaacggggccuuagaacacugauccucgccccgacgcgcgugguugcugccgagauggaagaggcgcugcgggggcuccccauuagauaccagaccccugccauccgcgcugagcacacaggacgggaaauuguggaccugaugugucaugccaccuucaccaugagacuucugucccccguccgcgugccuaauuauaaccugaucauuauggacgaggcucacuucacagaucccgccagcaucgccgcucggggcuacaucuccacgagaguugaaaugggggaggcggccggcauuuuuaugaccgcuacaccgccuggaucucgggaccccuucccccagagcaaugccccuaucauugaugaggaacgcgagauccccgaaagauccuggaacagcggccaugagugggugaccgacuuuaaggggaaaacagucugguucgugccuucuauuaaggccggaaaugauaucgcugccugccuccggaagaacggcaaaaagguuauccaacugucccgcaaaaccuuugacagcgaauaugugaagacgagaacaaaugauugggacuucgucgugaccaccgauauuucugagaugggggcgaacuuuaaagcugagcgggugaucgacccgagacgcuguaugaagcccgucauucuuacagauggagaggaacggguuauccuggccggcccuaugcccgugacccacagcuccgccgcucagagacgcgggcggauuggcagaaauccuaaaaacgaaaaugaccaguacaucuacaugggagagccccucgaaaacgacgaggauugcgcccacuggaaggaggcgaagaugcugcuggacaauaucaacacaccggaaggcauuaucccuucuauguucgagcccgaacgcgagaaaguggaugccauugacggggaauaucggcucagaggagaggcucgcaagaccuuugucgaucuuaugagacggggcgaccugccuguguggcuggccuacaaaguugcugccgaggggaucaauuaugcugaucgcagaugguguuucgacggaauuaagaacaaccagauccucgaagagaauguggaagucgagauuuggacgaaagagggcgaacggaagaagcugaaaccccgcuggcuugaugccagaaucuacagcgacccucuggcgcucaaggaguuuaaagaguucgccgcugggcggaagucccugacacugaaccucaucaccgagaugggcagacuucccacauucaugacccagaagacgcgcgaugcccuggacaaucuggcugugcuccauaccgccgaagccggaggccgggcuuauaaccacgcgcugucugagcuuccggagacacuggaaacccuccugcugcucacacuucuggccaccguuacagggggaauuuuucuguuccucaugagcggcagagggaucggaaagaugacccugggcaugugcugcauuaucacggcuuccauucuucugugguacgcccagauccagccucauuggaucgccgcuagcauuauccucgaguuuuuccugauugugcugcucauccccgaacccgagaagcagcgcacaccucaagauaaucagcuuaccuaugucgugauugccauccugaccgucguggcggccacaauggcuaacgaaaugggcuuucuggagaaaaccaagaaagaccucgggcugggaucuaucguuacacagcagccggaguccaauauucuugacaucgaucugcggcccgccagcgcuuggacgcucuacgccguggcgaccacauucgugaccccuaugcugagacacuccauugaaaacucuagcgucaauguuucccugacagccaucgcuaaccaagccaccgugcucaugggccuugggaagggauggccccugucuaaaauggacauuggcgugccucugcucgcuaucggguguuacagccaggucaaucccauuacgcugaccgccgcccuucugcuccugguggcccacuaugcgaucaucggaccuggccugcaggccaaggcuacacgggaggcccagaagcgcgcugccgccggcauuaugaaaaacccgaccguugaugggaucacagugauugaccucgaucccaucccuuacgaccccaaguuugaaaaacaacuuggacaggucaugcugcuggugcucugcgucacccaggugcugaugaugagaacgacaugggcgcuuugugaggcucugacccucgccacaggcccuauuuccacccugugggaagggaaucccggacgguucuggaacaccacaaucgcuguuagcauggccaauaucuuucgcggcucuuaucuggccggggcuggacuccuuuucuccauuaugaagaacacgaccaauacaagacggggcaccggcaacaucggggagacacugggagagaaauggaagucccgccugaacgcccucggcaaaucugaauuucaaauuuacaagaaguccgggauccaggagguggauagaacccuggcgaaagaaggaauuaagcggggcgagacggaccaucacgccgucagccgcgggucugcuaaacuuagaugguucguggagcggaauaugguuacaccggaaggaaagguggucgaucugggcugcggcagagggggauggagcuauuacuguggcgggcucaaaaacgugcgcgaggugaagggacugaccaagggcgggccuggacaugaagaacccauccccauguccaccuauggcuggaaucugguucggcuccagucuggcgucgacguguuuuucaucccucccgaaaaaugcgauacacuucugugugacauuggggagagcuccccuaacccgaccguggaggccggaagaacacugcgcguccucaaucugguugaaaacuggcuuaauaacaauacgcaguucugcaucaaggugcugaaccccuacaugccuagcgugauugagaaaauggaagcucuccaacggaaguacggcggggcccuggucagaaauccccugucccgcaacucuacccacgagauguauugggugagcaaugcguccggaaacaucguuucuagcgugaauaugauuucccggaugcucaucaacagauuuacaaugcgccauaaaaaggccaccuacgaaccugaugucgaccuuggcucugggacacggaacaucggaauugagagcgagauccccaaucuggacauuaucggcaagagaauugagaaaaucaagcaggagcacgaaaccuccuggcacuaugaucaggaccauccguacaaaacgugggcuuaucacggcagcuacgagaccaagcagacagggucugccuccagcauggugaacggaguugugcgccugcucaccaaaccuugggauguccugcccacagugacccaaauggcuaugacagacaccacgccuuucggccagcagcggguguuuaaggaaaaggucgauacaagaacccaggagcccaaagaggggaccaagaaacuuaugaagauuacagccgaauggcuguggaaagagcucggaaagaaaaagacgccucgcauguguaccagagaagaguucacacggaagguucgcucuaaugcugcccugggcgcgguguuuaccgacgagaacaaauggaaguccgccagagaagcuguggaggauagccgguucugggaacuggucgacaaagagagaucucuccaucuggaagggaagugcgagacauguguguauaauaugaugggaaaacgggagaagaaacuuggcgaauuuggcaaagccaaggggucccgcgcuaucugguacauguggcugggagccagauuccucgaguuugaagcccugggcuuccuuaacgaggaucacugguuuagccgggaaaauucccugagcgggguugagggagagggccuccacaaacugggguacauccugcgcgacgugucuaagaaagaaggcggagcgauguaugcugaugacaccgccggcugggacacaagaauuacccucgaggaucugaagaacgaagagauggucacgaaucauauggaaggggagcacaagaaacuugccgaggcuaucuucaagcugaccuaccaaaacaaagugguucgggugcagcgccccacaccgagaggaaccgucauggacauuaucagccggcgcgaucagagaggcuccgggcaagugggaacauauggccucaauaccuuuacgaacauggaagcccagcugauucggcagauggagggggaaggcguuuucaagaauauccagcaucuuacagugaccgaggagaucgcuguccaaaacuggcuggcccgcgugggaagagaacggcucucucgcauggcgauuagcggcgacgauugcgucgugaaaccucuggacgauagauucgccuccgcucugacagcccucaaugacauggggaagauccggaaggauauucagcagugggagcccucuagaggauggaacgacuggacccagguucccuuuugcagccaccauuuccacgaacugaucaugaaagauggccgcgugcuugucgugccuugucggaaccaagacgagcugauugggagagcucgcaucucccagggagccggcuggucucuccgggaaacggcgugccuggggaaguccuacgcccagauguggucccuuauguauuuucacagacgcgaucugcggcucgcugccaaugcuaucuguagcgccgugccgucucauuggguucccaccuccagaacaaccuggagcauucacgcuaaacaugaguggaugacaaccgaggacaugcugacaguguggaaccgcgucuggauccaggaaaauccuuggauggaggacaagacccccguggaaucuugggaggaaauuccuuaccugggcaaacgggaggaucaauggugcggaucccucaucggccugacgagcagagccacaugggcgaagaacauucaggccgcuaucaaucagguucgcucccuuauugggaacgaggaauauaccgacuacaugcccucuaugaagcgguucagacgggaggaagaggaagccggagugcugugguga

SEQ ID NO: 19863 - RNA, 9876 nt, Artificial Sequence
  derived and/or modified CDS sequence (opt5) from DENV-2__EU687246__SS-prME
uccgccggaaugaucauuaugcugauccccaccgugauggcuuuccaccugacgacgcggaauggggagccucauaugauugucuccauccaggaaaagggaaaaucucugcuuuuuaagaccgaggacggcguuaauaugugcacacugauggccauggaucucggggaacugugugaggacaccauuacauacaaaugcccgcuucugcggcaaaaugaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggauguccuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaggaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcaaaauccccuucgaaaucauggaccucgagaagagauacguucugggacgccugauuacggugaacccuaucgucaccgaaaaagauuccccggugaacauugaggccgaacccccuuuuggcgacagcuacaucauuaucgggguugagcccggccagcucaagcugaauugguucaagaaaggaucuagcauuggccaaauguuugagacaaccaugagaggggcuaagagaauggccauccuuggagauacagccugggacuucggcucccucgggggaguguuuaccucuaucggcaaagcucuccaucaggucuucggggccauuuauggcgcggcuuuuagcggaguguccuggacgaugaagauccugauuggcgugaucauuacauggaucgggaugaacagccgcucuaccucccugagcguuucucuuguccucgugggaaucgugacccuguaccugggcgucauggugcaggccgauuccggguguguugugagcuggaaaaauaaggaacucaagugcggauccggcauuuucaucacagacaacguccacaccuggacagagcaguauaaauuucaaccugaaucucccagcaagcuggccuccgcuauucagaaagcccaggaggaagggaucuguggcauucggucugugacgagacuugagaaucugauguggaagcagaucaccccggagcucaaccacauccuggcugaaaaugagguuaaacugacaauuaugaccggagauaucaagggcauuaugcaagccgggaaacgcagccuucggccucagcccacagaacucaaguacuccuggaagaccuggggaaaagcgaagaugcugagcacggagucucauaaccagaccuuccugaucgacggcccugaaacagccgagugccccaauaccaacagagcuuggaacucccucgagguggaagauuauggguuuggagucuucacaaccaacauuuggcugaaacuuaaggagaaacaggacgccuuuugugacagcaagcugaugucugcugccaucaaggauaaucgcgcggugcacgccgacaugggcuacuggaucgaauccgcucucaacgauacauggaaaauugagaaggccagcuucaucgagguuaaaaauugccauuggccuaagucucacacccuguggagcaacggcgugcuggaauccgagaugauuauccccaaaaaccuugcugggccggucagccaacacaauuaucggccuggauaccauacgcagauugccggccccuggcaccucgggaagcuggaaauggacuucgauuuuugugacggaacaaccgugguggucaccgaggauugcggcaacagagggcccucucugcgcacaaccacggccuccggaaagcucaucacagaauggugcugucggagcugcacccugccuccgcuuagauaccggggcgaggacggcuguugguaugggauggagauucgcccccugaaagaaaaggaggaaaaucucguuaacucccuggugacagcuggacauggccagguggauaauuucucucuggggguccuuggaauggcgcucuuucuggaggaaaugcugagaacccgggugggcacaaaacacgccauccuccugguugcucuuagcuucgugacccugaucacggggaacauguccuuuaaggaccucggaagagucgugguuauggugggcgccaccaugacagaugacauuggcaugggggucaccuaccuggcccugcuugcugccuucaaagugcgcccuacauuugcggcuggacugcuccugcggaagcucaccucuaaggagcugaugaugacgacaaucggcauuguucuucugagccaauccaauauccccgagaccauucucgaacugacagaugcccuggcccuugggaugauggugcugaaaaucgucagagacauggagaaguaucagcucgcugugaccaucauggccauucugugcgugccuaacgcggucauccuccagaaugcuuggaaaguuucuuguaccauucuggccguggugagcgucagcccccuucugcucacaagcucucagcaaaagacggacuggaucccucuggcccugaccauuaaaggacuuaaccccacagcuaucuuccugaccacacucucccgcaccaauaagaaaagaagcuggccgcugaacgaagccaucauggcugugggcaugguuucuauucucgccuccagccugcuuaagaaugauaucccuaugacggggccccugguggcgggaggccugcucacagucugcuacgugcugaccggccggucugccgaccuugagcuggaacgcgcuaccgauguuaagugggaggaccaggccgagauuuccgggagcuccccuauccucagcauuacaaucucugaagauggaagcauguccauuaaaaacgaggaagaggagcagacccugacaauccucaucagaacgggccugcuugugauuucugggcuguuucccgucagcaucccgauuaccgcugccgccugguaucugugggaagugaagaaacagcgggcuggaguccucugggacgugccuucucccccucccaugggcaaggcggagcuggaagauggggccuaccgcaucaaacaaaagggcauucuuggcuauagccagaucggcgcugggguuuacaaggagggaacauuccauaccauguggcacgugacaagaggcgccguccugaugcacaaagggaagcggaucgaacccagcugggccgacgugaaaaaggaucucauuuccuacggaggcggguggaaacuggagggagaguggaaggaaggcgaggaaguucaggugcucgcucuggagccuggcaagaauccgcgcgccguccagaccaaacccgggcuuuuuaagacgaacaccggaacaaucggcgcggugucucuggacuucagcccugggaccuccggaagccccauuaucgauaaaaagggcaaagugguugggcuguauggaaacggcgucgugacaagaucuggcgcuuacguguccgccauugcccaaaccgaaaagagcaucgaggacaauccugauaucgaggacgacauuuuucggaagcgcagacucacaaucauggaucugcaucccggggcuggaaaaacgaagcgguaucuuccugccauugucagagaagcgaucaaacgcggccugcggacccucauucuggcuccgacaagagugguugccgccgagauggaagaggcucuccgcgggcugcccauccgguaccagaccccugccauuagagcugaacacaccggacgcgagaucguggaccuuaugugucaugccacauucacgaugcggcugcugucucccgucagagugccuaacuauaaucucaucauuauggaugaggcgcacuucaccgaccccgccuccaucgcugcccgcggcuacauuagcacacggguugaaaugggggaggcugccggcaucuuuaugaccgccacaccgccuggauccagagaucccuucccccagucuaacgcuccuauuaucgacgaggaacgggagauccccgaacgcagcuggaacuccggccaugagugggugaccgauuuuaaggggaaaacggucugguucgugccuagcauuaaggcgggaaacgacaucgccgcuugccugagaaagaauggcaaaaagguuauucaacuuucucggaaaacauuugauuccgaauauaucaagacccgcaccaacgacugggauuucguggucacaaccgacauuagcgagaugggggccaauuuuaaagccgaaagagugaucgacccgcggagauguaugaagcccgugauccugacagauggagaggagcgcgucauucucgcuggcccuaugcccguuacccacucuagcgccgcgcagcggagagggcgcaucggccggaacccuaaaaaugaaaacgaccaguacauuuacaugggagagccccuggaaaaugaugaggacugcgcucacuggaaggaagccaagaugcugcucgauaacaucaauacgccggagggcauuaucccuuccauguucgagcccgaaagagagaaaguggacgccauugauggggaauaucgccuucggggagaggcuagaaagacauuuguggaccugaugcgcagaggcgaucugccugucuggcucgccuacaaaguggcggccgaagggaucaacuaugcugaccggcgcugguguuucgauggaaucaagaacaaucagauucuggaggagaacguugaaguggagaucuggaccaaagaaggcgagagaaagaaacuuaaaccccgguggcuggacgcccgcauuuacucugauccucucgcucugaaggaguuuaaagaguucgccgcugggagaaagagccugacacucaaucuuaucaccgagaugggccggcugcccacguucaugacccagaagaccagagacgcccuggacaaccucgcgguccugcauaccgccgaagcuggaggccgcgccuauaaucacgcucuuuccgagcugccggaaacacucgagacccugcugcuccuuacacugcuggccaccgugacagggggaauuuuucucuuccugaugucuggccgggggaucggaaagaugacacuuggcaugugcugcaucauuaccgccagcauccugcucugguacgcucagauucagccucauuggaucgcggccuccauuauccuggaguuuuuccugaucguucuccuuauucccgaacccgagaagcagagaaccccucaagauaaccagcugacauauguggucaucgcuauucugaccguggucgccgccacaauggcuaaugaaaugggcuuucucgagaaaacgaagaaagaccuggggcuuggaagcaucgccacccagcagccggaaucuaacauucuggauaucgaccuccgccccgcguccgccuggacacuguacgcuguggccaccacauucauuaccccuaugcugcggcacagcaucgaaaauuccucuguuaacgugagccucacggcuaucgccaaucaagcgaccgugcuuaugggccuggggaagggauggccccuguccaaaauggauauuggcgucccucuccuggccaucggguguuacucucagguuaaccccauuacacuuaccgcugcccugcuccugcugaucgcucacuaugccauuaucggaccuggccuccaggcuaaggccacaagagaggcgcagaagcgggccgcugccggcaucaugaaaaauccgaccguggacgggauuacggugaucgaucuugaccccauuccuuacgaucccaaguuugaaaaacaacugggacaggucaugcugcucgugcugugcguuacacaggugcuuaugaugcgcaccacaugggcucugugugaggcccucacccuggccaccggcccuaucagcacacugugggaagggaaccccggaagauucuggaauacgaccauugcggucuccauggcuaacaucuuucggggcagcuaucucgccggggcuggacuucuguucucuaucaugaagaauacaaccaacacacgcagaggcaccggcaacauuggggagacgcugggagaaaaauggaagucccggcucaaugcccugggcaaaagcgaguuucaaaucuacaagaagucugggauucaggagguggaccgcacacuugccaaagaaggaaucaagagaggcgagaccgaucaucacgcugucucccgggggagcgccaaacugcgcugguucguggaaagaaacaugguuaccccggagggaaagguggucgaccucggcugcggcagagggggauggucuuauuacuguggcgggcugaaaaaugugcgggagguuaagggacugacaaagggcgggccuggacaugaggaacccauucccaugagcaccuauggcuggaaccucgugcgccuucaguccggcgucgauguguuuuucaucccucccgaaaaaugcgacacacugcugugugacaucggggagucuagcccuaauccgacgguggaagcgggacggacccucagaguucugaaccuugucgagaauuggcugaacaauaacacacaguucugcauuaaggugcucaaucccuacaugccuuccgugaucgagaaaauggaaacccugcaacgcaaguacggcggggcccugguccggaacccccucagcagaaauuccacacacgagauguauuggguuucuaacgcuagcggaaauauuguguccucugugaacaugaucagccgcaugcuuauuaaccgguuuaccaugagacauaaaaaggccacguacgaaccugaugucgaccugggcuccgggacccgcaauaucggaauugagucugaaauccccaaccuggauaucauuggcaagcggaucgagaaaauuaagcaggagcacgaaacaagcuggcacuaugaccaggaucauccguacaaaaccugggcuuaucacggcuccuacgagacaaagcagaccgggagcgccucuuccauggugaauggaguugugagacuccugacaaaaccuugggacguccuucccaccgugacgcaaauggcgaugacagauaccaccccuuucggccagcagcgcguuuuuaaggaaaagguggacacacggacgcaggagcccaaagaagggaccaagaaacugaugaagaucacagccgaguggcucuggaaagagcugggaaagaaaaagaccccuagaauguguacacgcgaagaguucaccagaaagguccggagcaacgcugcccugggcgcuauuuuuacagaugaaaauaaauggaagucugcccgcgaggcuguggaggacuccagauucugggaacucguggauaaagagcggaaccugcaucuugaagggaagugcgagaccugugucuauaauaugaugggaaaaagagaaaagaagcugggcgaguuuggcaaagccaaggggagccgggcgaucugguacauguggcucggagcccgcuuccuggaguuugaagcucuuggcuuccugaacgaggaccacugguuuucuagagaaaauucccucagcgggguugagggagaaggccugcacaaacugggguacauccuccgggacguguccaagaaagagggcggagccauguaugcugaugacacggccggcugggauacccgcauuacacuggaggaccuuaagaacgaagagauggugaccaaucauauggaaggggagcacaagaaacuggccgaagcgaucuucaagcucacauaccaaaacaaagucgugagaguucagcggcccaccccgcgcggaacggugauggauauuaucagcagacgggaccagcgcggcucugggcaagucggaacauauggccugaauaccuuuacaaacauggaggcucagcuuauuagacagauggagggggaaggcguguucaagaauauccagcaucugaccguuacggaggaaaucgccgugcaaaacuggcucgcccgggucggacgcgagagacugagccggauggcuauuuccggcgaugacugcgugguuaaaccucuggaugaccgcuucgccucugcucucaccgcccugaacgauauggggaagaucagaaaggacauucagcagugggagcccagccggggauggaaugauuggacacaggugcccuuuugcucccaccauuuccacgaacuuaucaugaaagacggcagaguccugguggucccuugucgcaaccaagacgagcucauugggcgggcgagaaucucucagggagccggcuggagccugcgcgaaaccgcuugccuugggaaguccuacgcccagauguggucucugauguauuuucaccggagagaucuccgccuggcugccaaugcgauuuguagcgccgugccgucccauuggguucccacaagccggaccacauggucuauccacgcuaaacaugaguggaugaccacggaagacaugcugacaguguggaacagagucuggauccaggagaauccuuggauggaggauaagacccccguggaauccugggaggaaauuccuuaccucggcaaacgcgaggaccaauggugcggaagccugaucggccuuaccucucgggccacaugggcuaagaacauucaggccgcuaucaaucaggugagaucccugauugggagcgaagaguauaccgauuacaugcccuccaugaagcgcuuccggagagaggaagaggaagccggaguucucugguga

SEQ ID NO: 19864 - RNA, 9876 nt, Artificial Sequence
  derived and/or modified CDS sequence (opt5) from DENV-2__FJ639828__SS-prME
agcgugggaaugaucauuaugcugauccccaccgucauggccuuccaccugacgacgcggaauggggagccucauaugauuguuuccauccaggaaaagggaaagucucugcuuuuuaagaccgaggacggcgugaauaugugcacacugauggcuauggaucuuggggaacugugugaggacaccauuacauacaaaugcccgcuucugcggcaaaacgaacccgaggauaucgacuguuggugcaauuccaccuccacaugggugaccuauggaacguguaccacaaccggcgagcaccgcagagaaaagcggucugucgcccucgugccucauguugggaugggacuggagacacgcaccgaaacguggaugagcuccgagggcgcguggaaacacgcucagagaaucgagacauggauucugcggcaucccggcuucaccaucauggccgccauucucgcuuacacaaucgggaccacccacuuucagcgcacacugauuuucauccuucugacggccguggcuccuucuaugaccaugagaugcauuggaaucagcaaccgggauuuugucgaaggcguguccgggggaagcuggguugacaucgugcucgagcacggcucuugugucacaaccauggccaagaauaagcccacacuggauuucgaacuuauuaaaaccgaggcgaagcagccugccacgcugcgcaaauauugcaucgaagcuaagcucacaaacaccaccacagaguccagauguccgacccaaggggagcccagccugaaagaagaacaggacaagcgguuugugugcaagcauucuaugguggaucgcggauggggcaauggcugugggcuguucggaaaaggcgggauugucacaugcgccauguuuacgugcaagaaaaacauggaaggaaagaucguucagccugagaaucucgaauacaccauuguggugacaccccacuccggcgaggagcaugcugucgggaacgacaccggaaaacacggcaaggaaaucaaagugacaccucagagcucuaucaccgaggccgaacugacgggcuaugggaccguuacaauggaguguucccccagaaccggacuugauuucaaugaaauggugcugcuccaaauggagaacaaggcguggcugguccaccggcagugguuucuugaccugccgcucccuuggcugcccggcgccgauacacaggggagcaauuggauucagaaggagacccuggugacguucaaaaacccucaugcuaagaaacaagacguugugguccucggaucccaggaaggcgccaugcacacagcucugaccggggccacagagauccagaugucuagcggcaaucuucuguuuaccggacaucucaagugccgccugagaauggacaaacuucaacugaagggcauguccuacagcauguguaccgggaaguucaaaguggucaaggaaauugccgagacacagcacggaacgaucgugauucggguucaguaugagggcgaugggucucccugcaaaauccccuucgaaaucauggaccucgagaagagauacgugcugggacgccugauuaccgucaacccuaucgcuacagaaaaagauuccccggugaacauugaggcggaacccccuuuuggcgacagcuacaucauuaucgggguugagcccggccagcucaagcugaauugguucaagaaaggaucuagcauuggccaaauguuugagaccacaaugagaggggccaagagaauggcuauccuuggagauaccgccugggacuucggcucccucgggggaguguuuacgucuaucggcaaagcccuccaucaggucuucggggcuauuuauggcgccgcguuuagcggaguguccuggacaaugaagauccugauuggcgugaucauuaccuggaucgggaugaacagccgcucuaccucccugagcguuucucuuguccucgugggaguggucacacuguaccugggcgugaugguucaggcugauuccggguguguggucagcuggaaaaauaaggaacucaagugcggauccggcaucuucauuaccgacaacgugcacacauggacggagcaguauaaauuucaaccugaaucucccagcaagcuggccuccgccauccagaaagcucaggaggaagggauuuguggcauccggucuguuaccagacuugagaaucugauguggaagcagauuacaccggagcucaaccacauccuggccgaaaaugaggugaaacugaccaucaugacaggagauauuaagggcaucaugcaagcugggaaacgcagccuucggccucagcccaccgaacucaaguacuccuggaagacguggggaaaagccaagaugcugagcaccgagucucauaaccagacauuccugauugacggcccugaaaccgcggagugccccaauacaaacagagccuggaacucccucgaggucgaagauuauggguuuggaguguucaccacaaacaucuggcugaaacuuaaggagaaacaggacgcuuuuugugacagcaagcugaugucugccgcuauuaaggauaaucgcgccguucacgcggacaugggcuacuggaucgaauccgcccucaacgauaccuggaaaaucgagaaggcuagcuucauugaggugaaaaauugccauuggccuaagucucacacgcuguggagcaacggcguccuggaauccgagaugaucauucccaaaaaccuugccgggccggugagccaacacaauuaucggccuggauaccauacacagaucgcuggccccuggcaccucgggaagcuggaaauggacuucgauuuuugugacggaaccaccguggucguuacagaggauugcggcaacagagggcccucucugcgcaccacgacagccuccggaaagcucauuaccgaauggugcugucggagcugcacacugccuccgcuuagauaccggggcgaggacggcuguugguaugggauggagauccgcccccugaaagaaaaggaggaaaaucucgugaacucccuggugaccgccggacauggccaggucgauaauuucucucugggggugcuuggaauggcucucuuucuggaggaaaugcugagaacacggguuggcaccaaacacgcgauucuccugguggccgucagcuucgugacgcuuaucaccgggaacauguccuuuaaggaccugggaagaguuguggucauggugggcgcuacaaugaccgaugacaucggcauggggguuacauaccucgcccugcuggccgcuuucaaagugcgcccuaccuuugccgcgggacuuuuccugcggaagcucacgucuaaggagcugaugaugacaaccauuggcaucguccuccugagccaauccacacuucccgagaccauucuggaacucaccgaugcucuggcccuggggaugauggugcuuaaaauggugagagacauggagaaguaucagcuggccgucacaaucauggcuauucucugcguuccuaaugccgugauccugcagaacgcguggaaagugucuuguacgauccucgcugucgugagcguuagcccccugcuucugaccagcucucagcaaaagacagacuggauuccucucgcccugaccaucaaaggacugaaucccacagccauuuuucuuaccacgcugucccgcacaaacaagaaaagaagcuggccgcucaaugaagcuaucauggccgugggcauggucucuauucuggcuuccagccuccugaagaacgauaucccuaugaccgggccccuuguggccggaggccugcugaccguuugcuacgugcucacaggccggucugcggaccuggagcuugaacgcgccaccgaugucaagugggaggaccaggcugagaucuccgggagcuccccuauucugagcaucacaauuucugaagauggaagcauguccaucaaaaaugaggaagaggagcagacgcucaccauucugaucagaacaggccuccuggugauuucugggcuuuuccccgucagcaucccgaucaccgccgcugccugguaucugugggaagugaagaaacagcgggccggaguucugugggacgugccuucucccccucccaugggcaaggcugagcucgaagauggggcguaccgcauuaaacaaagaggaauccugggcuauagccagauuggcgccggggucuacaaggagggaacauuucauaccauguggcacgugacgcggggcgcuguucuuacccacaaggggaaacgcaucgaacccagcugggccgacgugaagaaagaucugauuuccuacggaggcggguggaagcucgagggagaguggaaagaaggcgaggaaguccaggugcuggcccucgagccuggcaagaacccgagagcugugcagacaaagcccgggcuguucaaaaccaauacaggaaccaucggcgccguuucucuugacuuuagcccugggacauccggaagccccaucauugauaagaaaggcaaggucguggggcuguauggaaacggcguggucacgcggucuggcgcguacguguccgcuaucgcccaaaccgagaaguccauugaggacaacccugauaucgaggacgacauuuuccgcaagagacggcugacaaucauggaucuccaucccggggccggaaagaccaaaagauaucugccugcuaucguucgcgaagccauuaagcggggccuuagaacccugauccucgcgccgacacgcguggucgcugccgagauggaagaggcccugcgggggcuccccauuagauaccagacgccugcuauccgcgccgaacacaccggacgggagauuguggaccugaugugucaugcuacauucaccaugagacuucugucucccguucgcgugccuaauuauaaccugaucauuauggaugaggcccacuuuacagaccccgcguccaucgccgcucggggcuacaucagcaccagagucgaaaugggggaggccgcuggcauuuucaugacggccacaccgccuggaucccgggaucccuuuccccagucuaaugccccuaucauugacgaagaacgcgagauccccgaaagaagcuggaacuccggccaugagugggugaccgauuucaaagggaagaccguuugguuugugccuagcauuaaagcuggaaaugacaucgcggccugccuccggaagaacggcaagaaagucauccaacugucucgcaagacauucgauuccgaauaugugaaaaccagaacaaaugacugggauuuuguggucaccacggacauuagcgagaugggggcuaacuucaaggccgaacggguuaucgacccgagacgcuguaugaaacccgugauucuuacagauggagaggagcgggugauccuggccggcccuaugcccgucacccacucuagcgcugcccagagacgcgggcggauuggcagaaauccuaagaacgaaaaugaccaguacaucuacaugggagagccccucgaaaacgaugaggacugcgcgcacuggaaagaagcuaagaugcugcuggauaauaucaacacaccggagggcauuaucccuuccauguuugagcccgaacgcgagaagguggacgccauugauggggaauaucggcucagaggagaggcccgcaaaaccuucguugaccuuaugagacggggcgaucugccuguguggcuggcuuacaaggucgccgcggaagggaucaauuaugccgaccgcagaugguguuuugauggaauuaaaaacaaccagauccucgaggagaauguggaaguugagauuuggacgaaggaaggcgagcggaaaaagcugaagccccgcuggcuugacgcuagaaucuacucugauccucuggcccucaaagaguucaaggaguucgcugccgggcggaaaagccugacccugaaccucaucacagagaugggcagacuucccaccuuuaugacacaaaagacccgcgacgcucuggacaaucuggccgugcuccauacagcggaagccggaggccgggcuuauaaccacgcccuguccgagcuuccggaaacccuggagacgcuccugcugcucacacuucuggcuaccgucaccgggggaauuuuccuguuucucaugucuggcagagggaucggaaaaaugacacugggcaugugcugcauugugaccgccagcauccuucugugguacgcccagauucagccucauuggaucgcugcguccaucauucucgaguucuuucugaucguccugcucauucccgaacccgagaagcagcgcacaccucaagauaaucagcuuacguaugugguuaucgccauucugaccgugguggcugccacaauggccaacgaaaugggcuuccuggagaagaccaaaaaggaccucgggcugggaagcaucgcuacacagcagccggaaucuaauauccuugauauugaccugcggcccgccuccgcguggacccucuacgccgucgcuacgaccuuuguuacaccuaugcugagacacagcaucgagaacuccucugugaaugugagccugaccgccauugcuaaccaagccacaguccucaugggccuugggaaaggauggccccuguccaagauggauaucggcgcgccucugcucgccauuggguguuacucucaggugaaucccaucacccugacggcugcccuucugcuccugguugcucacuaugccauuaucggaccuggccugcaggcuaaagccacacgggaggcgcagaagcgcgccgcugccggcaucaugaagaacccgaccguggacgggauuacagucaucgaucucgaccccauuccuuacgaucccaaauucgaaaagcaacuuggacaggugaugcugcugguccucugcgugacccagguucugaugaugagaaccacaugggcucuuugugaggcccugacgcucgccaccggcccuaucagcacacugugggaagggaaucccggacgguuuuggaacaccacaauugcgguguccauggcuaauaucuuccgcggcagcuaucuggccggggcuggacuccucuuuucuaucaugaaaaacaccacaaauuccagacggggcacaggcaacauuggggagacccugggagaaaaguggaaaagccgccugaacgcccucggcaagucugaguuccaaaucuacaaaaaguccgggauucaggaggucgacagaacccuggccaaggaaggaaucaaacggggcgagacagaucaucacgcugugagccgcgggucugccaaacuuagaugguuuguugaacggaauauggugaccccggagggaaaagucguggaccugggcugcggcagagggggauggagcuauuacuguggcgggcucaagaacgugcgcgagguuaaaggacugacaaagggcgggccuggacaugaagaacccauucccauguccacguauggcuggaaucugguccggcuccagucuggcguggauguguucuucaucccucccgaaaagugcgacacccuucugugugacaucggggagagcuccccuaacccgacagucgaagcgggaagaacccugcgcguucucaaucugguggagaacuggcuuaauaacaauacacaguuuugcauuaaagugcugaaccccuacaugccuagcgucaucgagaagauggaaacccuccaacggaaauacggcggggcccuggugagaaauccccugucccgcaacucuacgcacgagauguauuggguuagcaaugcuuccggaaacauugugucuagcgucaauaugaucucccggaugcucauuaacagauucaccaugcgccauaagaaagccacauacgaaccugauguggaccuuggcucugggacccggaacaucggaaucgagagcgaaauucccaaucuggauaucauuggcaagagaaucgagaagauuaaacaggagcacgaaacauccuggcacuaugaccaggaucauccguacaagaccugggcuuaucacggcagcuacgagacaaaacagaccgggucugccuccagcaugguuaacggagugguccgccugcucacgaagccuugggacgugcugcccacagugacccaaauggcgaugaccgauacaacgccuuuuggccagcagcgggucuucaaagaaaagguugacaccagaacacaggagcccaaggaagggaccaagaaacuuaugaaaaucacagccgaguggcuguggaaagagcucggcaagaagaaaaccccucgcauguguacaagagaagaguuuacccggaaggugcgcucuaaugcugcccugggcgcuauuuucacggaugaaaacaaguggaaauccgccagagaggcuguggaggacagccgguuuugggaacuggucgauaaggagagaaaucuccaucuggaagggaaaugcgagaccuguguguauaacaugaugggaaagcgggagaagaaacuuggcgaguucggcaaggccaaagggucucgcgcgaucugguacauguggcugggagccagauuucucgaguucgaagcucugggcuuucuuaaugaggaccacugguucucccgggaaaacagccuguccgggguugagggagaaggccuccaccgccugggguacauccugagagacgugagcaagaaagagggcggagccauguaugcugaugacacagccggcugggauacccggauuacacucgaggaccugaagaaugaagagauggucaccaaccauauggaaggggagcacaagaaacuugccgaagcgaucuuuaaacugacguaccaaaauaaagugguucgcgugcagagacccacaccgcggggaaccgucauggauauuaucucucgcagagaccagcggggcagcgggcaagugggaacauauggccucaacaccuucacgaauauggaggcucagcugauucgccagauggagggggaaggcguuuucaagaacauccagcaucuuaccgugacagaggaaaucgccguccaaaauuggcuggccagagugggacgggagcgccucuccagaauggcuauuucuggcgaugacugcgucgugaaaccucuggaugaccgguuugccagcgcucugaccgcccucaacgauauggggaagaucagaaaagacauucagcagugggagcccucccgcggauggaacgauuggacacagguucccuucugcucucaccauuuucacgaacugaucaugaaggacggccgggugcuugucgugccuuguagaaaucaagacgagcugauugggcgcgcgcggaucagccagggagccggcuggucccucagagaaaccgcuugccuggggaagucuuacgcccagauguggagccuuauguauuuccaccgccgggaucugagacucgcugccaacgcgaucuguuccgccgugccgagccauuggguucccacaucucgcaccacgugguccauucacgcuaaacaugaguggaugacaaccgaagacaugcugaccguguggaaucgggucuggauccaggagaacccuuggauggaggauaagacacccguggaaagcugggaggaaauuccuuaccugggcaaaagagaggaccaauggugcggaucucucaucggccugaccucccgcgccacaugggcuaagaauauucaggccgcuaucaaccagguucggagccuuauugggaaugaagaguauacggauuacaugcccuccaugaaaagauuucggagagaggaagaggaagccggagugcugugguga

SEQ ID NO: 19865 - RNA, 9876 nt, Artificial Sequence
  derived and/or modified CDS sequence (opt5) from DENV-2__FJ639829__SS-prME
agcgugggaaugaucauuaugcugauccccaccgugauggccuuccaccucacgacgcggaauggggagccucauaugauuguuuccauccaggaaaagggaaaaucucugcuuuuuaagaccgaggacggagugaauaugugcacacugauggcuauggaucucggggaacugugugaggacaccauuacauacaaaugcccgcuucugcggcaaaacgaacccgaggauaucgacuguuggugcaauuccaccuccacaugggugaccuauggaacguguaccacaaccggcgagcaccgcagagaaaagcggucugucgcccucgugccucauguugggaugggacuggagacacgcaccgaaacguggaugagcuccgagggcgcguggaaacacgcucagagaaucgagacauggauucugcggcaucccggcuucaccaucauggccgccauucucgcuuacacaaucgggaccacccacuuucagcgcacacugauuuucauccuucugacggccguggcuccuucuaugaccaugagaugcauuggaaucagcaaccgggauuuugucgaaggcguguccgggggaagcuggguugacaucgugcucgagcacggcucuugugucacaaccauggccaagaauaagcccacacuggauuucgaacuuauuaaaaccgaggcgaagcagccugccacgcugcgcaaauauugcaucgaagcuaagcucacaaacaccaccacagaguccagauguccgacccaaggggagcccagccugaaagaagaacaggacaagcgguuugugugcaagcauucuaugguggaucgcggauggggcaauggcugugggcuguucggaaaaggcgggauugucacaugcgccauguuuacgugcaagaaaaacauggaaggaaagaucguucagccugagaaucucgaauacaccauuguggugacaccccacuccggcgaggagcaugcugucgggaacgacaccggaaaacacggcaaggaaaucaaagugacaccucagagcucuaucaccgaggccgaacugacgggcuaugggaccguuacaauggaguguucccccagaaccggacuugauuucaaugaaauggugcugcuccaaauggagaacaaggcguggcugguccaccggcagugguuucuugaccugccgcucccuuggcugcccggcgccgauacacaggggagcaauuggauucagaaggagacccuggugacguucaaaaacccucaugcuaagaaacaagacguugugguccucggaucccaggaaggcgccaugcacacagcucugaccggggccacagagauccagaugucuagcggcaaucuucuguuuaccggacaucucaagugccgccugagaauggacaaacuucaacugaagggcauguccuacagcauguguaccgggaaguucaaaguggucaaggaaauugccgagacacagcacggaacgaucgugauucggguucaguaugagggcgaugggucucccugcaaaauccccuucgaaaucauggaccucgagaagagauacgugcugggacgccugauuaccgucaacccuaucgugacagaaaaagauuccccgguuaacauugaggcugaacccccuuuuggcgacagcuacaucauuaucgggguggagcccggccagcucaagcugaauugguucaagaaaggaucuagcauuggccaaauguuugagaccacaaugagaggggcgaagagaauggccauccuuggagauaccgcuugggacuucggcucccucggcggggucuuuacgucuaucgggaaagcccuccaucagguguucggggccauuuauggcgcugccuuuagcggaguguccuggacaaugaagauccugauuggcguuaucauuaccuggaucgggaugaacagccgcucuaccucccugagcgucucucuugugcucgugggagucgugacacuguaccugggcguuauggugcaggcggauuccgggugugucgugagcuggaaaaauaaggaacucaagugcggauccggcaucuucauuaccgacaacguucacacauggacggagcaguauaaauuucaaccugaaucucccagcaagcuggcuuccgccauccagaaagcccaggaggaagggauuuguggcauccggucugugaccagacuugagaaucugauguggaagcagauuacaccggagcucaaccacauccuggcugaaaaugaggucaaacugaccaucaugacaggagauauuaagggcaucaugcaagccgggaaacgcagccuucggccucagcccaccgaacucaaguacuccuggaagacguggggaaaagcuaagaugcugagcaccgagucucauaaccagacauuccugauugacggcccugaaaccgccgagugccccaauacaaacagagcguggaacucccucgagguggaagauuauggguuuggaguuuucaccacaaacaucuggcugaaacuuaaggagaaacaggacgccuuuugugacagcaagcugaugucugcugccauuaaggauaaucgcgcugugcacgccgacaugggcuacuggaucgaauccgcgcucaacgauaccuggaaaaucgagaaggccagcuucauugaggucaaaaauugccauuggccuaagucucacacgcuguggagcaacggcgugcuggaauccgagaugaucauucccaaaaaccuugcugggccggugagccaacacaauuaucggccuggauaccauacacagaucgccggccccuggcaccucgggaagcuggaaauggacuucgauuuuugugacggaaccaccgucguugugacagaggauugcggcaacagagggcccucucugcgcaccacgacagcuuccggaaagcucauuaccgaauggugcugucggagcugcacacugccuccgcuuagauaccggggcgaggacggcuguugguaugggauggagauccgcccccugaaagaaaaggaggaaaaucucgugaacucccuggucaccgccggacauggccagguggauaauuucucucuggggguucuuggaauggcccucuuucuggaggaaaugcugagaacacgggugggcaccaaacacgcuauucuccuggucgcggugagcuucguuacgcuuaucaccgggaacauguccuuuaaggaccugggaagaguggucgugaugguuggcgccacaaugaccgaugacaucggcaugggggugacauaccucgcucugcuggccgccuucaaaguccgcccuaccuuugcugccggacuuuuccugcggaagcucacgucuaaggagcugaugaugacaaccauuggcaucgugcuccugagccaauccacaauucccgagaccauccuugaacugaccgaugcgcucgcucuggggaugauggugcugaaaauggucagagacauggagaaguaucagcuugccguuacaauuauggccauccugugcgugccuaaugcugugauccuccagaacgccuggaaagucucuuguacgauucuggcggugguuagcgugagcccccugcugcuuaccagcucucagcaaaagacagacuggaucccucuggcucucaccauuaaaggacugaaucccacagccaucuuucugaccacgcuuucccgcacaaacaagaaaagaagcuggccgcugaaugaagccauuauggcugucggcauggugucuauccucgccuccagccugcucaagaacgauaucccuaugaccgggccccugguugcuggaggccuucugaccgugugcuacguccugacaggccggucugccgaccucgagcuggaacgcgcgaccgaugugaagugggaggaccaggccgagauuuccgggagcuccccuauccuuagcauuacaaucucugaagauggaagcauguccauuaaaaaugaggaagaggagcagacgcugaccauccucauuagaacaggccugcucgucaucucugggcuguuccccgugagcaucccgauuaccgcugccgcuugguaucuuugggaaguuaagaaacagcgggccggagugcugugggacgucccuucucccccucccaugggcaaggccgagcuggaagauggggcuuaccgcaucaaacaaagaggcauucucggcuauagccagaucggcgcggggguguacaaggagggaacauuucauaccauguggcacguuacgcggggcgccgugcugacccacaaggggaaacgcauugaacccagcugggcugacgucaagaaagaucuuaucuccuacggaggcggguggaagcuggagggagaguggaaagaaggcgaggaaguccaggugcucgcccuggagccuggcaagaacccgagagccguucagacaaagcccggacucuucaaaaccaauacaggaaccaucggcgcugucucucuggacuuuagcccugggacauccggaagccccauuaucgauaagaaaggcaaggugguggggcuuuauggaaacggcgucgugacgcggucuggcgccuacguuuccgcgauugcucaaaccgagaaguccaucgaggacaacccugauauugaggacgacaucuuccgcaagagacggcugacaaucauggaucugcaucccggggccggaaagaccaaaagauaucucccugccauugugcgcgaagcuaucaagcggggccugagaacccuuauucuggccccgacacgcgucguggcggcugagauggaagaggcccuccgggggcugcccaucagauaccagacgccugccauucgcgcugaacacaccggacgggagaucguugaccucaugugucaugccacauucaccaugagacugcuuucucccgugcgcgucccuaauuauaaccugauuaucauggaugaggcucacuuuacagaccccgccuccaucgcggcccggggcuacauuagcaccagaguggaaaugggggaggcugccggcaucuucaugacggcuacaccgccuggaucccgggaucccuuuccccagucuaaugccccuauuaucgacgaagaacgcgagauucccgaaagaagcuggaacuccggccaugaguggguuaccgauuucaaagggaagaccgugugguuugucccuagcaucaaagccggaaaugacaucgcugcgugccugcggaagaacggcaagaaagugauucaacucucucgcaagacauucgauuccgaauaugugaaaaccagaacaaaugacugggauuuugucguuaccacggacaucagcgagaugggggccaacuucaaggcugaacgggugauugacccgagacgcuguaugaaacccgugauccugacagauggagaggagcgggucauucuugccggcccuaugcccgugacccacucuagcgccgcucagagacgcgggcggaucggcagaaauccuaagaacgaaaaugaccaguacaucuacaugggagagccccuggaaaacgaugaggacugcgcccacuggaaagaagcgaagaugcuccuggauaauauuaacacaccggagggcaucauuccuuccauguuugagcccgaacgcgagaagguugacgcuaucgauggggaauaucggcugagaggagaggcccgcaaaaccuucguggaccucaugagacggggcgaucuuccugucuggcuggccuacaagguggcugccgaagggauuaauuaugcggaccgcagaugguguuuugauggaaucaaaaacaaccagauucuggaggagaauguugaaguggagaucuggacgaaggaaggcgagcggaaaaagcucaagccccgcuggcuggacgccagaaucuacucugauccucuugcucugaaagaguucaaggaguucgccgcugggcggaaaagccucacccugaaccugauuacagagaugggcagacuccccaccuuuaugacacaaaagacccgcgacgcccuugacaaucuggcuguccugcauacagccgaagcgggaggccgggccuauaaccacgcucucuccgagcugccggaaacccuugagacgcugcuccugcugacacuccuugccaccgugaccgggggaaucuuccuguuucugaugucuggcagagggauuggaaaaaugacacucggcaugugcugcaucgucaccgcuagcauucugcuuugguacgcccagauccagccucauuggaucgccgcuuccauuauccuggaguucuuucucauugugcugcugauccccgaacccgagaagcagcgcacaccucaagauaaucagcucacguauguugugauugcgauccuuaccguggucgccgcuacaauggccaacgaaaugggcuuccuggagaagaccaaaaaggaccuggggcucggaagcaucgccacacagcagccggaaucuaauauucuggauaucgaccuucggcccgcuuccgccuggacccuguacgcgguugccacgaccuuugugacaccuaugcucagacacagcauugagaacuccucugugaaugucagccugaccgcuaucgccaaccaagcuacagugcugaugggccucgggaaaggauggccccuuuccaagauggauauuggcgccccucugcuggcgaucggguguuacucucagguuaaucccauuacccucacggccgcucugcuucugcucguggcccacuaugcuaucaucggaccuggccugcaggccaaagcuacacgggaggcccagaagcgcgcggccgcuggcauuaugaagaacccgaccgucgacgggaucacagugauugaucuggaccccaucccuuacgaucccaaauucgaaaagcaacucggacaggucaugcuucuggugcugugcguuacccaggugcucaugaugagaaccacaugggcccugugugaggcucuuacgcuggccaccggcccuauuagcacacucugggaagggaaucccggacgguuuuggaacaccacaaucgccgucuccauggcgaauaucuuccgcggcagcuaucuggcuggggccggacugcucuuuucuauuaugaaaaacaccacaaauuccagacggggcacaggcaacaucggggagacccuuggagaaaaguggaaaagccgccugaacgcucugggcaagucugaguuccaaauuuacaaaaaguccgggauccaggagguggacagaacccucgccaaggaaggaauuaaacggggcgagacagaucaucacgccguuagccgcgggucugcuaagcugagaugguuuguggaacggaauauggucaccccggagggaaaagugguggaccuuggcugcggcagagggggauggagcuauuacuguggcgggcugaagaacguucgcgaggucaaaggacucacaaagggcgggccuggacaugaagaacccauccccauguccacguauggcuggaaucuggugcggcugcagucuggcguggaugucuucuucaucccucccgaaaagugcgacacccuccuuugugacauuggggagagcuccccuaacccgacaguugaagccggaagaacccugcgcgugcugaaucucguggagaacuggcugaauaacaauacacaguuuugcaucaaaguccuuaaccccuacaugccuagcgugauugagaagauggaaacccugcaacggaaauacggcggggcgcucguuagaaauccccugucccgcaacucuacgcacgagauguauugggugagcaaugccuccggaaacaucgucucuagcgugaauaugauuucccggaugcugaucaacagauucaccaugcgccauaagaaagcuacauacgaaccugauguugaccucggcucugggacccggaacaucggaauugagagcgaaauccccaaucuugauauuaucggcaagagaauugagaagaucaaacaggagcacgaaacauccuggcacuaugaccaggaucauccguacaagaccugggccuaucacggcagcuacgagacaaaacagaccgggucugcuuccagcauggugaacggagucgugcgccugcugacgaagccuugggacgugcuccccacagucacccaaauggccaugaccgauacaacgccuuuuggccagcagcggguuuucaaagaaaagguggacaccagaacacaggagcccaaggaagggaccaaaaagcugaugaaaauuacagcggaguggcuuuggaaggagcugggcaaaaagaaaaccccucgcauguguacaagagaagaguuuacccggaaggugcgcucuaaugccgcucucggcgccaucuucacggaugaaaacaaguggaaauccgcuagagaggccgucgaggacagccgguuuugggaacugguggauaaggagagaaaucugcaucucgaagggaaaugcgagaccuguguuuauaacaugaugggaaagcgggagaaaaagcugggcgaguucggcaaggcuaaagggucucgcgccaucugguacauguggcuuggagcgagauuucuggaguucgaagcccucggcuuucugaaugaggaccacugguucucccgggaaaacagccuuuccgggguggagggagaaggccugcaccgccucggguacauucugagagacgucagcaagaaagagggcggagcuauguaugccgaugacacagcuggcugggauacccggaucacacuggaggaccucaagaaugaagagauggugaccaaccauauggaaggggagcacaaaaagcuggccgaagccauuuuuaaacuuacguaccaaaauaaaguugugcgcguccagagacccacaccgcggggaaccgugauggauaucauuucucgcagagaccagcggggcagcgggcaaguuggaacauauggccugaacaccuucacgaauauggaggcgcagcucauccgccagauggagggggaaggcguguucaagaacauccagcaucugaccgucacagaggaaauugcugugcaaaauuggcuugccagagucggacgggagcgccuguccagaauggccaucucuggcgaugacugcgugguuaaaccucucgaugaccgguuugcuagcgcccugaccgcucugaacgauauggggaagauuagaaaagacauccagcagugggagcccucccgcggauggaacgauuggacacaggugcccuucugcucucaccauuuucacgaacucauuaugaaggacggccggguccugguggugccuuguagaaaucaagacgagcuuaucgggcgcgcccggaucagccagggagcgggcuggucccugagagaaaccgccugccucgggaagucuuacgcucagauguggagccugauguauuuccaccgccgggaucuuagacuggccgcuaacgccauuuguuccgcgguuccgagccauugggugcccacaucucgcaccacgugguccauccacgccaaacaugaguggaugacaaccgaagacaugcucaccgucuggaaucggguguggauucaggagaacccuuggauggaggauaagacacccguugaaagcugggaggaaaucccuuaccugggcaaaagagaggaccaauggugcggaucucugauuggccucaccucccgcgcuacaugggccaagaauauccagguggcuauuaaccagguccggagccugaucgggaaugaagaguauacggauuacaugcccuccaugaaaagauuucggagagaggaagaggaagccggagugcuuugguga

SEQ ID NO: 19866 - RNA, 9876 nt, Artificial Sequence
  derived and/or modified CDS sequence (opt5) from DENV-2__FJ639831__SS-prME
uccgccggcaugaucauuaugcugauccccaccgugauggcuuuccaccucaccacgcggaauggggagccucauaugauuguguccauccaggaaaagggaaaaucucugcuuuuuaagaccgaggacggcguuaauaugugcacacugauggccauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggauguccuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaagacaagcgguuugucugcaagcauucuauuguggaucgcggauggggcaauggcugugggcuguucggaaaaggcgggaucgugaccugcgccauguuuacaugcaagaaaaacauggaaggaaagauuguccagccugagaaucucgaauacacgaucguugugacaccccacuccggcgaggagcaugcgguggggaacgacacaggaaaacacggcaaggaaaucaaagucaccccucagagcucugugacagaggccgaacugaccggcuaugggacgguuaccauggaguguucccccagaacaggacuugauuucaaugaaauggugcugcuccaaauggagaacaaggcuuggcugguccaccggcagugguuucuugaccugccgcucccuuggcugcccggcgccgauacccaggggagcaauuggauucagaaggagacacuggugaccuucaaaaacccucaugcuaagaaacaagacguugugguccucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaaguggucaaggaaauugcggagacccagcacggaacaaucgugauucggguucaguaugagggcgaugggucucccugcaaaauccccuucgaaaucauggaccucgagaagagauacgugcugggacgccugauuacggucaacccuaucgugaccgaaaaagauuccccgguuaacauugaggccgaacccccuuuuggcgacagcuacaucauuaucgggguggagcccggccagcucaagcugaauugguucaagaaaggaucuagcauuggccaaauguuugagacaaccaugagaggggcuaagagaauggccauccuuggagauacagccugggacuucggcucccucgggggagucuuuaccucuaucggcaaagcucuccaucagguguucggggccauuuauggcgcggcuuuuagcggaguguccuggacgaugaagauccugauuggcguuaucauuacauggaucgggaugaacagccgcucuaccucccugagcgucucucuugugcucgugggaaucgucacccuguaccugggcgugaugguucaggccgauuccggguguguggucagcuggaaaaauaaggaacucaagugcggauccggcauuuucaucacagacaacgugcacaccuggacagagcaguauaaauuucaaccugaaucucccagcaagcuggccuccgcuauucagaaagcccaggaggaagggaucuguggcauucggucuguuacgagacuugagaaucugauguggaagcagaucaccccggagcucaaccacauccuggcugaaaaugaggugaaacugacaauuaugaccggagauaucaagggcauuaugcaagccgggaaacgcagccuucggccucagcccacagaacucaaguacuccuggaagaccuggggaaaagcgaagaugcugagcacggagucucauaaccagaccuuccugaucgacggcccugaaacagccgagugccccaauaccaacagagcuuggaacucccucgaggucgaagauuauggguuuggaguguucacaaccaacauuuggcugaaacuuaaggagaaacaggacgccuuuugugacagcaagcugaugucugcugccaucaaggauaaucgcgcgguucacgccgacaugggcuacuggaucgaauccgcucucaacgauacauggaaaauugagaaggccagcuucaucgaggugaaaaauugccauuggccuaagucucacacccuguggagcaacggcguccuggaauccgagaugauuauccccaaaaaccuugcugggccggugagccaacacaauuaucggccuggauaccauacgcagauugccggccccuggcaccucgggaagcuggaaauggacuucgauuuuugugacggaacaaccguggucguuaccgaggauugcggcaacagagggcccucucugcgcacaaccacggccuccggaaagcucaucacagaauggugcugucggagcugcacccugccuccgcuuagauaccggggcgaggacggcuguugguaugggauggagauucgcccccugaaagaaaaggaggaaaaucucgugaacucccuggugacagcuggacauggccagaucgauaauuucucucuggggguccuuggaauggcgcucuuucuggaggaaaugcugagaacccgggugggcacaaaacacgccauccuccugguugcugugagcuucgucacccuuauuacggggaacauguccuuuaaggaccugggaagagugguugugauggucggcgccaccaugacagaugacaucggcaugggggugaccuaccucgcccugcuggcugccuucaaaguucgcccuacauuuguggcgggacuucugcuccggaagcugaccucuaaggagcucaugaugacgacaauuggcaucguccugcuuagccaauccaccauucccgagacaauccuggaacucaccgaugcucuggcccuggggaugauggugcuuaaaaucgugagagacauggagaaguaucagcuggccgucaccauuauggcuauccucugcguuccuaaugccgugauucugcagaacgcguggaaagugucuuguacaauccucgcugucgugagcguuagcccccugcuucugacgagcucucagcaaaagaccgacuggauuccucucgcccugacaaucaaaggacugaaucccaccgccaucuuccuuacaacccugucccgcacgaacaagaaaagaagcuggccgcucaaugaagcuauuauggccgugggcauggucucuauccuggcuuccagccuccugaagaacgauauuccuaugacagggccccuuguggccggaggccugcugaccguuugcuacgugcucaccggccggucugcggaccuggagcuugaacgcgccacagaugucaagugggaggaccaggcugagaucuccgggagcuccccuauucugagcaucaccauuucugaagauggaagcauguccaucaaaaaugaggaagaggagcagacacucacgauccugauuagaaccggccuccuggugaucucugggcuuuuucccgucagcauuccgaucacagccgcugccugguaucugugggaagugaagaaacagcgggccggaguucugugggacgugccuucucccccucccaugggcaaggcugagcucgaagauggggcguaccgcauuaaacaaaagggaguccugggcuauagccagaucggcgccgggguguacaaggagggaaccuuccauacaauguggcacguuaccagaggcgcugugcuuaugcacaaagggaagcggaucgaacccagcugggccgacgucaaaaaggaucugauuuccuacggaggcggguggaaacucgagggagaguggaaggaaggcgaggaaguccaggugcuggcccucgagccuggcaagaacccgcgcgcuguucagacgaaacccgggcuguuuaagaccaauacaggaaccaucggcgccgucucucuugacuucagcccugggacauccggaagccccauuaucgauaaaaagggcaaagugguggggcuguauggaaacggcgucgugaccagaucuggcgcguacguuuccgcuauugcccaaacagaaaagagcaucgaggacaacccugauaucgaggacgacauuuuucggaagcgcagacugacgaucauggaucuccaucccggggccggaaaaaccaagcgguaucugccugcuauugugagagaagccaucaaacgcggccuucggacacugauucucgcgccgaccagagucguggcugccgagauggaagaggcccugcgcgggcuccccauccgguaccagaccccugcuauuagagccgaacacacaggacgcgagaucguugaccugaugugucaugcuacguucaccaugcggcuucugucucccgugagagucccuaauuauaaccugaucauuauggaugaggcccacuucacagaccccgcguccaucgccgcucgcggcuacauuagcacccggguggaaaugggggaggccgcuggcaucuuuaugacagccaccccgccuggauccagagaucccuucccccagucuaaugccccuauuaucgacgaggaacgggagauccccgaacgcagcuggaacuccggccaugaguggguuacggauuuuaaggggaaaacagugugguucgucccuagcauuaaggcuggaaaugacaucgcggccugccucagaaagaacggcaaaaaggugauucaacugucucggaaaaccuuugauuccgaauaugugaagacccgcacaaaugacugggauuucgucguuaccacagacaucagcgagaugggggcuaacuuuaaagccgaaagagugauugacccgcggagauguaugaagcccgugauccuuaccgauggagaggagcgcgucauccuggccggcccuaugcccgugacgcacucuagcgcugcccagcggagagggcgcauuggccggaauccuaaaaacgaaaaugaccaguacaucuacaugggagagccccucgaaaacgaugaggacugcgcgcacuggaaggaagcuaagaugcugcuggauaauauuaacacaccggagggcaucauuccuuccauguucgagcccgaaagagagaaaguugacgccaucgauggggaauaucgccuccggggagaggccagaaagaccuuuguggaccuuaugcgcagaggcgaucugccugucuggcuggcuuacaaaguggccgcggaagggauuaauuaugccgaccggcgcugguguuucgauggaaucaagaacaaccagauccucgaggagaauguugaaguggagauuuggacaaaagaaggcgagagaaagaagcugaaaccccgguggcuugacgcucgcaucuacucugauccucuggcccucaaggaguuuaaagaguucgcugccgggagaaagagccugacccugaaccucauuacggagaugggccggcuucccaccuucaugacacagaaaaccagagacgcucuggacaaucuggccguccuccauacagcggaagccggaggccgcgcuuauaaccacgcccuguccgagcuuccggaaacccuggagacacuccugcugcucacccuucuggcuacggugacagggggaaucuuucuguuccucaugucuggccgggggauuggaaagaugacccugggcaugugcugcaucaucaccgccagcauucuucugugguacgcccagauccagccucauuggauugcugcguccaucauucucgaguuuuuccugaucguccugcucauccccgaacccgagaagcagagaacaccucaagauaaucagcuuaccuaugugguuauugccauccugacagugguggcugccacgauggccaacgaaaugggcuuucuggagaaaaccaagaaagaccucgggcugggaagcauuacaacccagcagccggaaucuaauauccuugauauugaccugcgccccgcuuccgccuggacacucuacgcggucgccaccacguucguuaccccuaugcugcggcacagcaucgagaacuccucugugaaugugagccugacagcuauugccaaccaagcuaccguccucaugggccuugggaagggauggccccuguccaaaauggauaucggcgugccucugcucgccaucggguguuacucucagguuaaucccauuacacugaccgcggcccuucugcuccugguggcucacuaugccaucauuggaccuggccugcaggcuaaggccacgagagaggcucagaagcgggccgcggccggcaucaugaaaaacccgacagucgacgggauuaccgugaucgaucucgaccccaucccuuacgaucccaaguuugaaaaacaacuuggacaggucaugcugcuggugcucugcguuacacaggugcugaugaugcgcaccaccugggcuaugugugaggcccuuacacuggcuacgggcccuauuagcacccucugggaagggaaucccggaagauucuggaacacaaccaucgccgucuccauggccaauauuuuucggggcagcuaucuggcgggggcuggacugcuguucucuaucaugaagaacacaaccaauacgcgcagaggcacaggcaacauuggggagacccuuggagaaaaauggaagucccggcugaacgcccugggcaaaagcgaguuucaaaucuacaagaagucugggauccaggagguggaccgcacccucgcuaaagaaggaauuaagagaggcgagacagaucaucacgccguuucccgggggagcgccaaacugcgcugguucguggaaagaaauauggucaccccggagggaaaggugguggaccuuggcugcggcagagggggauggucuuauuacuguggcgggcugaaaaacguucgggaggucaagggacucacaaagggcgggccuggacaugaggaacccauccccaugagcacguauggcuggaaucuggugcgccugcaguccggcguggaugucuuuuucauuccucccgaaaaaugcgacacccuccuuugugacaucggggagucuagcccuaacccgacaguugaagcuggacggacccugagagugcugaaucucguggagaacuggcugaauaacaauacacaguucugcauuaagguccuuaaccccuacaugccuuccgugaucgagaaaauggaaacccugcaacgcaaguacggcggggcccucguucggaauccccugagcagaaacuccacgcacgagauguauugggugucuaaugcgagcggaaacaucgucuccucugugaauaugauuagccgcaugcugaucaaccgguuuaccaugagacauaaaaagacaaccuacgaaccugauguugaccucggcuccgggacacgcaacauuggaaucgagucugaaauucccaaucuugauaucauuggcaagcggaucgagaaaaucaagcaggagcacgaaaccagcuggcacuaugaccaggaucauccguacaaaacaugggccuaucacggcuccuacgagaccaagcagacggggagcgcuucuuccauggugaacggagucgugagacugcugacaaaaccuugggacgugcuccccaccgucacccaaauggccaugacagauacgaccccuuucggccagcagcgcguuuuuaaggaaaagguggacacacggacccaggagcccaaagaagggacaaagaaacugaugaagauuaccgcugaguggcuuuggaaagagcugggaaagaaaaagacaccuagaauguguacccgcgaagaguucacgagaaaggugcggagcaaugccgcgcucggcgccaucuuuaccgaugaaaacaaauggaagucugcucgcgaggccgucgaggacuccagauucugggaacugguggauaaagagcggaagcugcaucucgaagggaaaugcgagacauguguuuauaauaugaugggaaagagagaaaagaaacugggcgaguuuggcaaggcuaaagggagccgggccauuugguacauguggcuuggagcucgcuuccuggaguuugaagcccucggcuuccugaacgaggaccacugguuuucuagagaaaauucccuuagcgggguggagggagaaggccugcacaagcucggguacauccugcgggacgucuccaaaaaggagggcggagcgauguaugccgaugacaccgcuggcugggauacacgcauuacccuggaggaccucaagaacgaagagauggugacgaaucauauggaaggggagcacaaaaagcuggccgaagcuaucuucaaacuuacauaccaaaacaagguugugagaguccagcggcccaccccgcgcggaacagugauggauaucauuagcagacgggaccagcgcggcucugggcaaguuggaaccuauggccugaauacguuuaccaacauggaggcccagcucaucagacagauggagggggaaggcguguucaaaaauauucagcaucugacagucaccgaggaaaucgccgugcaaaacuggcuugcgcgggucggacgcgagagacugagccggauggcuauuuccggcgaugacugcgugguuaagccucucgaugaccgcuucgccucugcccugacagcucugaaugauauggggaagaucagaaaagacauccagcagugggagcccagccggggauggaacgauuggacccaggugcccuuuugcucccaccauuuccacgaacucauuaugaaggacggcagaguccugguggugccuugucgcaaccaagacgagcuuaucgggcgggccagaauuucucagggagcuggcuggagccugcgcgaaacagccugccucgggaaauccuacgcgcagauguggucucugaucuauuuucaccggagagaucuucgccuggccgcuaaugccauuuguagcgcuguuccgucccauugggugcccaccagccggacgacauggucuauccacgccaagcaugaguggaugaccaccgaagacaugcucacagucuggaacagaguguggauucaggagaauccuuggauggaggauaaaacccccguugaauccugggaggaaaucccuuaccugggcaagcgcgaggaccaauggugcggaagccugaucggccucacaucucgggcgacgugggccaagaacauucagaccgcuaucaaucaggugagaucccugauugggaacgaagaguauacagauuacaugcccagcaugaaacgcuuccggagagaggaagaggaagccggaguccuuugguga

SEQ ID NO: 19867 - RNA, 9876 nt, Artificial Sequence
  derived and/or modified CDS sequence (opt5) from DENV-2__FJ639832__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacagacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacgucaaaacacgcaccaacgacugggauuucguggugaccacagacauuuccgagaugggggccaauuuuaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaaagagagaaggucgacgccauugauggggaauaccgccuccggggagaggcuagaaaaacguuuguggaccuuaugcgcagaggcgaucugccuguuuggcuggccuauaagguggcggccgaggggaucaacuacgcugaccggcgcugguguuucgauggaaucaaaaacaaucagauucucgaagagaacgucgaaguggagaucuggacaaaggagggcgaaagaaagaaacugaagccccgguggcuugacgcccgcauuuauuccgauccucuggcucucaaagaguuuaaggaguucgccgcugggagaaaaucucugacccugaaucucaucacagagaugggccggcuucccaccuucaugacgcaaaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacagagaaccccucaagacaaccagcuuaccuacguggucaucgcuauucugacagugguugccgccaccauggcuaaugaaaugggcuuucuggagaagaccaagaaggaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaaacgggccgcugccggcauuaugaagaauccgacaguugacgggaucaccgugaucgaucucgaccccauuccuuaugaucccaaauuugaaaagcaacuuggacaggucaugcugcugauccucugcgugacgcagguccugaugaugcgcacaaccugggcucuuugugaggcccugacacucgccaccggcccuauuucuacccugugggaagggaaccccggaagauucuggaauacaacgaucgcggugagcauggcuaacauuuuucggggcuccuaccuggccggggcuggacuccuuuucagcaucaugaaaaauaccacaaacacccgcagaggcacaggcaacaucggggagacccugggagagaaguggaaaucucggcugaaugcccucggcaaguccgaauuucaaauuuauaagaaaagcgggauccaggagguugaccgcacgcuggccaaggaaggaauuaaaagaggcgagacagaucaccaugcugugucucggggguccgccaaacuucgcugguucgucgagagaaacauggugaccccggaaggaaaaguuguggaccugggcugcggcagagggggauggagcuacuauuguggcgggcucaagaauguccgggaggugaagggacugaccaaaggcgggccuggacacgaagaacccauccccaugucuacauacggcuggaaccuggugcgccuccagagcggcguugaugucuuuuucauuccucccgaaaagugcgacacccuucugugugauaucggggaguccucuccuaauccgacaguggaggcgggacggacgcugagagugcucaaccuggucgaaaauuggcuuaacaauaacacccaguucugcaucaaaguucugaaucccuacaugccuagcgugauugagaagauggaagcccuccaacgcaaauauggcggggcucuggugcggaacccccuguccagaaauagcacacaugagauguacugggucuccaacgccucuggaaauaucgugagcuccguuaacaugauuucucgcaugcucaucaaccgguuuaccaugagacacaagaaggcuacauaugaaccugacguggaccuuggcagcgggacccgcaauauuggaaucgaguccgagguccccaaccuggauauuaucggcaaacggaucgaaaagauuaaacaggagcaugaaacgucuuggcacuacgaccaggaucacccguauaagaccugggccuaccauggcagcuaugagacaaaacagaccggguccgcgagcucuauggugaauggaguugugagacugcucacaaagccuugggacguccugcccaccgugacacaaauggccaugaccgauacgacaccuuucggccagcagcgcguguuuaaggaaaaagucgacacccggacccaggagcccaaggaggggaccaagaaacuuaugaaaaucacggcugaauggcuguggaaggagcucggcaaaaagaagaccccuagaauguguacacgcgaagaguucaccagaaaaguucgguccaacgccgcucugggcgccauuuuuacagaugagaauaaguggaaaagcgcucgcgaagccguggaggacucuagauucugggaacugguggauaaggagcggaaccuccaccuggaagggaaaugcgagaccugugucuacaauaugaugggaaagagagagaagaaacuuggcgaauuuggcaaggcgaaagggucccgggccaucugguacauguggcugggagcucgcuuccucgaguuugaagcccugggcuuccuuaacgaggaccauugguuuagcagagaaaauucucuguccgggguggagggagagggccuccacaagcugggguauauucugcgggauguuagcaaaaaggaaggcggagcuauguacgccgacgacacagccggcugggauacccgcaucacgcucgaggaccugaagaacgaagagauggugaccaaucacauggaaggggagcauaagaaacuugcggaggcuaucuucaaacugacauaucaaaacaaagucgugagaguucagcggcccaccccgcgcggaacagugauggauauuaucuccagacgggaccagcgcggcagcgggcaagucggaaccuacggccucaauacguuuacaaacauggaagcccagcugauuagacagauggagggggaaggcguguucaaaaauauccagcaccuuaccguuacagaggagguggccguccaaaacuggcuggcucgggugggacgcgaaagacucucucggauggccauuagcggcgaugacugcgucgugaagccucuggaugaccgcuucgcuaacgcccugaccgcgcucaaugauauggggaagaucagaaaagacauccagcagugggagcccuccaagggauggaacgauuggacgcagguucccuuuugcucucaucacuuccaugaacugauuaugaaagacggccgggugcuugucgugccuuguagaaaucaagaugagcugaucgggcgcgcccggauuagccagggagcuggcuggucccucagagaaaccgccugccuggggaagucuuaugcucagauguggagccuuauguacuuucaccgccgggaccugagacucgccgcgaacgccaucuguuccgcugugccgucucacuggguucccacaagccgcaccacaugguccauucaugccaaacacgaguggaugaccacagaggacaugcugaccguguggaaucgggucuggaucagagaaaacccuuggauggaggauaagacgcccguggaaagcugggaggaaauuccuuaucugggcaagcgcgaggaccaguggugcggaucucucaucggccugacaucccgggcuaccugggccaaaaauauccaagcugccauuaaccagguuagaagccuuaucgggaaugaggaauacaccgauuacaugcccucuaugaagcgcuuccggagagaggaagaggaagcgggagugcugugguga

SEQ ID NO: 19868 - RNA, 9876 nt, Artificial Sequence
  derived and/or modified CDS sequence (opt5) from DENV-2__FJ687434__SS-prME
agcgugggcaugaucauuaugcugauccccaccgucauggccuuccaccucacaacgagaaacggggagccucauaugauuguuuccauccaggaaaagggaaagucucugcuuuuuaagaccgaggacggcgugaauaugugcacacugauggcuauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucugucgcccucgugccucauguugggaugggacuggagacacgcaccgaaacguggaugagcuccgagggcgcguggaaacacgcucagagaaucgagacauggauucugcggcaucccggcuucaccaucauggccgccauucucgcuuacacaaucgggaccacccacuuucagcgcacacugauuuucauccuucugacggccguggcuccuucuaugaccaugagaugcauuggaaucagcaaccgggauuuugucgaaggcguguccgggggaagcuggguugacaucgugcucgagcacggcucuugugucacaaccauggccaagaauaagcccacacuggauuucgaacuuauuaaaaccgaggcgaagcagccugccacgcugcgcaaauauugcaucgaagcuagacucacaaacaccaccacagagucccgguguccgacccaaggggagcccagccugaaggaggaacaagacaaacgcuuugugugcaagcauucuaugguggauagaggauggggcaauggcugugggcuguucggaaagggcgggauugucacaugcgccauguuuacgugcaaaaagaacauggaaggaaaaaucguucagccugagaaucucgaauacaccauuguggugacaccccacuccggcgaggagcaugcugucgggaacgacaccggaaagcacggcaaagaaaucaaggugacaccucagagcucuaucaccgaggccgaacugacgggcuaugggaccguuacaauggaguguagcccccggaccagccuugauuucaaugaaauggugcugcuccaaauggagaacaaagcguggcugguccaccgccagugguuucuugaccugccgcucccuuggcugcccggagccgauacacagggcuccaauuggauucagaaggagacccuggugacguucaagaacccucaugcuaaaaagcaagacguugugguccucgggucucaggaaggagccaugcacacagcucugaccggcgccacagagauccagaugagcuccgggaaucuucuguuuaccggccaucucaaaugcagacugcggauggacaaacuucaacugaaaggaaugagcuacucuauguguaccggcaaguucaagguggucaaagaaauugccgagacacagcacgggacgaucgugauuagaguucaguaugagggagauggcucccccugcaagauccccuucgaaaucauggaccucgagaaacgcuacgugcuggggcggcugauuaccgucaacccuaucgugacagaaaaggauagcccgguuaacauugaggcugaacccccuuuuggagacucuuacaucauuaucggcguggagcccgggcagcucaaacugaauugguucaagaagggcagcuccauuggacaaauguuugagaccacaaugagaggcgcgaaacgcauggccauccuuggggauaccgcuugggacuucggaucucugggcggggucuuuacgagcaucggaaaggcccuccaucagguguucggcgccauuuauggggcugccuuuuccggcgugagcuggacaaugaaaauccugauuggaguuaucauuaccuggaucggcaugaacucucgguccaccagccugucugucucccuugugcucgugggggucgugacacuguaccugggaguuauggugcaggcggauagcggcugugucguguccuggaagaauaaagaacucaagugcgggucuggaaucuucauuaccgacaacguucacacauggacggagcaguauaaguuucaaccugaaagccccuccaaacuggcuucugccauccagaaggcccaggaggaaggcauuugugggaucagaagcgugacccgccuugagaaucugauguggaaacagauuacaccggagcucaaccacauccuggcugaaaaugaggucaagcugaccaucaugacaggcgauauuaaaggaaucaugcaagccggcaagcggucccuuagaccucagcccaccgaacucaaauacagcuggaagacgugggggaaggcuaaaaugcugucuaccgagucccauaaccagacauuccugauugacggaccugaaaccgccgagugccccaauacaaaccgcgcguggaauagccucgagguggaagauuauggcuuugggguuuucaccacaaacaucuggcugaaacuuaaagagaagcaggacgccuuuugugacucuaaacugauguccgcugccauuaaggauaaucgggcugugcacgccgacaugggauacuggaucgaaagcgcgcucaacgauaccuggaagaucgagaaagccucuuucauugaggucaagaauugccauuggccuaaaagccacacgcugugguccaacggcgugcuggaaagcgagaugaucauucccaagaaccuugcuggcccggugucucaacacaauuauagaccuggguaccauacacagaucgccggacccuggcaccucggcaaacuggaaauggacuucgauuuuugugacgggaccaccgucguugugacagaggauugcggaaaccgcggccccucccugcggaccacgacagcuagcgggaagcucauuaccgaauggugcuguagauccugcacacugccuccgcuucgguaccgcggagaggacggcuguugguauggcauggagaucagaccccugaaggaaaaagaggaaaaucucgugaacucucuggucaccgccgggcauggacagguggauaauuucagccugggcguucuugggauggcccucuuucuggaggaaaugcugcggacaagagugggaaccaagcacgcuauucuccuggucgcgguguccuucguuacgcuuaucaccggcaacaugucuuuuaaagaccuggggcgcguggucgugaugguuggagccacaaugaccgaugacaucggcaugggcgugacauaccucgcucugcuggccgccuucaagguccggccuaccuuugcugccgggcuucugcucagaaaacugacgagcaaggagcucaugaugacaaccauuggaaucgugcugcuuucccaaucuacaauucccgagaccauccuggaacucaccgaugcgcuggcucugggcaugauggugcuuaagaugguccgcgacauggagaaauaucagcuggccguuacaauuauggccauccucugcgugccuaaugcugugauccugcagaacgccuggaaggucagcuguacgauucucgcggugguuuccgugagcccccugcuucugaccucuucccagcagaagacagacuggaucccucucgcucugaccauuaaggggcugaaucccacagccaucuuccuuaccacgcugagcagaacaaacaaaaagcggucuuggccgcucaaugaagccauuauggcugucggaaugguguccauccuggccagcucucuccugaaaaacgauaucccuaugaccggcccccuuguugcugggggacugcugaccgugugcuacguccucacaggccgcuccgccgaccuggagcuugaaagagcgaccgaugugaagugggaggaccaggccgagauuagcggcuccagcccuauccugucuauuacaaucagcgaagauggguccaugucuauuaagaaugaggaagaggagcagacgcucaccauccugauucggacaggacuccuggucaucagcggccuuuuucccguguccaucccgauuaccgcugccgcuugguaucugugggaaguuaaaaagcagcgcgccggggugcugugggacgucccuucucccccucccaugggaaaagccgagcucgaagauggcgcuuacagaaucaagcaacgggggauucugggauauagccagaucggcgcgggcguguacaaagaggggacauuccauaccauguggcacguuacgcgcggagccgugcuuaugcacaagggcaagagaauugaacccuccugggcugacgucaaaaaggaucugaucucuuacgggggaggcuggaaacucgagggggaguggaaggaaggagaggaagugcaagugcuggcccucgagccuggcaaaaacccgcgggccguucagaccaagcccggccuguuuaagacaaauaccgggacaaucggagcugucagccuugacuucuccccuggcaccagcgggucucccauuaucgauaaaaagggaaaaguggugggccuguaugggaacggagucgugacacgcuccggcgccuacguuagcgcgauugcucaaacggaaaagucuaucgaggacaacccugauauugaggacgacaucuuuagaaaacggagacugaccaucauggaucuccaucccggcgccgggaagacaaagcgcuaucugccugccauugugcgggaagcuaucaaaagaggacuucgcacccugauucucgccccgacccgggucguggcggcugagauggaagaggcccugagaggccuccccauccgcuaccagacgccugcuauucgggcugaacacacagggagagagaucguugaccugaugugucaugccaccuucacaaugcgccuucugucccccgugcgggucccuaauuauaaccugauuaucauggaugaggcucacuucaccgaccccgccagcaucgcggccagaggauacauuuccacacggguggaaaugggcgaggcugccgggaucuuuaugaccgcuacgccgccuggcucucgcgaucccuucccccagagcaaugccccuauuaucgacgaagagagagagauucccgaacgguccuggaacagcggacaugaguggguuacagauuuuaagggcaaaaccgugugguucgucccuucuaucaaggccgggaaugacaucgcugcgugccuccgcaaaaacggaaagaaggugauucaacuguccagaaaaaccuuugauagcgaauaugugaagacacggaccaaugacugggauuucgucguuacaaccgacaucucugagaugggcgccaacuuuaaagcugaaagagugauugacccgcgccgguguaugaagcccgugauccuuacggauggggaggagagagucauucuggccggaccuaugcccgugacacacagcuccgccgcucagcgccggggcagaaucgggcgcaauccuaaaaacgaaaaugaccaguacaucuacaugggcgagccccucgaaaacgaugaggacugcgcccacuggaaggaagcgaaaaugcugcuggauaauauuaacaccccggagggaaucauuccuucuauguucgagcccgaacgggagaagguugacgcuaucgauggcgaauauagacuccgcggggaggccagaaagacauuuguggaccuuaugcggcgcggagaucugccugucuggcuggccuacaaaguggcugccgaaggcauuaauuaugcggacagacggugguguuucgaugggaucaagaacaaccagauucucgaggagaauguugaaguggagaucuggaccaaagaaggagagcgcaagaaacugaagcccagauggcuugacgcccggaucuacagcgauccucuggcucucaaggaguuuaaagaguucgccgcuggcagaaagucccugacgcugaaccucauuaccgagauggggcgccuucccacauucaugacccagaagacacgggacgcccuggacaaucuggcuguccuccauaccgccgaagcgggcggcagagccuauaaccacgcucugucugagcuuccggaaacacuggagacccuccugcugcucacgcuucuggccacagugaccggcgggaucuuucuguuccucaugagcggacgcggcauugggaagaugacccugggaaugugcugcaucgucacagcuuccauucuucugugguacgcccagauccagccucauuggaucgccgcuagcauuauccucgaguuuuuccugauugugcugcucauccccgaacccgagaaacagcggaccccucaagauaaucagcuuacauauguugugauugcgauccugacgguggucgccgcuaccauggccaacgaaaugggcuuucuggagaagacaaagaaagaccucggccuggggucuaucgccacccagcagccggaauccaauauucuugauaucgaccugagacccgcuagcgccuggacacucuacgcgguugccaccacguucgugaccccuaugcugcggcacuccauugagaacucuagcgugaaugucucccugacagcuaucgccaaccaagcuaccgugcucaugggacuuggcaagggguggccccugucuaaaauggauauuggagccccucugcucgcgaucggcuguuacagccagguuaaucccauuacacugaccgccgcccuucugcuccugguggcccacuaugcuaucaucgggccuggacugcaggccaaggcuacgcgcgaggcccagaaaagagcggccgcuggcauuaugaagaacccgacagucgacggcaucaccgugauugaucucgaccccaucccuuacgaucccaaguuugaaaaacaacuugggcaggccaugcugcugguccucugcgugacacagguucugaugaugcggaccaccugggcucuuugugaggcccugacacucgccacgggaccuauuuccacccugugggaaggcaaucccgggcgcuucuggaacacaaccaucgcggugagcauggcuaauaucuuuagaggaucuuaucuggccggcgcugggcuccuuuucuccauuaugaagaacacaaccaauagccggcgcggaacgggcaacaucggcgagacacugggggaaaaauggaagucuagacugaacgcccucggaaaauccgaguuucaaauuuacaagaaaagcggcauccaggaggucgaccggacccuggccaaggaagggauuaagcgcggagagaccgaucaucacgcugugucuagaggcagcgccaaacuucggugguucguugaaagaaauauggugacaccggaggggaaggucguggaccugggaugcggccgcggcgggugguccuauuacuguggaggccucaaaaacgugcgggagguuaaggggcugaccaaaggaggcccugggcaugaggaacccauccccaugucuacauauggauggaaucuggucagacuccagagcggcguggauguguuuuucaucccucccgaaaagugcgacacgcuucugugugacauuggcgaguccagcccuaacccgaccgucgaagcggggcgcacacugcggguucucaaucugguggagaacuggcuuaauaacaauacccaguucugcaucaaggugcugaaccccuacaugccuuccgucauugagaaaauggaaacacuccaaagaaaguacggaggcgcccuggugcgcaauccccugucucggaacagcacccacgagauguauuggguuuccaaugcuucugggaacaucgugagcuccgucaauaugauuucuagaaugcucaucaaccgcuuuacgaugcggcauaaaaaggccaccuacgaaccugauguggaccuuggaagcggcacaagaaacaucgggauugaguccgaaauccccaaucuggauauuaucggaaaacgcauugagaagaucaagcaggagcacgaaaccagcuggcacuaugaccaggaucauccguacaaaacaugggcuuaucacggcucuuacgagaccaagcagacaggcuccgccagcucuaugguuaacggggugguccggcugcucaccaaaccuugggacgugcugcccacggugacacaaauggcgaugaccgauaccacaccuuucggacagcagagagucuuuaaggaaaaaguugacacgcgcacccaggagcccaaggaaggcacaaagaaacuuaugaagauuaccgccgaguggcuguggaaagagcucgggaagaaaaagacaccuagaauguguacccgggaagaguucacacgcaaagugagauccaaugcugcccugggagcuaucuuuaccgaugaaaacaaguggaaguccgcccgggaggcuguggaggacucuagauucugggaacuggucgauaaagagcggaaucuccaucuggaaggcaagugcgagacguguguguauaacaugauggggaaacgcgaaaagaaacuuggagaguuuggcaaggccaagggcuccagagcgaucugguacauguggcugggggcccgguuccucgaguuugaagcucugggauuccuuaaugaggaccacugguuuagccgcgaaaacucccugagcggcguugagggggaaggacuccacaaacugggcuacauucugagagacgugucuaagaaagaagggggagccauguaugcugaugacaccgccggaugggauacacggaucacccucgaggaccugaagaaugaagagauggucacaaaccauauggaaggcgagcacaagaaacuugccgaagcgauuuucaaacugaccuaccaaaauaaagugguucgcgugcagagacccacgccgcgggggacagucauggauaucauuagccgcagagaccagcggggauccggccaaguggggaccuauggacucaacacauuuaccaauauggaggcucagcugauccgccagauggagggcgaagggguuuucaagaacauccagcaucuuacggugaccgaggaaauugccguccaaaauuggcuggccagagugggccgggagcgccucucuagaauggcuaucagcggagaugacugcgucgugaaaccucuggaugaccgguucgccuccgcucugacagcccucaacgauaugggcaagauuagaaaagacauccagcagugggagcccucucgcggguggaacgauuggacccagguucccuuuugcagccaccauuuccacgaacugauuaugaaggacggacgggugcuugucgugccuuguagaaaucaagacgagcugaucggccgcgcgcggaucucccagggggccggauggucucucagagaaacagcuugccugggcaagagcuacgcccagauguggucccuuauguauuuucaccgccgggaucugagacucgcugccaacgcgauuuguagcgccgugccgucucauuggguucccaccucccgcacaaccuggagcauccacgcuaaacaugaguggaugacgacagaagacaugcugaccguguggaaucgggucuggauucaggagaacccuuggauggaggauaagacccccguggaaucuugggaggaaaucccuuaccuggggaaaagagaggaccaauggugcggcucccucauuggacugacaagccgcgccaccugggcuaagaauauccaggccgcuauuaaccagguucggucccuuaucggcaaugaagaguauacagauuacaugcccucuaugaaaagauuccggagagaggaagaggaagccggggugcugugguga

SEQ ID NO: 19869 - RNA, 9876 nt, Artificial Sequence
  derived and/or modified CDS sequence (opt5) from DENV-2__FJ687439__SS-prME
agcgccggaaugaucauuaugcugauccccacagugauggcuuuccaccugacaacgagaaauggggagccucauaugauugucggaauccaggaaaagggcaaaucccugcuuuuuaagacagaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggagaacaaggcuuggcuggugcaccggcagugguuucuugaccugccgcucccuuggcugcccggggccgauaagcaggaguccaauuggauucagaaagaaacccuggucacauucaagaacccucaugcuaaaaagcaagacgugguugugcucggaagccaggagggcgccaugcacaccgcccugacgggggcuacagaaauccagauguccucuggcaaucuucuguuuaccggacaucucaaaugccgccugagaauggacaaacuucaacugaagggcaugagcuacuccauguguacagggaaauucaaggucgugaaagagauugcggagacccagcacggaaccaucgucauucgggugcaguaugaaggcgaugggagccccugcaagauccccuucgagaucauggaccucgagaagcgguacguucugggacgccugauuacagugaacccuaucgccacggagaaggauucuccggucaacauugaagcugagcccccuuuuggcgacuccuacaucauuaucgggguggagcccggccagcucaagcugaauugguucaaaaagggaagcucuauuggccaaauguuugaaaccacaaugagaggggccaaaagaauggccauccuuggagauaccgcuugggacuucggcagccucgggggaguuuuuacauccaucggcaaggcccuccaucagguguucggggcgauuuauggcgcugccuuuucuggagucagcuggaccaugaaaauccugauuggcgugaucauuacguggaucgggaugaacucccgcagcacaucucuguccgugagccuuguucucgucggaaucgugacccuguaccugggcgugaugguccaggccgauucugggugugugguuuccuggaagaauaaggagcucaaaugcggaagcggcauuuucaucaccgacaacgugcacacauggaccgaacaguauaaguuucaaccugagucccccucuaaacuggcuagcgccauucagaaggcucaggaagaggggaucuguggcauucgguccgucacaagacuugagaaucugauguggaaacagaucacgccggaacucaaccacauccuggccgagaaugaagugaagcugaccauuaugacaggagauaucaaaggcauuaugcaagcggggaagcgcucucuucggccucagcccaccgagcucaaguacagcuggaaaacauggggaaaggccaaaaugcuguccaccgaaagcuauaaccagacguuccugaucgacggcccugagaccgcugagugccccaauacaaacagagccuggaacucucucgaaguugaggauuacggguuuggaguguucaccacaaacauuuggcugaaacuuaaagaaaagcaggacgcuuuuugugacuccaagcugaugagcgccgcgaucaaagauaaucgcgccguccaugcugacaugggcuauuggaucgagucugcccucaacgauaccuggaagauugagaaggcuagcuucaucgaagugaagaauugccacuggccuaaaagccauacacuguggucuaacggcguucuggagagcgaaaugauuauccccaagaaccuugccgggccggugucccaacacaauuaccggccuggauaccacacccagauugccggccccuggcaucucgggaagcuggagauggacuucgauuuuugugacggaacgacagucaucgugaccgaagauugcggcaacagagggcccagccugcgcaccacaaccgcuucuggaaaacucauuacggaguggugcugucgguccugcacacugccuccgcuuagauaucggggcgaggacggcuguugguacgggauggaaauccgcccccugaaggagaaagaagagaaucucgugaacagccuggucaccgcgggacacggccagguugauaauuucucccugggggugcuuggaauggcccucuuucuggaagagaugcugagaacacgggugggcaccaagcaugcuauccuccuggucgccgugucuuucguuacacuuauuaccgggaacaugagcuuuaaagaccugggaagaguggucgugaugguuggcgccacgauggcugaugacaucggcaugggggugaccuaucucgcccugcuggcggcuuucaagguccgcccuacauuugccgccggacuucugcuccggaagcugaccuccaaagagcucaugaugacaaccauuggcaucgugcugcuuucucaaagcacgauucccgaaacaauccuggagcucaccgaugcucuggcccuggggaugaugguucuuaagaucgugagaaauauggaaaaauaccagcuggcggucacaauuauggcuauccucugcgugccuaacgccgugauucugcagaaugccuggaaggucuccuguaccauccucgcuguugugucugugagcccccugcuucugaccuccagccagcagaagacggacuggauuccucucgcccugacgaucaagggacugaaccccaccgcuaucuuccuuacaacccugucucgcacaaauaaaaagagauccuggccgcucaacgaggccauuauggcggucggcauggugagcauccuggccucuucccuccugaagaaugacauuccuaugaccgggccccuuguugcuggaggccugcugacggugugcuauguccucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauccugauuagaacaggccuccugguuaucuccgggcuuuuucccauuucuaucccgauuacggccgcugcgugguaccugugggaggugaaaaagcagcgggccggaguccugugggaugugccuucucccccucccaugggcaaagcugaacucgaggacggggccuaucgcaucaagcaaaagggaauccugggcuacucccagauuggcgccggggucuacaaagaaggaaccuuccacacaauguggcaugugaccagaggcgcuguucuuaugcacaaggggaaacggaucgagcccuccugggccgaugugaagaaagaccugauuagcuauggaggcggguggaagcucgagggagaauggaaggagggcgaagagguccaggugcuggcgcucgaaccuggcaaaaauccgcgcgcuguucagacaaagcccgggcuguuuaaaaccaacacgggaaccaucggcgccgugucccuugauuucucuccugggacaagcggaucccccauuaucgacaagaaaggcaaggucguggggcuguacggaaacggcgugguuaccagaagcggcgccuaugucucugcuaucgcccaaacagagaaguccauugaggauaauccugaaaucgaggacgauauuuuucggaaacgcagacugaccaucauggaccuccaccccggggcgggaaagacaaaacgguaccugccugcuauugugagagaagccaucaagcgcggccuucggacgcugauucucgccccgaccagaguggucgcugccgagauggaagaggcucugcgcgggcuccccauccgguaucagaccccugccaucagagcggagcauaccggacgcgaaauuguggaccugaugugucacgccaccuucacaaugcggcuucugagccccguuagagugccuaacuacaaucugaucgucauggaugaggcucauuucacggaccccgccucuauugcugcccgcggcuauaucuccacccggguggaaaugggggaggccgcuggcauuuuuaugacagcgaccccgccuggaagcagagaucccuucccccaguccaacgccccuaucaucgacgaggaacgggagauucccgaacgcucuuggaauagcggccacgaguggguuacagauuuuaaagggaagaccgugugguucgucccuuccaucaaggcuggaaacgacauugccgccugccuccgcaaaaauggcaagaaagugauccaacugagccggaagacguuugauucugaauacguuaaaacacgcaccaacgacugggauuucguggucaccacagacauuuccgagaugggggcuaauuuuaaggccgagagagugaucgauccgcggagauguaugaaacccgugauccuuaccgacggagaggaacgcgucauucuggcgggcccuaugcccguuacacauagcucugcugcccagcggagagggcgcaucggccggaacccuaagaaugaaaacgaccaguacauuuauaugggagagccccucgaaaaugaugaggacugcgcccacuggaaggaggcuaaaaugcugcuggauaacaucaauaccccggaaggcauuaucccuagcauguucgagcccgaaagagagaagguggacgccauugauggggaauaccgccuccggggagaggcgagaaaaacguuuguggaccuuaugcgcagaggcgaucugccugucuggcuggccuauaagguggcugccgaggggaucaacuacgcugaccggcgcugguguuucgauggaaucaaaaacaaucagauucucgaagagaacguugaaguggagaucuggacaaaggagggcgaaagaaagaaacugaagccccgguggcuugacgcccgcauuuauuccgauccucuggcucucaaagaguuuaaggaguucgccgcggggagaaaaucucugacccugaaucucaucacagagaugggccggcuucccaccuucaugacgcaaaagaccagagacgcccuggauaaccuggcuguccuccacacagccgaagcuggaggccgcgccuacaaucaugcccugagcgagcuuccggagacccuggaaacacuccugcugcucacccuucuggcuacagugaccgggggaauuuuucuguuccucauguccggccgggggaucggaaagaugacgcugggcaugugcugcaucauuacagcgucuauccuucugugguaugcccagauucagccucacuggaucgcugccagcauuauccucgaguuuuuccugaucguucugcucauucccgaacccgagaaacagagaaccccucaagacaaccagcuuaccuacguggucaucgccauucugacaguggucgcugccaccauggcgaaugaaaugggcuuucuggagaagaccaagaaggaccucgggcugggauccaucgccacgcagcagccggagagcaacauucuugauaucgaccugcgccccgcuucugccuggacccucuacgcuguggccacaaccuucguuacaccuaugcugcggcauuccauugaaaauagcuccgugaacaucucucugaccgcgaucgccaaucaagcuacggugcucaugggccuugggaaaggauggccccugagcaagauggauauuggcgucccucugcucgccaucggguguuauucccagguuaaccccauuacccugacagcugcccuucugcuccugguggcucacuacgccaucauuggaccuggccugcaggcgaaggccaccagagaggcucagaaacgggccgcugccggcaucaugaagaauccgacaguggacgggaucaccgucauugaucucgaccccaucccuuaugaucccaaauuugaaaagcaacuuggacaggugaugcugcugauucucugcguuacacaggugcugaugaugcgcacaaccugggcccuuugugaggcgcugacacucgcuaccggcccuaucucuacccugugggaagggaaccccggaagauucuggaauacaacgauugccgucagcauggcuaacaucuuucggggcuccuaccuggccggggccggacuccuuuucagcaucaugaaaaauaccacaaacacccgcagaggcacaggcaacauuggggagacccugggagagaaguggaaaucucggcugaaugcucucggcaaguccgaauuucaaaucuauaagaaaagcgggauucaggagguggaccgcacgcuggccaaggaaggaaucaaaagaggcgagacagaucaccaugcggucucucggggguccgccaaacuucgcugguucguggagagaaacaugguuaccccggaaggaaaaguggucgaccugggcugcggcagagggggauggagcuacuauuguggcgggcucaagaaugugcgggagguuaagggacugaccaaaggcgggccuggacacgaagaacccauucccaugucuacauacggcuggaaccuggugcgccuccagagcggcgucgauguguuuuucaucccucccgaaaagugcgacacccuucugugugauaucggggaguccucuccuaauccgacaguggaggcuggacggacgcugagaguucucaaccuggucgaaaauuggcuuaacaauaacacccaguucugcauuaaagugcugaaucccuacaugccuagcgugaucgagaagauggaagcccuccaacgcaaauauggcggggcucugguccggaacccccuguccagaaauagcacacaugagauguacuggguuuccaacgccucuggaaauauugugagcuccgugaacaugaucucucgcaugcucauuaaccgguuuaccaugagacacaagaaggcgacauaugaaccugacgucgaccuuggcagcgggacccgcaauaucggaauugaguccgagauccccaaccuggauaucauuggcaaacggaucgaaaagauuaaacaggagcaugaaacgucuuggcacuacgaccaggaucacccguauaagaccugggccuaccauggcagcuaugagacaaaacagaccggguccgcuagcucuauggugaauggaguugugagacugcucacaaagccuugggacguccugcccaccgugacacaaauggccaugaccgauacgacaccuuucggccagcagcgcguuuuuaaggaaaaaguggacacccggacccaggagcccaaggaggggaccaagaaacuuaugaaaaucacggcugaauggcuguggaaggagcucggcaaaaagaagaccccuagaauguguacacgcgaagaguucaccagaaaaguccgguccaacgccgcucugggcgccauuuuuacagaugagaauaaguggaaaagcgcgcgcgaagccguggaggacucuagauucugggaacugguggauaaggagcggaaccuccaccuggaagggaaaugcgagaccugugucuacaauaugaugggaaagagagagaagaaacuuggcgaauuuggcaaggcuaaagggucccgggccaucugguacauguggcugggagcucgcuuccucgaguuugaagcccugggcuuccuuaacgaggaccauugguuuagcagagaaaauucucuguccgggguugagggagagggccuccacaagcugggguauauccugcgggaugugagcaaaaaggaaggcggagccauguacgcggacgacacagcuggcugggauacccgcauuacgcucgaggaccugaagaacgaagagauggugaccaaucacauggaaggggagcauaagaaacuugccgaggccaucuucaaacugacauaucaaaacaaagucgugagaguucagcggcccaccccgcgcggaacagugauggauauuaucuccagacgggaccagcgcggcagcgggcaagucggaaccuacggccucaauacguuuacaaacauggaagcucagcugauuagacagauggagggggaaggcguguucaaaaauauccagcaccuuaccguuacagaggagguggccguccaaaacuggcuggcucgggugggacgcgaaagacucucucggauggccaucagcggcgaugacugcguugugaagccucuggaugaccgcuucgcgaacgcccugaccgcucucaaugauauggggaagauuagaaaagacauccagcagugggagcccuccaagggauggaacgauuggacgcagguccccuuuugcucucaucacuuccaugaacugauuaugaaagacggccgggugcuugucgugccuuguagaaaucaagaugagcugaucgggcgcgcccggauuagccagggagcuggcuggucccucagagaaaccgccugccuggggaagucuuaugcgcagauguggagccuuauguacuuucaccgccgggaccugagacucgccgcuaacgccaucuguuccgcuguuccgucucacugggugcccacaagccgcaccacaugguccauucaugccaaacacgaguggaugaccacagaggacaugcugaccgucuggaaucggguguggaucagagaaaacccuuggauggaggauaagacgcccguggaaagcugggaggaaaucccuuaucugggcaagcgcgaggaccaguggugcggaucucucauuggccugacaucccgggcuaccugggccaaaaauauccaagcggccauuaaccagguuagaagccuuaucgggaaugaggaauacaccgauuacaugcccucuaugaagcgcuuccggagagaggaagaggaagcuggagugcugugguga

SEQ ID NO: 19870 - RNA, 9876 nt, Artificial Sequence
  derived and/or modified CDS sequence (opt5) from DENV-2__FJ687440__SS-prME
agcgccggcaugaucauuaugcugauccccaccgugauggcuuuccaccucaccacgagaaauggggaaccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacauggaucaccuauggcacguguaccacaaccggggagcaccgcagagaaaagcgguccguggcgcucgugccucaugucggaaugggccuggagacacgcaccgaaacguggaugucuagcgagggcgcuuggaaacacgcccagagaauugagacauggauccugcggcaucccggguucaccauuauggccgcuauccucgccuacacaauuggaaccacccacuuucagcgcgcucugaucuucauucuucugacagccguggcgccuuccaugacgaugagaugcaucggcaucucuaaccgggauuuuguugaaggggugagcggaggcuccugggucgacauugugcucgagcacgggagcuguguuaccacaauggccaagaauaagcccacccuggauuucgaacuuaucaaaacagaggcuaagcagccugccacccugcgcaaauauugcauugaagcuaagcucacgaacacaaccaccgagucuagauguccgacacaaggagagcccucccugaaagaagaacaagacaagcgguuugugugcaagcauagcauggucgaucgcggcuggggcaauggguguggacuguucggcaaagggggaaucgugaccugcgccauguuuacaugcaagaaaaacauggaaggcaagauugugcagccugagaaucucgaauacacgaucgucguuacaccccacucuggggaggagcaugcggugggaaacgacacaggcaaacacggcaaggaaaucaaagugaccccucaguccagcauuacagaggccgaacugaccggguauggaacggucaccauggaguguucucccagaacaggccuugauuucaaugaaauggugcugcuccaaauggagaacaaggcuuggcugguucaccggcagugguuucuugaccugccgcucccuuggcugcccggggccgauaagcagggauccaauuggauccagaaagagacccuggugacauucaagaacccucaugcuaaaaagcaagacgucgugguucucggcagccaggaaggggccaugcacaccgcccugacgggcgcuacagagauucagauguccucuggaaaucuucuguuuaccggccaucucaaaugccgccugagaauggacaaacuucaacugaaggggaugagcuacuccauguguacaggaaaauucaagguggucaaagaaaucgcggagacccagcacggcaccauugugauccggguccaguaugagggggauggaagccccugcaagauccccuucgaaauuauggaccucgagaaaagauacgugcugggccgccugaucacaguuaacccuauugugacggaaaaggauucuccggucaacaucgaggccgaacccccuuuuggggacuccuacauuaucauuggcguggagcccggacagcucaagcugaauugguucaaaaagggcagcucuaucgggcaaauguuugagaccacaaugcggggagcuaaaagaauggccauccuuggcgauaccgccugggacuucgggagccugggaggcguuuuuacauccauugggaaggcucuccaucagguguucggcgccaucuauggagcggcuuuuucuggcgucagcuggaccaugaaaauucugaucggggugauuaucacguggaucggaaugaacucccgcagcacaucucuguccgugagccuuguucucgucggcauugugacccuguaccugggggugaugguccaggccgauucuggaugugugguuuccuggaagaauaaggaacucaaaugcggcagcgggaucuucauuaccgacaacgugcacacauggaccgagcaguauaaguuucaaccugaaucccccucuaaacuggccagcgcuauccagaaggcccaggaggaaggcauuuguggaauccgguccgucacaagacuugagaaucugauguggaaacagaucacgccggagcucaaccacauucuggcugaaaaugaggugaagcugaccaucaugacaggcgauauuaaagggaucaugcaagccggaaagcgcucucuucggccucagcccaccgaacucaaguacagcuggaaaacauggggcaaggcgaaaaugcuguccaccgagagccauaaccagacguuccugauugacgggccugaaaccgccgagugccccaauacaaacagagcuuggaacucucucgagguugaagauuauggauuuggcguguucaccacaaacaucuggcugaaacuuaaagagaagcaggacgccuuuugugacuccaagcugaugagcgcugccaucaaagauaaucgcgcgguccacgccgacaugggcuacuggauugaaucugcucucaacgauaccuggaagaucgagaaagccuccuucauugaggugaagaauugccauuggccuaaaagccacacacuguggucuaacgggguucuggaaagcgagaugaucauucccaagaaccuugcuggaccggugucccaacacaauuaucggccuggcuaccauacccagaucgccgggcccuggcaccucggaaagcuggaaauggacuucgauuuuugugacggcacgacagucauugugaccgaggauugcgggaacagaggacccagccugcgcaccacaaccgccucuggcaaacucaucacggaauggugcugucgguccugcacacugccuccgcuuagauaccggggcgaggacggguguugguauggaauggagauccgcccccugaaggaaaaagaggaaaaucucgugaacagccuggucaccgcuggccaugggcagguugauaauuucucccugggagugcuuggcauggcgcucuuucuggaggaaaugcugagaacacggguggggaccaagcacgccauucuccuggucgcugugucuuucguuacacuuaucaccggaaacaugagcuuuaaagaccugggcagaguggucgugaugguuggcgccacgaugaccgaugacauugggaugggagugacauaccucgcccugcuggcugccuucaagguccgcccuaccuuugcggcuggccuucugcuccggaagcugacauccaaagagcucaugaugaccacgaucgggauugugcugcuuucucaaagcacaauccccgagaccauccuggaacucacagaugcccuggcccugggaaugaugguucuuaagauugugagaaauauggagaaauaucagcuggcugucaccaucauggccauucucugcgugccuaacgcggugauccugcagaaugcuuggaaggucuccuguaccauucucgccguugugucugugagcccccugcuucugacauccagccagcagaagacggacuggaucccucucgcccugaccaucaagggccugaaccccacagcuauuuuccuuaccacacugucucgcaccaauaaaaagagauccuggccgcucaacgaagccaucauggcugucgggauggugagcauucuggccucuucccuccugaagaaugacaucccuaugacgggaccccuuguugcgggcggccugcugacagugugcuacguccucaccgggcggagcgccgaucuggagcuugaacgcgcuaccgacgugaaaugggaggaucaggccgagauuucuggauccagcccuauccuguccauuacaaucagcgaagacggcucuaugagcaucaagaacgaggaagaggagcagacccucacaauucugaucagaacggggcuccugguuauuuccggacuuuuucccgugucuaucccgauuaccgcugccgccugguaucugugggaagucaaaaagcagcgggcuggcgugcugugggaugucccuucucccccucccauggggaaagcggagcucgaagacggagccuaccgcaucaagcaaaagggcauccugggcuauucccagauuggggcuggaguguacaaagagggcacauuccauaccauguggcacguuacaagaggggccgugcuuaugcacaagggaaaacggaucgaacccuccugggccgaugucaagaaagaccugauuagcuacggcgggggauggaagcucgagggcgaguggaaggaaggcgaggaagugcagguucuggcucucgagccugggaaaaauccgcgcgccgugcagaccaagcccggacuguuuaaaacgaacaccggcacaaucggggcggucucccuugauuucucuccuggaaccagcggcucccccauuaucgacaagaaagggaagguggugggacuguauggcaacggcguugucacaagaagcggggcuuacgugucugccaucgcccaaaccgaaaaguccauugaggauaauccugagaucgaagacgauauuuuucggaaacgcagacugacaaucauggaccuccaucccggagcuggcaagacgaaacgguaucugccugccauugugagagaggcgaucaagcgcgggcuucggacccugauucucgcuccgacaagagucguggccgccgaaauggaggaagcucugcgcggacuccccauccgguaccagaccccugccaucagagcugagcacaccggccgcgagauuguugaccugaugugucaugccacauucacgaugcggcuucugagccccgugagagucccuaacuauaaucugaucauuauggaugaagcgcacuucaccgaccccgccucuaucgcugcccgcggguacauuuccacacggguggagaugggcgaagcugccggaaucuuuaugaccgccacaccgccuggcagcagagaucccuucccccaguccaacgcuccuaucauugacgaggagcgggaaauccccgagcgcucuuggaauagcgggcaugaauggguuaccgauuuuacgggaaaaacagugugguucgucccuuccauuaaggcgggcaacgacaucgccgcuugccucagaaagaaugggaaaaaggugauucaacugagccggaaaaccuuugauucugaguauguuaagacccgcacaaacgacugggauuucguggucaccacagacaucuccgaaaugggagccaauuuuaaagccgagagagugaucgauccgcggagauguaugaagcccgugauucuuaccgacggcgaggaacgcgucauccuggcugggccuaugcccguuacgcacagcucugccgcgcagcggagaggccgcauuggacggaacccuaaaaaugagaacgaccaguacaucuacaugggcgaaccccucgagaaugaugaagacugcgcucacuggaaggaggccaagaugcugcuggauaacauuaauacaccggaggggaucauuccuagcauguucgaacccgagagagaaaaaguggacgccaucgauggagaguaucgccuccggggcgaagcuagaaagaccuuuguggaccuuaugcgcagaggggaucugccugucuggcuggccuacaaaguggcggccgagggaaucaacuaugcugaccggcgcugguguuucgauggcauuaagaacaaucagauccucgaggaaaacguugagguggaaauuuggacaaaagagggggagagaaagaagcugaaaccccgguggcuugacgcccgcaucuacuccgauccucuggcucucaaggaauuuaaagaguucgccgcuggcagaaagucucugacccugaaucucauuacggaaaugggacggcuucccaccuucaugacacagaagaccagagacgcccuggauaaccuggcgguccuccauacagccgaggcuggcgggcgcgccuauaaucacgcucugagcgaacuuccggagacccuggagacacuccugcugcucacccuucuggccacggugacaggaggcaucuuucuguuccucauguccgggcggggaaucggcaagaugacccugggcaugugcugcauuaucaccgccucuauucuucugugguacgcucagauccagccucauuggauugcggccagcaucauccucgaauuuuuccugauuguucugcucauccccgagcccgaaaagcagagaacaccucaagacaaccagcuuaccuauguggucauugcuauccugacaguggucgccgccacgauggcuaaugagaugggguuucuggagaagaccaagaaagaccucggacugggcuccauugccacacagcagccggagagcaacauccuugauauugaccugcgccccgcgucugccuggacccucuacgcuguggccacaaccuucguuacgccuaugcugcggcacuccaucgagaauagcuccgugaacgugucucugaccgcuaucgccaaucaagcgacaguccucauggggcuuggaaagggcuggccccugagcaaaauggauauugggguuccucugcucgccaucggauguuacucccaggugaaccccauuacccugacagcugcccuucugcuccugguggcucacuaugccaucauuggcccuggccugcaggcuaaggccaccagagaagcgcagaagcgggccgcugccgggaucaugaaaaauccgacggucgacggaaucacagugauugaucucgaccccaucccuuacgaucccaaguuugagaaacaacuuggccagguuaugcugcugauucucugcgugacccagguccugaugaugcgcacaaccugggcucuuugugaagcccugacccucgccacagggccuaucucuacgcugugggagggaaaccccggcagauucuggaauaccacaauugcggugagcauggcuaacaucuuucggggguccuaucuggccggagcuggccuccuuuucagcaucaugaagaauaccacaaacacccgcagaggcacggggaacauuggagaaacacugggcgagaaauggaagucucggcugaaugcccucgggaaauccgaguuucaaaucuacaaaaagagcggcauucaagaagucgaccgcacccuggccaaagagggaaucaagagaggggaaaccgaucaucacgcugugucucggggauccgccaaacuucgcugguucguugagagaaacauggugacaccggagggcaaggucguggaccugggcugcgggcggggaggcuggagcuauuacugugggggacucaaaaauguuagagaagugaagggccugaccaaagggggaccuggccaugaggaacccauucccaugucuacauauggcuggaaccugguccgccuccagagcgggguggauguguuuuucaucccucccgagaaaugcgacacgcuucugugugauaucggagaauccucuccuaauccgaccguugaggcgggccggacacugagaguccucaaccugguggagaauuggcuuaacaauaacacccaguucugcauuaaggugcugaaucccuacaugccuagcgucaucgagaagauggaggcccuccaacgcaaguacgggggagcucugguucggaacccccuguccagaaauagcacacacgaaauguauuggguguccaacgccucuggcaauauugugagcuccgucaacaugaucucucgcaugcucauuaaccgguuuaccaugagacauaaaaaggcuacguacgagccugacguggaccuugggagcggaacccgcaauaucggcauugaauccgagauccccaaccuggauaucauuggcaagcggaucgagaaaauuaagcaggaacacgagacaucuuggcacuaugaccaggaucauccguacaaaaccugggccuaucacgggagcuacgaaacaaagcagaccggauccgcgagcucuaugguuaauggcguggucagacugcucacaaaaccuugggacgugcugcccaccguuacgcaaauggccaugacagauaccaccccuuucgggcagcagcgcguguuuaaggagaaggucgacacacggacgcaggaacccaaagagggaaccaagaaacuuaugaagaucacagcugaguggcuguggaaagaacucggcaagaaaaagaccccuagaauguguacacgcgaggaguucaccagaaaggugcgguccaacgccgcucugggggccauuuuuacagaugagaauaaauggaaaagcgcucgcgaggccguggaagacucuagauucugggagcuggucgauaaagaacggaaccuccaucuggagggaaagugcgaaaccuguguuuauaauaugaugggcaaaagagagaagaaacuuggcgaguuugggaaagcgaagggaucccgggccaucugguacauguggcugggcgcucgcuuccucgaauuugaggcccugggguuccuuaacgaagaccacugguuuagcagagaaaauucucuguccggaguggaaggcgaggggcuccacaaacugggcuacauccugcgggaugugagcaagaaagagggaggcgcuauguaugccgacgacacggccgggugggauacccgcauuacacucgaagaccugaagaacgaggaaauggucaccaaucauauggagggagaacacaagaaacuugcggaggcuaucuucaagcugacauaccaaaacaaagugguuagagugcagcggcccaccccgcgcggcacggucauggauauuaucuccagacgggaccagcgcgggagcggacaagugggcacauaugggcucaauaccuuuacaaacauggaggcccagcugauuagacagauggaaggcgagggaguuuucaagaauauccagcaucuuaccgccacggaagagaucgcugugcaaaacuggcuggcccgggucggccgcgagagacucucucggauggcuauuagcggggaugacugcgugguuaaaccucuggaugaccgcuucgccaacgcgcugaccgcccucaaugauaugggaaagaucagaaaggacauucagcagugggaacccuccaaaggcuggaacgauuggacacaggugcccuuuugcucucaccauuuccacgagcugaucaugaaggacgggcggguccuuguggucccuuguagaaaucaagaugaacugauuggacgcgcucggaucagccagggcgccggguggucccucagagagaccgcuugccugggcaaaucuuacgcccagauguggagccuuauguauuuucaccgccgggaccugagacucgcggccaacgcuauuuguuccgccgugccgucucauuggguucccacaagccgcaccacaugguccauccacgcuaagcaugaauggaugaccacggaggacaugcugacaguguggaaucgggucuggaucagagagaacccuuggauggaagauaaaacccccguggagagcugggaagagauuccuuaccugggaaagcgcgaagaccaguggugcggcucucucaucgggcugaccucccgggccacaugggcuaagaauauucaagccgcgaucaaccaggugagaagccuuauuggaaaugaggaguauaccgauuacaugcccucuaugaaacgcuuccggagagaagaggaagaggccggcguucugugguga

SEQ ID NO: 19871 - RNA, 9876 nt, Artificial Sequence
  derived and/or modified CDS sequence (opt5) from DENV-2__FJ687441__SS-prME
agcgccggaaugaucauuaugcugauccccaccgugauggcuuuccaccucaccacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacauggaucaccuauggcacguguaccacaaccggggagcacagaagagaaaagcgguccguggcgcucgugccucaugucggaaugggccuggagacacgcaccgaaacguggaugucuagcgagggcgcuuggaagcacgcccagagaauugagacauggauccugcggcaucccggguucaccauuauggccgcuauccucgccuacacaauuggaaccacccacuuucagcgcgcucugaucuucauucuucugacagccguggcgccuuccaugacgaugagaugcaucggcaucucuaaccgggauuuuguugaaggggugagcggaggcuccugggucgacauugugcucgagcacgggagcuguguuaccacaauggccaagaauaagcccacccuggauuucgaacuuaucaaaacagaggcuaagcagccugccacccugcgcaaauauugcauugaagcuaagcucacgaacacaaccaccgagucuagauguccgacacaaggagagcccucccugaaagaggaacaagacaagcgguuugugugcaagcauagcauggucgaucgcggcuggggcaauggguguggacuguucggcaaagggggaaucgugaccugcgccauguuuacaugcaagaaaaacauggaaggcaagauugugcagccugagaaucucgaauacacgaucgucguuacaccccacucuggggaggagcaugcggugggaaacgacacaggcaaacacggcaaggaaaucaaagugaccccucaguccagcauuacagaggccgaacugaccggguauggaacggucaccauggaguguucucccagaacaggccuugauuucaaugaaauggugcugcuccaaauggagaacaaggcuuggcugguucaccggcagugguuucuugaccugccgcucccuuggcugcccggggccgauaagcagggauccaauuggauccagaaagagacccuggugacauucaagaacccucaugcuaaaaagcaagacgucgugguucucggcagccaggaaggggccaugcacaccgcccugacgggcgcuacagagauucagauguccucuggaaaucuucuguuuaccggccaucucaaaugccgccugagaauggacaaacuucaacugaaggggaugagcuacuccauguguacaggaaaauucaagguggucaaagaaaucgcggagacccagcacggcaccauugugauccggguccaguaugagggggauggaagccccugcaagauccccuucgaaauuauggaccucgagaaaagauacgugcugggccgccugaucacaguuaacccuauugugacggaaaaggauucuccggucaacaucgaggccgaacccccuuuuggggacuccuacauuaucauuggcguggagcccggacagcucaagcugaauugguucaaaaagggcagcucuaucgggcaaauguuugagaccacaaugcggggagcuaaaagaauggccauccuuggcgauaccgccugggacuucgggagccugggaggcguuuuuacauccauugggaaggcucuccaucagguguucggcgccaucuauggagcggcuuuuucuggcgucagcuggaccaugaaaauucugaucggggugauuaucacguggaucggaaugaacucccgcagcacaucucuguccgugagccuuguucucgucggcauugugacccuguaccugggggugaugguccaggccgauucuggaugugugguuuccuggaagaauaaggaacucaaaugcggcagcgggaucuucauuaccgacaacgugcacacauggaccgagcaguauaaguuucaaccugaaucccccucuaaacuggccagcgcuauccagaaggcccaggaggaaggcauuuguggaauccgguccgucacaagacuugagaaucugauguggaaacagaucacgccggagcucaaccacauucuggcugaaaaugaggugaagcugaccaucaugacaggcgauauuaaagggaucaugcaagccggaaagcgcucucuucggccucagcccaccgaacucaaguacagcuggaaaacauggggcaaggcgaaaaugcuguccaccgagagccauaaccagacguuccugauugacgggccugaaaccgccgagugccccaauacaaacagagcuuggaacucucucgagguugaagauuauggauuuggcguguucaccacaaacaucuggcugaaacuuaaagagaagcaggacgccuuuugugacuccaagcugaugagcgcugccaucaaagauaaucgcgcgguccacgccgacaugggcuacuggauugaaucugcucucaacgauaccuggaagaucgagaaagccuccuucauugaggugaagaauugccauuggccuaaaagccacacacuguggucuaacgggguucuggaaagcgagaugaucauucccaagaaccuugcuggaccggugucccaacacaauuaucggccuggcuaccauacccagaucgccgggcccuggcaccucggaaagcuggaaauggacuucgauuuuugugacggcacgacagucauugugaccgaggauugcgggaacagaggacccagccugcgcaccacaaccgccucuggcaaacucaucacggaauggugcugucgguccugcacacugccuccgcuuagauaccggggcgaggacggguguugguauggaauggagauccgcccccugaaggaaaaagaggaaaaucucgugaacagccuggucaccgcuggccaugggcagguugauaauuucucccugggagugcuuggcauggcgcucuuucuggaggaaaugcugagaacacggguggggaccaagcacgccauucuccuggucgcugugucuuucguuacacuuaucaccggaaacaugagcuuuaaagaccugggcagaguggucgugaugguuggcgccacgaugaccgaugacauugggaugggagugacauaccucgcccugcuggcugccuucaagguccgcccuaccuuugcggcuggccuucugcuccggaagcugacauccaaagagcucaugaugaccacgaucgggauugugcugcuuucucaaagcacaauccccgagaccauccuggaacucacagaugcccuggcccugggaaugaugguucuuaagauugugagaaauauggagaaauaucagcuggcugucaccaucauggccauucucugcgugccuaacgcggugauccugcagaaugcuuggaaggucuccuguaccauucucgccguugugucugugagcccccugcuucugacauccagccagcagaagacggacuggaucccucucgcccugaccaucaagggccugaaccccacagcuauuuuccuuaccacacugucucgcaccaauaaaaagagauccuggccgcucaacgaagccaucauggcugucgggauggugagcauucuggccucuucccuccugaagaaugacaucccuaugacgggaccccuuguugcgggcggccugcugacagugugcuacguccucaccgggcggagcgccgaucuggagcuugaacgcgcuaccgacgugaaaugggaggaucaggccgagauuucuggauccagcccuauccuguccauuacaaucagcgaagacggcucuaugagcaucaagaacgaggaagaggagcagacccucacaauucugaucagaacggggcuccugguuauuuccggacuuuuucccgugucuaucccgauuaccgcugccgccugguaucugugggaagucaaaaagcagcgggcuggcgugcugugggaugucccuucucccccucccauggggaaagcggagcucgaagacggagccuaccgcaucaagcaaaagggcauccugggcuauucccagauuggggcuggaguguacaaagagggcacauuccauaccauguggcacguuacaagaggggccgugcuuaugcacaagggaaaacggaucgaacccuccugggccgaugucaagaaagaccugauuagcuacggcgggggauggaagcucgagggcgaguggaaggaaggcgaggaagugcagguucuggcucucgagccugggaaaaauccgcgcgccgugcagaccaagcccggacuguuuaaaacgaacaccggcacaaucggggcggucucccuugauuucucuccuggaaccagcggcucccccauuaucgacaagaaagggaagguggugggacuguauggcaacggcguugucacaagaagcggggcuuacgugucugccaucgcccaaaccgaaaaguccauugaggauaauccugagaucgaagacgauauuuuucggaaacgcagacugacaaucauggaccuccaucccggagcuggcaagacgaaacgguaucugccugccauugugagagaggcgaucaagcgcgggcuucggacccugauucucgcuccgacaagagucguggccgccgaaauggaggaagcucugcgcggacuccccauccgguaccagaccccugccaucagagcugagcacaccggccgcgagauuguugaccugaugugucaugccacauucacgaugcggcuucugagccccgugagagucccuaacuauaaucugaucauuauggaugaagcgcacuucaccgaccccgccucuaucgcugcccgcggguacauuuccacacggguggagaugggcgaagcugccggaaucuuuaugaccgccacaccgccuggcagcagagaucccuucccccaguccaacgcuccuaucauugacgaggagcgggaaauccccgagcgcucuuggaauagcgggcaugaauggguuaccgauuuuaaaggaaagacggugugguucgucccuuccauuaaggcgggcaacgacaucgccgcuugccuccgcaagaaugggaagaaagugauucaacugagccggaagacauuugauucugaguauguuaaaacccgcaccaacgacugggauuucguggucacaaccgacaucuccgaaaugggagccaauuuuaaggccgagagagugaucgauccgcggagauguaugaaacccgugauucuuacagacggcgaggaacgcgucauccuggcugggccuaugcccguuacccacagcucugccgcgcagcggagaggccgcauuggacggaacccuaagaaugagaacgaccaguacaucuacaugggcgaaccccucgagaaugaugaagacugcgcucacuggaaggaggccaaaaugcugcuggauaacauuaauacgccggaggggaucauuccuagcauguucgaacccgagagagaaaagguggacgccaucgauggagaguaucgccuccggggcgaagcuagaaaaacauuuguggaccuuaugcgcagaggggaucugccugucuggcuggccuacaagguggcggccgagggaaucaacuaugcugaccggcgcugguguuucgauggcauuaaaaacaaucagauccucgaggaaaacguugagguggaaauuuggaccaaggagggggagagaaagaaacugaagccccgguggcuugacgcccgcaucuacuccgauccucuggcucucaaagaauuuaaggaguucgccgcuggcagaaaaucucugacacugaaucucauuaccgaaaugggacggcuucccacguucaugacccaaaagacaagagacgcccuggauaaccuggcgguccuccauaccgccgaggcuggcgggcgcgccuauaaucacgcucugagcgaacuuccggagacacuggagacccuccugcugcucacacuucuggccaccgugacgggaggcaucuuucuguuccucauguccgggcggggaaucggcaagaugacacugggcaugugcugcauuaucaccgccucuauucuucugugguacgcucagauccagccucauuggauugcggccagcaucauccucgaauuuuuccugauuguucugcucauccccgagcccgaaaaacagagaaccccucaagacaaccagcuuacauauguggucauugcuauccugaccguggucgccgccacaauggcuaaugagaugggguuucuggaaaagacgaaaaaggaccucggacugggcuccauugccacccagcagccggagagcaacauccuugauauugaccugcgccccgcgucugccuggacacucuacgcuguggccaccacauucguuaccccuaugcugcggcacuccaucgagaauagcuccgugaacgugucucugacggcuaucgccaaucaagcgaccguccucauggggcuuggaaaaggcuggccccugagcaagauggauauugggguuccucugcucgccaucggauguuacucccaggugaaccccauuacacugaccgcugcccuucugcuccugguggcucacuaugccaucauuggcccuggccugcaggcuaaggccacaagagaagcgcagaaacgggccgcugccgggaucaugaagaauccgaccgucgacggaaucacggugauugaucucgaccccaucccuuacgaucccaaauuugagaagcaacuuggccagguuaugcugcugauucucugcgugacacagguccugaugaugcgcaccacaugggcucuuugugaagcccugacccucgccaccgggccuaucucuacacugugggagggaaaccccggcagauucuggaauacgaccauugcggugagcauggcuaacaucuuucggggguccuaucuggccggagcuggccuccuuuucagcaucaugaaaaauacaaccaacacacgcagaggcaccgggaacauuggagaaacgcugggcgagaaguggaaaucucggcugaaugcccucgggaaguccgaguuucaaaucuacaagaaaagcggcauucaggaagucgaccgcacacuggccaaggagggcaucaaaagaggggaaaccgaucaucacgcugugucucggggauccgccaaacuucgcugguucguugagagaaacauggugaccccggagggcaaagucguggaccugggcugcgggcggggaggcuggagcuauuacugugggggacucaagaauguuagagaagugaagggccugacaaaagggggaccuggccaugaggaacccauucccaugucuaccuauggcuggaaccugguccgccuccagagcgggguggauguguuuuucaucccucccgagaagugcgacacacuucugugugauaucggagaauccucuccuaauccgacgguugaggcgggccggacccugagaguccucaaccugguggagaauuggcuuaacaauaacacacaguucugcauuaaagugcugaaucccuacaugccuagcgucaucgaaaagauggaggcccuccaacgcaaauacgggggagcucugguucggaacccccuguccagaaauagcacccacgaaauguauuggguguccaacgccucuggcaauauugugagcuccgucaacaugaucucucgcaugcucauuaaccgguuuacaaugagacauaagaaggcuaccuacgagccugacguggaccuugggagcggaacgcgcaauaucggcauugaauccgagauccccaaccuggauaucauuggcaaacggaucgagaagauuaaacaggaacacgagaccucuuggcacuaugaccaggaucauccguacaagacaugggccuaucacgggagcuacgaaaccaaacagacaggauccgcgagcucuaugguuaauggcguggucagacugcucaccaagccuugggacgugcugcccacaguuacccaaauggccaugacggauacaaccccuuucgggcagcagcgcguguuuaaggagaaagucgacacccggacacaggaacccaaggagggaacgaagaaacuuaugaaaaucaccgcugaguggcuguggaaagaacucggcaaaaagaagacaccuagaauguguacccgcgaggaguucacaagaaaagugcgguccaacgccgcucugggggccauuuuuaccgaugagaauaaguggaaaagcgcucgcgaggccguggaagacucuagauucugggagcuggucgauaaggaacggaaccuccaucuggagggaaaaugcgaaacauguguuuauaauaugaugggcaagagagagaagaaacuuggcgaguuugggaaggcgaaaggaucccgggccaucugguacauguggcugggcgcucgcuuccucgaauuugaggcccugggguuccuuaacgaagaccacugguuuagcagagaaaauucucuguccggaguggaaggcgaggggcuccacaagcugggcuacauccugcgggaugugagcaaaaaggagggaggcgcuauguaugccgacgacaccgccgggugggauacgcgcauuacccucgaagaccugaagaacgaggaaauggucacaaaucauauggagggagaacacaagaaacuugcggaggcuaucuucaaacugaccuaccaaaacaaagugguuagagugcagcggcccacaccgcgcggcaccgucauggauauuaucuccagacgggaccagcgcgggagcggacaagugggcacguaugggcucaauacauuuaccaacauggaggcccagcugauuagacagauggaaggcgagggaguuuucaaaaauauccagcaucuuacagccaccgaagagaucgcugugcaaaacuggcuggcccgggucggccgcgagagacucucucggauggcuauuagcggggaugacugcgugguuaagccucuggaugaccgcuucgccaacgcgcugacggcccucaaugauaugggaaagaucagaaaagacauucagcagugggaacccuccaagggcuggaacgauuggacccaggugcccuuuugcucucaccauuuccacgagcugaucaugaaagacgggcggguccuuguggucccuuguagaaaucaagaugaacugauuggacgcgcucggaucagccagggcgccggguggucccucagagagacagcuugccugggcaagucuuacgcccagauguggagccuuauguauuuucaccgccgggaccugagacucgcggccaacgcuauuuguuccgccgugccgucucauuggguucccaccagccgcacaaccugguccauccacgcuaaacaugaauggaugacaaccgaggacaugcugacgguguggaaucgggucuggaucagagagaacccuuggauggaagauaagacacccguggagagcugggaagagauuccuuaccugggaaagcgcgaagaccaguggugcggcucucucaucgggcugaccucccgggccaccugggcuaaaaauauucaagccgcgaucaaccaggugagaagccuuauuggaaaugaggaguauacagauuacaugcccucuaugaagcgcuuccggagagaagaggaagaggccggcguucugugguga

SEQ ID NO: 19872 - RNA, 9876 nt, Artificial Sequence
  derived and/or modified CDS sequence (opt5) from DENV-2__FJ687445__SS-prME
agcgugggaaugaucauuaugcugauccccaccgugauggccuuccaccucacgacgcggaauggggagccucauaugauuguuuccauccaggaaaagggaaaaucucugcuuuuuaagaccgaggacggagugaauaugugcacacugauggcuauggaucucggggaacugugugaggacaccauuacauacaaaugcccgcuucugcggcaaaacgaacccgaggauaucgacuguuggugcaauuccaccuccacaugggugaccuauggaacguguaccacaaccggcgagcaccgcagagaaaagcggucugucgcccucgugccucauguugggaugggacuggagacacgcaccgaaacguggaugagcuccgagggcgcguggaaacacgcucagagaaucgagacauggauucugcggcaucccggcuucaccaucauggccgccauucucgcuuacacaaucgggaccacccacuuucagcgcacacugauuuucauccuucugacggccguggcuccuucuaugaccaugagaugcauuggaaucagcaaccgggauuuugucgaaggcguguccgggggaagcuggguugacaucgugcucgagcacggcucuugugucacaaccauggccaagaauaagcccacacuggauuucgaacuuauuaaaaccgaggcgaagcagccugccacgcugcgcaaauauugcaucgaagcuaagcucacaaacaccaccacagaguccagauguccgacccaaggggagcccagccugaaagaagaacaggacaagcgguuugugugcaagcauucuaugguggaucgcggauggggcaauggcugugggcuguucggaaaaggcgggauugucacaugcgccauguuuacgugcaagaaaaacauggaaggaaagaucguucagccugagaaucucgaauacaccauuguggugacaccccacuccggcgaggagcaugcugucgggaacgacaccggaaaacacggcaaggaaaucaaagugacaccucagagcucuaucaccgaggccgaacugacgggcuaugggaccguuacaauggaguguucccccagaaccggacuugauuucaaugaaauggugcugcuccaaauggagaacaaggcguggcugguccaccggcagugguuucuugaccugccgcucccuuggcugcccggcgccgauacacaggggagcaauuggauucagaaggagacccuggugacguucaaaaacccucaugcuaagaaacaagacguugugguccucggaucccaggaaggcgccaugcacacagcucugaccggggccacagagauccagaugucuagcggcaaucuucuguuuaccggacaucucaagugccgccugagaauggacaaacuucaacugaagggcauguccuacagcauguguaccgggaaguucaaaguggucaaggaaauugccgagacacagcacggaacgaucgugauucggguucaguaugagggcgaugggucucccugcaaaauccccuucgaaaucauggaccucgagaagagauacgugcugggacgccugauuaccgucaacccuaucgugacagaaaaagauuccccgguuaacauugaggcugaacccccuuuuggcgacagcuacaucauuaucgggguggagcccggccagcucaagcugaauugguucaagaaaggaucuagcauuggccaaauguuugagaccacaaugagaggggcgaagagaauggccauccuuggagauaccgcuugggacuucggcucccucggcggggucuuuacgucuaucgggaaagcccuccaucagguguucggggccauuuauggcgcugccuuuagcggaguguccuggacaaugaagauccugauuggcguuaucauuaccuggaucgggaugaacagccgcucuaccucccugagcgucucucuugugcucgugggagucgugacacuguaccugggcguuauggugcaggcggauuccgggugugucgugagcuggaaaaauaaggaacucaagugcggauccggcaucuucauuaccgacaacguucacacauggacggagcaguauaaauuucaaccugaaucucccagcaagcuggcuuccgccauccagaaagcccaggaggaagggauuuguggcauccggucugugaccagacuugagaaucugauguggaagcagauuacaccggagcucaaccacauccuggcugaaaaugaggucaaacugaccaucaugacaggagauauuaagggcaucaugcaagccgggaaacgcagccuucggccucagcccaccgaacucaaguacuccuggaagacguggggaaaagcuaagaugcugagcaccgagucucauaaccagacauuccugauugacggcccugaaaccgccgagugccccaauacaaacagagcguggaacucccucgagguggaagauuauggguuuggaguuuucaccacaaacaucuggcugaaacuuaaggagaaacaggacgccuuuugugacagcaagcugaugucugcugccauuaaggauaaucgcgcugugcacgccgacaugggcuacuggaucgaauccgcgcucaacgauaccuggaaaaucgagaaggccagcuucauugaggucaaaaauugccauuggccuaagucucacacgcuguggagcaacggcgugcuggaauccgagaugaucauucccaaaaaccuugcugggccggugagccaacacaauuaucggccuggauaccauacacagaucgccggccccuggcaccucgggaagcuggaaauggacuucgauuuuugugacggaaccaccgucguugugacagaggauugcggcaacagagggcccucucugcgcaccacgacagcuuccggaaagcucauuaccgaauggugcugucggagcugcacacugccuccgcuuagauaccggggcgaggacggcuguugguaugggauggagauccgcccccugaaagaaaaggaggaaaaucucgugaacucccuggucaccgccggacauggccagguggauaauuucucucuggggguucuuggaauggcccucuuucuggaggaaaugcugagaacacgggugggcaccaaacacgcuauucuccuggucgcggugagcuucguuacgcuuaucaccgggaacauguccuuuaaggaccugggaagaguggucgugaugguuggcgccacaaugaccgaugacaucggcaugggggugacauaccucgcucugcuggccgccuucaaaguccgcccuaccuuugcugccggacuuuuccugcggaagcucacgucuaaggagcugaugaugacaaccauuggcaucgugcuccugagccaauccacaauucccgagaccauccuugaacugaccgaugcgcucgcucuggggaugauggugcugaaaauggucagagacauggagaaguaucagcuugccguuacaauuauggccauccugugcgugccuaaugcugugauccuccagaacgccuggaaagucucuuguacgauucuggcggugguuagcgugagcccccugcugcuuaccagcucucagcaaaagacagacuggaucccucuggcucucaccauuaaaggacugaaucccacagccaucuuucugaccacgcuuucccgcacaaacaagaaaagaagcuggccgcugaaugaagccauuauggcugucggcauggugucuauccucgccuccagccugcucaagaacgauaucccuaugaccgggccccugguugcuggaggccuucugaccgugugcuacguccugacaggccggucugccgaccucgagcuggaacgcgcgaccgaugugaagugggaggaccaggccgagauuuccgggagcuccccuauccuuagcauuacaaucucugaagauggaagcauguccauuaaaaaugaggaagaggagcagacgcugaccauccucauuagaacaggccugcucgucaucucugggcuguuccccgugagcaucccgauuaccgcugccgcuugguaucuuugggaaguuaagaaacagcgggccggagugcugugggacgucccuucucccccucccaugggcaaggccgagcuggaagauggggcuuaccgcaucaaacaaagaggcauucucggcuauagccagaucggcgcggggguguacaaggagggaacauuucauaccauguggcacguuacgcggggcgccgugcugacccacaaggggaaacgcauugaacccagcugggcugacgucaagaaagaucuuaucuccuacggaggcggguggaagcuggagggagaguggaaagaaggcgaggaaguccaggugcucgcccuggagccuggcaagaacccgagagccguucagacaaagcccggacucuucaaaaccaauacaggaaccaucggcgcugucucucuggacuuuagcccugggacauccggaagccccauuaucgauaagaaaggcaaggugguggggcuuuauggaaacggcgucgugacgcggucuggcgccuacguuuccgcgauugcucaaaccgagaaguccaucgaggacaacccugauauugaggacgacaucuuccgcaagagacggcugacaaucauggaucugcaucccggggccggaaagaccaaaagauaucucccugccauugugcgcgaagcuaucaagcggggccugagaacccuuauucuggccccgacacgcgucguggcggcugagauggaagaggcccuccgggggcugcccaucagauaccagacgccugccauucgcgcugaacacaccggacgggagaucguugaccucaugugucaugccacauucaccaugagacugcuuucucccgugcgcgucccuaauuauaaccugauuaucauggaugaggcucacuuuacagaccccgccuccaucgcggcccggggcuacauuagcaccagaguggaaaugggggaggcugccggcaucuucaugacggcuacaccgccuggaucccgggaucccuuuccccagucuaaugccccuauuaucgacgaagaacgcgagauucccgaaagaagcuggaacuccggccaugaguggguuaccgauuucaaagggaagaccgugugguuugucccuagcaucaaagccggaaaugacaucgcugcgugccugcggaagaacggcaagaaagugauucaacucucucgcaagacauucgauuccgaauaugugaaaaccagaacaaaugacugggauuuugucguuaccacggacaucagcgagaugggggccaacuucaaggcugaacgggugauugacccgagacgcuguaugaaacccgugauccugacagauggagaggagcgggucauucuugccggcccuaugcccgugacccacucuagcgccgcucagagacgcgggcggaucggcagaaauccuaagaacgaaaaugaccaguacaucuacaugggagagccccuggaaaacgaugaggacugcgcccacuggaaagaagcgaagaugcuccuggauaauauuaacacaccggagggcaucauuccuuccauguuugagcccgaacgcgagaagguugacgcuaucgauggggaauaucggcugagaggagaggcccgcaaaaccuucguggaccucaugagacggggcgaucuuccugucuggcuggccuacaagguggcugccgaagggauuaauuaugcggaccgcagaugguguuuugauggaaucaaaaacaaccagauucuggaggagaauguugaaguggagaucuggacgaaggaaggcgagcggaaaaagcucaagccccgcuggcuggacgccagaaucuacucugauccucuugcucugaaagaguucaaggaguucgccgcugggcggaaaagccucacccugaaccugauuacagagaugggcagacuccccaccuuuaugacacaaaagacccgcgacgcccuugacaaucuggcuguccugcauacagccgaagcgggaggccgggccuauaaccacgcucucuccgagcugccggaaacccuugagacgcugcuccugcugacacuccuugccaccgugaccgggggaaucuuccuguuucugaugucuggcagagggauuggaaaaaugacacucggcaugugcugcaucgucaccgcuagcauucugcuuugguacgcccagauccagccucauuggaucgccgcuuccauuauccuggaguucuuucucauugugcugcugauccccgaacccgagaagcagcgcacaccucaagauaaucagcucacguauguugugauugcgauccuuaccguggucgccgcuacaauggccaacgaaaugggcuuccuggagaagaccaaaaaggaccuggggcucggaagcaucgccacacagcagccggaaucuaauauucuggauaucgaccuucggcccgcuuccgccuggacccuguacgcgguugccacgaccuuugugacaccuaugcucagacacagcauugagaacuccucugugaaugucagccugaccgcuaucgccaaccaagcuacagugcugaugggccucgggaaaggauggccccuuuccaagauggauauuggcgccccucugcuggcgaucggguguuacucucagguuaaucccauuacccucacggccgcucugcuucugcucguggcccacuaugcuaucaucggaccuggccugcaggccaaagcuacacgggaggcccagaagcgcgcggccgcuggcauuaugaagaacccgaccgucgacgggaucacagugauugaucuggaccccaucccucaugaucccaaauucgaaaagcaacucggacaggucaugcuucuggugcugugcguuacccaggugcucaugaugagaaccacaugggcccugugugaggcucuuacgcuggccaccggcccuauuagcacacucugggaagggaaucccggacgguuuuggaacaccacaaucgccgucuccauggcgaauaucuuccgcggcagcuaccuggcuggggccggacugcucuuuucuauuaugaaaaacaccacaaauuccagacggggcacaggcaacaucggggagacccuuggagaaaaguggaaaagccgccugaacgcucugggcaagucugaguuccaaauuuauaaaaaguccgggauccaggagguggacagaacccucgccaaggaaggaauuaaacggggcgagacagaucaccaugccguuagccgcgggucugcuaagcugagaugguuuguggaacggaauauggucaccccggagggaaaagugguggaccuuggcugcggcagagggggauggagcuacuauuguggcgggcugaagaacguucgcgaggucaaaggacucacaaagggcgggccuggacacgaagaacccauccccauguccacguacggcuggaaucuggugcggcugcagucuggcguggaugucuucuucaucccucccgaaaagugcgacacccuccuuugugacauuggggagagcuccccuaacccgacaguugaagccggaagaacccugcgcgugcugaaucucguggagaacuggcugaauaacaauacacaguuuugcaucaaaguccuuaaccccuauaugccuagcgugauugagaagauggaaacccugcaacggaaauacggcggggcgcucguuagaaauccccugucccgcaacucuacgcaugagauguacugggugagcaaugccuccggaaacaucgucucuagcgugaauaugauuucccggaugcugaucaacagauucaccaugcgccacaagaaagcuacauaugaaccugauguugaccucggcucugggacccggaacaucggaauugagagcgaaauccccaaucuugauauuaucggcaagagaauugagaagaucaaacaggagcacgaaacauccuggcauuacgaccaggaucacccguauaagaccugggccuaccauggcagcuaugagacaaaacagaccgggucugcuuccagcauggugaacggagucgugcgccugcugacgaagccuugggacgugcuccccacagucacccaaauggccaugaccgauacaacgccuuuuggccagcagcggguuuucaaagaaaagguggacaccagaacacaggagcccaaggaagggaccaaaaagcugaugaaaauuacagcggaguggcuuuggaaggagcugggcaaaaagaaaaccccucgcauguguacaagagaagaguuuacccggaaggugcgcucuaaugccgcucucggcgccaucuucacggaugaaaacaaguggaaauccgcuagagaggccgucgaggacagccgguuuugggaacugguggauaaggagagaaaucugcaccucgaagggaaaugcgagaccuguguuuacaacaugaugggaaagcgggagaaaaagcugggcgaguucggcaaggcuaaagggucucgcgccaucugguauauguggcuuggagcgagauuucuggaguucgaagcccucggcuuucugaaugaggaccacugguucucccgggaaaacagccuuuccgggguggagggagaaggccugcaucgccucggguacauucugagagacgucagcaagaaagagggcggagcuauguacgccgaugacacagcuggcugggauacccggaucacacuggaggaccucaagaaugaagagauggugaccaaccacauggaaggggagcauaaaaagcuggccgaagccauuuuuaaacuuacguaucaaaauaaaguugugcgcguccagagacccacaccgcggggaaccgugauggauaucauuucucgcagagaccagcggggcagcgggcaaguuggaacauacggccugaacaccuucacgaauauggaggcgcagcucauccgccagauggagggggaaggcguguucaagaacauccagcaccugaccgucacagaggaaauugcugugcaaaauuggcuugccagagucggacgggagcgccuguccagaauggccaucucuggcgaugacugcgugguuaaaccucucgaugaccgguuugcuagcgcccugaccgcucugaacgauauggggaagauuagaaaagacauccagcagugggagcccucccgcggauggaacgauuggacacaggugcccuucugcucucaucacuuucacgaacucauuaugaaggacggccggguccugguggugccuuguagaaaucaagacgagcuuaucgggcgcgcccggaucagccagggagcgggcuggucccugagagaaaccgccugccucgggaagucuuaugcucagauguggagccugauguacuuccaucgccgggaucuuagacuggccgcuaacgccauuuguuccgcgguuccgagccacugggugcccacaucucgcaccacgugguccauccaugccaaacacgaguggaugacaaccgaagacaugcucaccgucuggaaucggguguggauucaggagaacccuuggauggaggauaagacacccguugaaagcugggaggaaaucccuuaucugggcaaaagagaggaccaauggugcggaucucugauuggccucaccucccgcgcuacaugggccaagaauauccagguggcuauuaaccagguccggagccugaucgggaaugaagaguacacggauuauaugcccuccaugaaaagauuucggagagaggaagaggaagccggagugcuuugguga

SEQ ID NO: 19873 - RNA, 9876 nt, Artificial Sequence
  derived and/or modified CDS sequence (opt5) from DENV-2__FJ687447__SS-prME
agcgcuggcaugaucauuaugcugauccccacagugauggcuuuccaccuuacaacgagaaauggggagccucauaugauugucggaauccaggaaaagggcaaaucccugcuuuuuaagacagaggacgggguuaauaugugcacacugauggccauggaucucggagaacugugugaggacaccauuacauacaaaugcccgcuucugcggcaaaaugaacccgaggauaucgacuguuggugcaauucuaccuccacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaucccuugauuucaaugaaaugguucugcuccaaauggagaacaaggcuuggcuggugcaccggcagugguuucuugaccugccgcucccuuggcugcccggcgccgauaagcaggagagcaauuggauucagaaagaaacccuggucacauucaagaacccucaugcuaaaaagcaagacgugguugugcucgggucccaggagggagccaugcacaccgcccugacgggcgcuacagaaauccagaugucuagcgggaaucuucuguuuaccggccaucucaaaugccgccugagaauggacaaacuucaacugaagggaauguccuacagcauguguacaggcaaauucaaggucgugaaagagauugcggagacccagcacgggaccaucgucauucgggugcaguaugaaggagauggcucucccugcaagauccccuucgagaucauggaccucgagaagcgguacguucuggggcgccugauuacagugaacccuaucgucacggagaaggauuccccggugaacauugaagccgagcccccuuuuggagacagcuacaucauuaucggcguugagcccgggcagcucaagcugaauugguucaaaaagggcucuagcauuggacaaauguuugaaaccacaaugcggggcgcuaaaagaauggccauccuuggggauaccgccugggacuucggaucccugggcgggguguuuacaucuaucggaaaggcucuccaucaggucuucggcgccauuuauggggcggcuuuuagcggcguguccuggaccaugaaaauccugauuggagugaucauuacguggaucggcaugaacagccgcucuacaucccugagcguuucucuuguccucguggggaucgugacccuguaccugggagucauggugcaggccgauuccggcuguguugugagcuggaagaauaaggagcucaaaugcggguccggaauuuucaucaccgacaacguccacacauggaccgaacaguauaaguuucaaccugagucucccagcaaacuggccuccgcuauucagaaggcccaggaagagggcaucugugggauucggucugugacaagacuugagaaucugauguggaaacagaucacgccggaacucaaccacauccuggcugagaaugaaguuaagcugaccauuaugacaggcgauaucaaaggaauuaugcaagccggcaagcgcagccuucggccucagcccaccgagcucaaguacuccuggaaaacaugggggaaggcgaaaaugcugagcaccgaaucuuauaaccagacguuccugaucgacggaccugagaccgccgagugccccaauacaaacagagcuuggaacucccucgaaguggaggauuacggcuuuggggucuucaccacaaacauuuggcugaaacuuaaagaaaagcaggacgccuuuugugacagcaagcugaugucugcugccaucaaagauaaucgcgcggugcaugccgacaugggauauuggaucgaguccgcucucaacgauaccuggaagauugagaaagccagcuucaucgaaguuaagaauugccacuggccuaaaucucauacacuguggagcaacggcgugcuggaguccgaaaugauuauccccaagaaccuugcuggcccggucagccaacacaauuaccggccuggguaccacacccagauugccggacccuggcaucucggcaagcuggagauggacuucgauuuuugugacgggacgacagugaucgugaccgaagauugcggaaacagaggccccucucugcgcaccacaaccgccuccgggaaacucauuacggaguggugcugucggagcugcacacugccuccgcuuagauaucggggagaggacggcuguugguacggcauggaaauccgcccccugaaggagaaagaagagaaucucgucaacucccugguuaccgcugggcacggacagguggauaauuucucucugggcgugcuugggauggcgcucuuucuggaagagaugcugagaacacgggucggaaccaagcaugccauccuccugguggcuguuagcuucgugacacuuauuaccggcaacauguccuuuaaagaccuggggagagucgugguuauggugggagccacgauggccgaugacaucggcaugggcgucaccuaucucgcucugcuggccgcguucaaggugcgcccuacauuugcugccgggcuucugcuccggaagcugaccucuaaagagcucaugaugacaaccauuggaaucguucugcuuagccaauccacgauucccgaaacaauccuggagcucaccgaugcccuggcucugggcaugauggugcuuaagaucgucagaaauauggaaaaauaccagcuggccgugacaauuauggcgauccucugcgugccuaacgcugucauucugcagaaugccuggaagguuucuuguaccauccucgccguggugagcgucagcccccugcuucugaccagcucucagcagaagacggacuggauuccucucgcucugacgaucaaggggcugaaccccaccgccaucuuccuuacaacccugucccgcacaaauaaaaagagaagcuggccgcucaacgaggcuauuauggccgugggaaugguuucuauccuggcguccagccuccugaagaaugacauuccuaugaccggcccccuuguggccgggggacugcugacggucugcuaugugcucacaggccggucugcugaucuggaacuugagcgcgccaccgacguuaaaugggaggaucaggcugaaaucuccggcagcuccccuauucugagcaucaccauuucugaggacgggagcauguccaucaagaacgaagaggaggaacagacacucaccauccugauuagaacaggacuccuggugaucucuggccuuuuucccauuagcaucccgauuacggccgccgcuugguaccugugggaggucaaaaagcagcgggcgggggugcugugggaugucccuucucccccucccaucggaaaagccgaacucgaggacggcgcuuaucgcaucaagcaaaaggggauucugggauacagccagaucggcgccggcguguacaaagaagggaccuuccacacaauguggcauguuaccagaggagccgugcuuaugcacaagggcaaacggauugagcccagcugggcugaugucaagaaagaccugaucuccuaugggggaggcuggaagcucgagggggaauggaaggagggagaagaggugcagguucuggcccucgaaccuggcaaaaauccgcgcgcggugcagacaaagcccggccuguuuaaaaccaacacggggaccauuggagcugucucucuugauuucagcccuggcacauccgggagccccaucaucgacaagaaaggaaagguggugggccuguacgggaacggaguugucaccagaucuggcgccuauguguccgccauugcucaaacagaaaaguccaucgaggauaauccugaaauugaggacgauaucuuucggaaacgcagacugaccauuauggaccuccaccccggcgccgggaagacaaaacgguaccugccugcgaucgugagagaagcuauuaagcgcggacuucggacgcugauccucgccccgaccagagucguggccgcugagauggaagaggcccugcgcggccuccccauccgguaucagaccccugcuauuagagccgagcauaccgggcgcgaaaucguugaccugaugugucacgcgaccuucacaaugcggcuucugucucccgugagagucccuaacuacaaucugauuaucauggaugaggcccauuucacggaccccgcuuccauugccgcucgcggauauaucagcacccggguggaaaugggcgaggccgccgggaucuuuaugacagcuaccccgccuggcuccagagaucccuucccccagucuaacgcgccuauuaucgacgaggaacgggagauucccgaacgcagcuggaacuccggacacgaguggguuacagauuuuaaaggcaagaccgugugguucgucccuagcaucaaggccgggaacgacauugcugccugccuccgcaagaauggaaagaaagugauccaacugucucggaagacguuugauuccgaauacguuaaaacacgcaccaacgacugggauuucguggucaccacagacaucagcgagaugggcgccaauuuuaaggcugagagagugauugauccgcggagauguaugaaacccgugauccuuaccgacggggaagaaagagucauucuggccggaccuaugcccguuacacauucuagcgcggcucagcggagaggccgcaucgggcggaacccuaagaaugaaaacgaccaguacauuuauaugggcgagccccucgaaaaugaugaggacugcgcccacuggaaggaggccaaaaugcugcuggauaacaucaauaccccggaaggaauuaucccuuccauguucgagcccgaaagagagaagguggacgcuaucgauggcgaauaccgccucagaggggaagccagaaaaacguuuguggaccuuaugcgcagaggagaucugccugucuggcuggcguucaagguggccgcugagggcauuaacuaugccgaccggcgcugguguuuugaugggaucaaaaacaaucagauucucgaagagaacguugaaguggagaucuggacaaaggagggagaaagaaagaaacugaagccccgguggcuugacgcucgcauuuacucugauccucuggcccucaaagaguucaaggaguucgcugccggcagaaaaagccugacccugaaucucaucacagagauggggcggcuucccaccuuuaugacgcaaaagaccagagacgcgcuggauaaccuggccguccuccacacagcugaagccggcggacgcgcuuauaaucaugcccuguccgagcuuccggagacccuggaaacacuccugcugcucacccuucuggccacagugaccggcgggaucuuccuguuucucaugucuggacggggcauugggaagaugacgcugggaaugugcugcaucauuacagcuagcauccuucugugguacgcgcagauucagccucacuggaucgccgcuuccaucauucucgaguucuuucugaucguucugcucauucccgaacccgagaaacagagaaccccucaagacaaccagcuuaccuauguggucaucgccauucugacaguggucgccgcuaccauggccaaugaaaugggcuuccuggagaagaccaagaaggaccucggccuggggagcaucgcgacgcagcagccggagucuaacauucuugauaucgaccugcgccccgccuccgcuuggacccucuacgccguggcuacaaccuuuguuacaccuaugcugcggcauagcaucgaaaauuccucugugaacgugagccugaccgccauugcgaaucaagccacgguccucaugggacuuggcaaaggguggccccuguccaagauggauaucggaguuccucugcucgcuauuggcuguuacucucaggugaaccccaucacccugacagccgcccuucugcuccugguggcccacuaugcuauuaucgggccuggacugcaggccaaggcgaccagagaggcccagaaacgggcugccgcuggcaucaugaagaauccgacagucgacggcauuaccgugaucgaucucgaccccauuccuuacgaucccaaauucgaaaagcaacuugggcagguuaugcugcugauccucugcgugacgcagguccugaugaugcgcacaaccugggcccuuugugaggcccugacacucgcgaccggaccuauuagcacccugugggaaggcaaccccgggagauuuuggaauacaacgaucgcuguguccauggccaacaucuuccggggaagcuaucuggcuggcgccgggcuccucuuuucuauuaugaaaaauaccacaaacacccgcagaggaacaggcaacaucggcgagacccugggggagaaguggaaaucccggcugaaugcccucggaaagagcgaguuccaaauuuacaagaaaucuggcauccaggaggucgaccgcacgcuggcuaaggaagggauuaaaagaggagagacagaucaccaugccgugucccggggcagcgcgaaacuucgcugguuuguugagagaaacauggugaccccggaagggaaagucguggaccugggaugcggccggggcggguggucuuauuacuguggaggccucaagaauguuagagaggugaaggggcugaccaaaggaggcccugggcacgaggaacccauccccaugagcacauauggauggaaccugguccgccuccaguccggcguggauguguucuucaucccucccgaaaagugcgacacccuucugugugauauuggcgagucuagcccuaauccgacaguugaggccgggcggacgcugagaguccucaaccugguggaaaauuggcuuaacaauaacacccaguuuugcaucaaagugcugaaucccuacaugccuuccgucauugagaagauggaagcucuccaacgcaaauacggaggcgcccugguucggaacccccugagcagaaauuccacacaugagauguauugggugucuaacgcuagcgggaauaucguguccucugucaacaugauuagccgcaugcucaucaaccgguucaccaugagacacaagaaggccacauacgaaccugacguggaccuuggauccggcacccgcaauauugggaucgagucugagauccccaaccuggauauuaucggaaaacggauugaaaagaucaaacaggagcaugaaacgagcuggcacuaugaccaggaucacccguacaagaccugggcguaucauggcuccuacgagacaaaacagaccggcagcgccucuuccaugguuaaugggguggucagacugcucacaaagccuugggacgugcugcccaccguuacacaaauggcuaugaccgauacgacaccuuuuggacagcagcgcguguucaaggaaaaagucgacacccggacccaggagcccaaggagggcaccaagaaacuuaugaaaauuacggccgaauggcuguggaaggagcucgggaaaaagaagaccccuagaauguguacacgcgaagaguuuaccagaaaagugcggagcaacgcugcccugggagcuaucuucacagaugagaauaaguggaaaucugcccgcgaagcgguggaggacuccagauuuugggaacuggucgauaaggagcggaaccuccaccuggaaggcaaaugcgagaccuguguuuauaauaugauggggaagagagagaagaaacuuggagaguucggcaaggccaaaggcagccgggcuaucugguacauguggcugggggcccgcuuucucgaguucgaagcucugggauuucuuaacgaggaccauugguucucuagagaaaauucccugagcggcguggagggggagggacuccacaagcugggcuacauucugcgggauguguccaaaaaggaagggggcgccauguaugccgacgacacagcgggaugggauacccgcaucacgcucgaggaccugaagaacgaagagauggucaccaaucacauggaaggcgagcauaagaaacuugcugaggccauuuuuaaacugacauaccaaaacaaagugguuagagugcagcggcccaccccgcgcgggacagucauggauaucauuagcagacgggaccagcgcggaucuggccaaguggggaccuauggacucaauacguucacaaacauggaagcccagcugaucagacagauggagggcgaagggguuuucaaaaauauccagcaccuuaccgugacagaggaggucgcugugcaaaacuggcuggcccggguuggccgcgaaagacucagccggauggcuauuuccggagaugacugcguggucaagccucuggaugaccgcuuugccaacgcgcugaccgcccucaaugauaugggcaagaucagaaaagacauucagcagugggagcccucuaagggguggaacgauuggacacaggugcccuucugcagccaucacuuucaugaacugaucaugaaagacggacggguccuugugguuccuuguagaaaucaagaugagcugauuggccgcgcucggaucucccagggggccggauggucucucagagaaaccgcuugccugggcaagagcuacgcccagauguggucccuuauguauuuccaccgccgggaccugagacucgcggccaacgcuauuuguucugccgugccgagccacuggguccccacaucccgcaccacauggagcauccaugcuaaacacgaguggaugaccacagaggacaugcugaccguguggaaucggguguggaucagagaaaacccuuggauggaggauaagacgcccguugaaucuugggaggaaauuccuuaccuggggaagcgcgaggaccaguggugcggcucccucaucggacugacaagccgggccaccugggcuaaaaauauucaagccgcgaucaaccaggugagaucucuuauuggcaaugaggaauauaccgauuacaugcccuccaugaagcgcuuucggagagaggaagaggaagccgggguccugugguga

SEQ ID NO: 19874 - RNA, 9876 nt, Artificial Sequence
  derived and/or modified CDS sequence (opt5) from DENV-2__FJ810411__SS-prME
agcgcuggcaugaucauuaugcugauccccacagugauggcuuuccaccuuacaacgagaaauggggagccucauaugauugucggaauccaggaaaagggcaaaucccugcuuuuuaagacagaggacgggguuaauaugugcacacugauggccauggaucucggagaacugugugaggacaccauuacauacaaaugcccgcuucugcggcaaaaugaacccgaggauaucgacuguuggugcaauucuaccuccacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaucccuugauuucaaugaaaugguucugcuccaaauggagaacaaggcuuggcuggugcaccggcagugguuucuugaccugccgcucccuuggcugcccggcgccgauaagcaggagagcaauuggauucagaaagaaacccuggucacauucaagaacccucaugcuaaaaagcaagacgugguugugcucgggucccaggagggagccaugcacaccgcccugacgggcgcuacagaaauccagaugucuagcgggaaucuucuguuuaccggccaucucaaaugccgccugagaauggacaaacuucaacugaagggaauguccuacagcauguguacaggcaaauucaaggucgugaaagagauugcggagacccagcacgggaccaucgucauucgggugcaguaugaaggagauggcucucccugcaagauccccuucgagaucauggaccucgagaagcgguacguucuggggcgccugauuacagugaacccuaucgucacggagaaggauuccccggugaacauugaagccgagcccccuuuuggagacagcuacaucauuaucggcguugagcccgggcagcucaagcugaauugguucaaaaagggcucuagcauuggacaaauguuugaaaccacaaugcggggcgcuaaaagaauggccauccuuggggauaccgccugggacuucggaucccugggcgggguguuuacaucuaucggaaaggcucuccaucaggucuucggcgccauuuauggggcggcuuuuagcggcguguccuggaccaugaaaauccugauuggagugaucauuacguggaucggcaugaacagccgcucuacaucccugagcguuucucuuguccucguggggaucgugacccuguaccugggagucauggugcaggccgauuccggcuguguugugagcuggaagaauaaggagcucaaaugcggguccggaauuuucaucaccgacaacguccacacauggaccgaacaguauaaguuucaaccugagucucccagcaaacuggccuccgcuauucagaaggcccaggaagagggcaucugugggauucggucugugacaagacuugagaaucugauguggaaacagaucacgccggaacucaaccacauccuggcugagaaugaaguuaagcugaccauuaugacaggcgauaucaaaggaauuaugcaagccggcaagcgcagccuucggccucagcccaccgagcucaaguacuccuggaaaacaugggggaaggcgaaaaugcugagcaccgaaucuuauaaccagacguuccugaucgacggaccugagaccgccgagugccccaauacaaacagagcuuggaacucccucgaaguggaggauuacggcuuuggggucuucaccacaaacauuuggcugaaacuuaaagaaaagcaggacgccuuuugugacagcaagcugaugucugcugccaucaaagauaaucgcgcggugcaugccgacaugggauauuggaucgaguccgcucucaacgauaccuggaagauugagaaagccagcuucaucgaaguuaagaauugccacuggccuaaaucucauacacuguggagcaacggcgugcuggaguccgaaaugauuauccccaagaaccuugcuggcccggucagccaacacaauuaccggccuggguaccacacccagauugccggacccuggcaucucggcaagcuggagauggacuucgauuuuugugacgggacgacagugaucgugaccgaagauugcggaaacagaggccccucucugcgcaccacaaccgccuccgggaaacucauuacggaguggugcugucggagcugcacacugccuccgcuuagauaucggggagaggacggcuguugguacggcauggaaauccgcccccugaaggagaaagaagagaaucucgucaacucccugguuaccgcugggcacggacagguggauaauuucucucugggcgugcuugggauggcgcucuuucuggaagagaugcugagaacacgggucggaaccaagcaugccauccuccugguggcuguuagcuucgugacacuuauuaccggcaacauguccuuuaaagaccuggggagagucgugguuauggugggagccacgauggccgaugacaucggcaugggcgucaccuaucucgcucugcuggccgcguucaaggugcgcccuacauuugcugccgggcuucugcuccggaagcugaccucuaaagagcucaugaugacaaccauuggaaucguucugcuuagccaauccacgauucccgaaacaauccuggagcucaccgaugcccuggcucugggcaugauggugcuuaagaucgucagaaauauggaaaaauaccagcuggccgugacaauuauggcgauccucugcgugccuaacgcugucauucugcagaaugccuggaagguuucuuguaccauccucgccguggugagcgucagcccccugcuucugaccagcucucagcagaagacggacuggauuccucucgcucugacgaucaaggggcugaaccccaccgccaucuuccuuacaacccugucccgcacaaauaaaaagagaagcuggccgcucaacgaggcuauuauggccgugggaaugguuucuauccuggcguccagccuccugaagaaugacauuccuaugaccggcccccuuguggccgggggacugcugacggucugcuaugugcucacaggccggucugcugaucuggaacuugagcgcgccaccgacguuaaaugggaggaucaggcugaaaucuccggcagcuccccuauucugagcaucaccauuucugaggacgggagcauguccaucaagaacgaagaggaggaacagacacucaccauccugauuagaacaggacuccuggugaucucuggccuuuuucccauuagcaucccgauuacggccgccgcuugguaccugugggaggucaaaaagcagcgggcgggggugcugugggaugucccuucucccccucccaucggaaaagccgaacucgaggacggcgcuuaucgcaucaagcaaaaggggauucugggauacagccagaucggcgccggcguguacaaagaagggaccuuccacacaauguggcauguuaccagaggagccgugcuuaugcacaagggcaaacggauugagcccagcugggcugaugucaagaaagaccugaucuccuaugggggaggcuggaagcucgagggggaauggaaggagggagaagaggugcagguucuggcccucgaaccuggcaaaaauccgcgcgcggugcagacaaagcccggccuguuuaaaaccaacacggggaccauuggagcugucucucuugauuucagcccuggcacauccgggagccccaucaucgacaagaaaggaaagguggugggccuguacgggaacggaguugucaccagaucuggcgccuauguguccgccauugcucaaacagaaaaguccaucgaggauaauccugaaauugaggacgauaucuuucggaaacgcagacugaccauuauggaccuccaccccggcgccgggaagacaaaacgguaccugccugcgaucgugagagaagcuauuaagcgcggacuucggacgcugauccucgccccgaccagagucguggccgcugagauggaagaggcccugcgcggccuccccauccgguaucagaccccugcuauuagagccgagcauaccgggcgcgaaaucguugaccugaugugucacgcgaccuucacaaugcggcuucugucucccgugagagucccuaacuacaaucugauuaucauggaugaggcccauuucacggaccccgcuuccauugccgcucgcggauauaucagcacccggguggaaaugggcgaggccgccgggaucuuuaugacagcuaccccgccuggcuccagagaucccuucccccagucuaacgcgccuauuaucgacgaggaacgggagauucccgaacgcagcuggaacuccggacacgaguggguuacagauuuuaaaggcaagaccgugugguucgucccuagcaucaaggccgggaacgacauugcugccugccuccgcaagaauggaaagaaagugauccaacugucucggaagacguuugauuccgaauacguuaaaacacgcaccaacgacugggauuucguggucaccacagacaucagcgagaugggcgccaauuuuaaggcugagagagugauugauccgcggagauguaugaaacccgugauccuuaccgacggggaagaaagagucauucuggccggaccuaugcccguuacacauucuagcgcggcucagcggagaggccgcaucgggcggaacccuaagaaugaaaacgaccaguacauuuauaugggcgagccccucgaaaaugaugaggacugcgcccacuggaaggaggccaaaaugcugcuggauaacaucaauaccccggaaggaauuaucccuuccauguucgagcccgaaagagagaagguggacgcuaucgauggcgaauaccgccucagaggggaagccagaaaaacguuuguggaccuuaugcgcagaggagaucugccugucuggcuggcguucaagguggccgcugagggcauuaacuaugccgaccggcgcugguguuuugaugggaucaaaaacaaucagauucucgaagagaacguugaaguggagaucuggacaaaggagggagaaagaaagaaacugaagccccgguggcuugacgcucgcauuuacucugauccucuggcccucaaagaguucaaggaguucgcugccggcagaaaaagccugacccugaaucucaucacagagauggggcggcuucccaccuuuaugacgcaaaagaccagagacgcgcuggauaaccuggccguccuccacacagcugaagccggcggacgcgcuuauaaucaugcccuguccgagcuuccggagacccuggaaacacuccugcugcucacccuucuggccacagugaccggcgggaucuuccuguuucucaugucuggacggggcauugggaagaugacgcugggaaugugcugcaucauuacagcuagcauccuucugugguacgcgcagauucagccucacuggaucgccgcuuccaucauucucgaguucuuucugaucguucugcucauucccgaacccgagaaacagagaaccccucaagacaaccagcuuaccuauguggucaucgccauucugacaguggucgccgcuaccauggccaaugaaaugggcuuccuggagaagaccaagaaggaccucggccuggggagcaucgcgacgcagcagccggagucuaacauucuugauaucgaccugcgccccgccuccgcuuggacccucuacgccguggcuacaaccuuuguuacaccuaugcugcggcauagcaucgaaaauuccucugugaacgugagccugaccgccauugcgaaucaagccacgguccucaugggacuuggcaaaggguggccccuguccaagauggauaucggaguuccucugcucgcuauuggcuguuacucucaggugaaccccaucacccugacagccgcccuucugcuccugguggcccacuaugcuauuaucgggccuggacugcaggccaaggcgaccagagaggcccagaaacgggcugccgcuggcaucaugaagaauccgacagucgacggcauuaccgugaucgaucucgaccccauuccuuacgaucccaaauucgaaaagcaacuugggcagguuaugcugcugauccucugcgugacgcagguccugaugaugcgcacaaccugggcccuuugugaggcccugacacucgcgaccggaccuauuagcacccugugggaaggcaaccccgggagauuuuggaauacaacgaucgcuguguccauggccaacaucuuccggggaagcuaucuggcuggcgccgggcuccucuuuucuauuaugaaaaauaccacaaacacccgcagaggaacaggcaacaucggcgagacccugggggagaaguggaaaucccggcugaaugcccucggaaagagcgaguuccaaauuuacaagaaaucuggcauccaggaggucgaccgcacgcuggcuaaggaagggauuaaaagaggagagacagaucaccaugccgugucccggggcagcgcgaaacuucgcugguuuguugagagaaacauggugaccccggaagggaaagucguggaccugggaugcggccggggcggguggucuuauuacuguggaggccucaagaauguuagagaggugaaggggcugaccaaaggaggcccugggcacgaggaacccauccccaugagcacauauggauggaaccugguccgccuccaguccggcguggauguguucuucaucccucccgaaaagugcgacacccuucugugugauauuggcgagucuagcccuaauccgacaguugaggccgggcggacgcugagaguccucaaccugguggaaaauuggcuuaacaauaacacccaguuuugcaucaaagugcugaaucccuacaugccuuccgucauugagaagauggaagcucuccaacgcaaauacggaggcgcccugguucggaacccccugagcagaaauuccacacaugagauguauugggugucuaacgcuagcgggaauaucguguccucugucaacaugauuagccgcaugcucaucaaccgguucaccaugagacacaagaaggccacauacgaaccugacguggaccuuggauccggcacccgcaauauugggaucgagucugagauccccaaccuggauauuaucggaaaacggauugaaaagaucaaacaggagcaugaaacgagcuggcacuaugaccaggaucacccguacaagaccugggcguaucauggcuccuacgagacaaaacagaccggcagcgccucuuccaugguuaaugggguggucagacugcucacaaagccuugggacgugcugcccaccguuacacaaauggcuaugaccgauacgacaccuuuuggacagcagcgcguguucaaggaaaaagucgacacccggacccaggagcccaaggagggcaccaagaaacuuaugaaaauuacggccgaauggcuguggaaggagcucgggaaaaagaagaccccuagaauguguacacgcgaagaguuuaccaaaaaggugagaagcaacgcugcccugggagcuaucuucacagaugagaauaaauggaagucugcccgggaagcgguggaggacucccgcuuuugggaacuggucgauaaagagagaaaccuccaccuggaaggcaagugcgagaccuguguuuauaauaugauggggaagcgggagaagaaacuuggagaguucggcaaagccaaaggcagcagagcuaucugguacauguggcugggggcccgguuucucgaguucgaagcucugggauuucuuaacgaggaccauugguucucucgcgaaaauucccugagcggcguggagggggagggacuccacaaacugggcuacauucugagagauguguccaagaaggaagggggcgccauguaugccgacgacacagcgggaugggauacccggaucacgcucgaggaccugaaaaacgaagagauggucaccaaucacauggaaggcgagcauaagaaacuugcugaggccauuuuuaagcugacauaccaaaacaaagugguucgcgugcagagacccaccccgcgggggacagucauggauaucauuagccgcagagaccagcggggaucuggccaaguggggaccuauggacucaauacguucacaaacauggaagcccagcugauccgccagauggagggcgaagggguuuucaagaauauccagcaccuuaccgugacagaggaggucgcugugcaaaacuggcuggccagaguuggccgggaacgccucagcagaauggcuauuuccggagaugacugcguggucaagccucuggaugaccgguuugccaacgcgcugaccgcccucaaugauaugggcaaaauccgcaaggacauucagcagugggagcccucuaaaggguggaacgauuggacacaggugcccuucugcagccaucacuuucaugaacugaucaugaaggacggaagaguccuugugguuccuugucggaaucaagaugagcugauuggcagagcucgcaucucccagggggccggauggucucuccgggaaaccgcuugccugggcaaaagcuacgcccagauguggucccuuauguauuuccacagacgcgaccugcggcucgcggccaacgcuauuuguucugccgugccgagccacuggguccccacauccagaaccacauggagcauccaugcuaagcacgaguggaugaccacagaggacaugcugaccguguggaaucgcguguggauccgggaaaacccuuggauggaggauaagacgcccguugaaucuugggaggaaauuccuuaccuggggaaaagagaggaccaguggugcggcucccucaucggacugacaagccgcgccaccugggcuaagaauauucaagccgcgaucaaccaggugcggucucuuauuggcaaugaggaauauaccgauuacaugcccuccaugaaaagauuucgccgggaggaagaggaagccgggguccugugguga

SEQ ID NO: 19875 - RNA, 9876 nt, Artificial Sequence
  derived and/or modified CDS sequence (opt5) from DENV-2__FJ744713__SS-prME
agcgcuggcaugaucauuaugcugauccccaccgugauggcuuuccaccuuacaacgagaaauggggagccucauaugauugucggaauccaggaaaagggcaagucccugcuuuuuaagaccgaggacgggguuaauaugugcacacugauggccauggaucucggagaacugugugaggacaccauuacauacaagugcccgcuucugcggcaaaaugaacccgaggauaucgacuguuggugcaauucuaccuccacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaucccuugauuucaaugaaaugguucugcuccaaauggagaacaaggcuuggcuggugcaccggcagugguuucuugaccugccgcucccuuggcugcccggcgccgauaagcaggagagcaauuggauucagaaagaaacccuggucacauucaagaacccucaugcuaaaaagcaagacgugguugugcucgggucccaggagggagccaugcacaccgcccugacgggcgcuacagaaauccagaugucuagcgggaaucuucuguuuaccggccaucucaaaugccgccugagaauggacaaacuucaacugaagggaauguccuacagcauguguacaggcaaauucaaggucgugaaagagauugcggagacccagcacgggaccaucgucauucgggugcaguaugaaggagauggcucucccugcaagauccccuucgagaucauggaccucgagaagcgguacguucuggggcgccugauuacagugaacccuaucgucacggagaaggauuccccggugaacauugaagccgagcccccuuuuggagacagcuacaucauuaucggcguugagcccgggcagcucaagcugaauugguucaaaaagggcucuagcauuggacaaauguuugaaaccacaaugcggggcgcuaaaagaauggccauccuuggggauaccgccugggacuucggaucccugggcgggguguuuacaucuaucggaaaggcucuccaucaggucuucggcgccauuuauggggcggcuuuuagcggcguguccuggaccaugaaaauccugauuggagugaucauuacguggaucggcaugaacagccgcucuacaucccugagcguuucucuuguccucguggggaucgugacccuguaccugggagucauggugcaggccgauuccggcuguguugugagcuggaagaauaaggagcucaaaugcggguccggaauuuucaucaccgacaacguccacacauggaccgaacaguauaaguuucaaccugagucucccagcaaacuggccuccgcuauucagaaggcccaggaagagggcaucugugggauucggucugugacaagacuugagaaucugauguggaaacagaucacgccggaacucaaccacauccuggcugagaaugaaguuaagcugaccauuaugacaggcgauaucaaaggaauuaugcaagccggcaagcgcagccuucggccucagcccaccgagcucaaguacuccuggaaaacaugggggaaggcgaaaaugcugagcaccgaaucuuauaaccagacguuccugaucgacggaccugagaccgccgagugccccaauacaaacagagcuuggaacucccucgaaguggaggauuacggcuuuggggucuucaccacaaacauuuggcugaaacuuaaagaaaagcaggacgccuuuugugacagcaagcugaugucugcugccaucaaagauaaucgcgcggugcaugccgacaugggauauuggaucgaguccgcucucaacgauaccuggaagauugagaaagccagcuucaucgaaguuaagaauugccacuggccuaaaucucauacacuguggagcaacggcgugcuggaguccgaaaugauuauccccaagaaccuugcuggcccggucagccaacacaauuaccggccuggguaccacacccagauugccggacccuggcaucucggcaagcuggagauggacuucgauuuuugugacgggacgacagugaucgugaccgaagauugcggaaacagaggccccucucugcgcaccacaaccgccuccgggaaacucauuacggaguggugcugucggagcugcacacugccuccgcuuagauaucggggagaggacggcuguugguacggcauggaaauccgcccccugaaggagaaagaagagaaucucgucaacucccugguuaccgcugggcacggacagguggauaauuucucucugggcgugcuugggauggcgcucuuucuggaagagaugcugagaacacgggucggaaccaagcaugccauccuccugguggcuguuagcuucgugacacuuauuaccggcaacauguccuuuaaagaccuggggagagucgugguuauggugggagccacgauggccgaugacaucggcaugggcgucaccuaucucgcucugcuggccgcguucaaggugcgcccuacauuugcugccgggcuucugcuccggaagcugaccucuaaagagcucaugaugacaaccauuggaaucguucugcuuagccaauccacgauucccgaaacaauccuggagcucaccgaugcccuggcucugggcaugauggugcuuaagaucgucagaaauauggaaaaauaccagcuggccgugacaauuauggcgauccucugcgugccuaacgcugucauucugcagaaugccuggaagguuucuuguaccauccucgccguggugagcgucagcccccugcuucugaccagcucucagcagaagaccgacuggauuccucucgcucugacgaucaaggggcugaaccccaccgccaucuuccuuacaacccugucccgcacaaauaaaaagagaagcuggccgcucaacgaggcuauuauggccgugggaaugguuucuauccuggcguccagccuccugaagaaugacauuccuaugaccggcccccuuguggccgggggacugcugacggucugcuaugugcucacaggccggucugcugaucuggaacuugagcgcgccaccgacguuaaaugggaggaucaggcugaaaucuccggcagcuccccuauucugagcaucaccauuucugaggacgggagcauguccaucaagaacgaagaggaggaacagauccucacaauucugaucagaaccggacuccuggugauuucuggccuuuuucccaucagcauuccgaucacagccgccgcuugguaccugugggaggucaaaaagcagcgggcgggggugcugugggaugucccuucucccccucccaucggaaaagccgaacucgaggacggcgcuuaucgcauuaagcaaaaggggauccugggauacagccagauuggcgccggcguguacaaagaagggacguuccacaccauguggcauguuacaagaggagccgugcuuaugcacaagggcaaacggaucgagcccagcugggcugaugucaagaaagaccugauuuccuaugggggaggcuggaagcucgagggggaauggaaggagggagaagaggugcagguucuggcccucgaaccuggcaaaaauccgcgcgcggugcagaccaagcccggccuguuuaaaacaaacaccgggacgaucggagcugucucucuugauuucagcccuggcaccuccgggagccccaucauugacaagaaaggaaagguggugggccuguacgggaacggaguugucacaagaucuggcgccuauguguccgccaucgcucaaaccgaaaaguccauugaggauaauccugaaaucgaggacgauauuuuucggaaacgcagacugacaaucauggaccuccaccccggcgccgggaagaccaaacgguaccugccugcgauugugagagaagcuaucaagcgcggacuucggacacugauccucgccccgacgagagucguggccgcugagauggaagaggcccugcgcggccuccccauucgguaucagaccccugcuaucagagccgagcauacagggcgcgaaauuguugaccugaugugucacgcgaccuucaccaugcggcuucugucucccgugagagucccuaacuacaaucugaucauuauggaugaggcccauuucacagaccccgcuuccaucgccgcucgcggauauaucagcacgcggguggaaaugggcgaggccgccgggauuuuuaugaccgcuacaccgccuggcuccagagaucccuucccccagucuaacgcgccuaucauugacgaggaacgggagauccccgaacgcagcuggaacuccggacacgaguggguuaccgauuuuaaaggcaagacagugugguucgucccuagcauuaaggccgggaacgacaucgcugccugccuccgcaagaauggaaagaaagugauccaacugucucggaagaccuuugauuccgaauacguuaaaacgcgcacaaacgacugggauuucguggucaccaccgacauuagcgagaugggcgccaauuuuaaggcugagagagugaucgauccgcggagauguaugaaacccgugauucuuacagacggggaagaaagagucauccuggccggaccuaugcccguuacccauucuagcgcggcucagcggagaggccgcauugggcggaacccuaagaaugaaaacgaccaguacaucuauaugggcgagccccucgaaaaugaugaggacugcgcccacuggaaggaggccaaaaugcugcuggauaacauuaauacaccggaaggaaucaucccuuccauguucgagcccgaaagagagaagguggacgcuauugauggcgaauaccgccucagaggggaagccagaaaaaccuuuguggaccuuaugcgcagaggagaucugccugucuggcuggcguucaagguggccgcugagggcaucaacuaugccgaccggcgcugguguuuugaugggauuaaaaacaaucagauccucgaagagaacguugaaguggagauuuggacgaaggagggagaaagaaagaaacugaagccccgguggcuugacgcucgcaucuacucugauccucuggcccucaaagaguucaaggaguucgcugccggcagaaaaagccugacacugaaucucaucaccgagauggggcggcuucccacauuuaugacccaaaagacgagagacgcgcuggauaaccuggccguccuccacaccgcugaagccggcggacgcgcuuauaaucaugcccuguccgagcuuccggagacacuggaaacccuccugcugcucacacuucuggccaccgugacaggcgggauuuuccuguuucucaugucuggacggggcaucgggaagaugacccugggaaugugcugcauuaucacggcuagcauucuucugugguacgcgcagauccagccucacuggaucgccgcuuccauuauccucgaguucuuucugauuguucugcucauccccgaacccgagaaacagagaacaccucaagacaaccagcuuaccuauguggucauugccauccugaccguggucgccgcuacaauggccaaugaaaugggcuuccuggagaagaccaaaaaggaccucggccuggggagcauugcgacacagcagccggagucuaacauccuugauaucgaccugcgccccgccuccgcuuggacgcucuacgccguggcuaccacauuuguuaccccuaugcugcggcauagcauugaaaauuccucugugaacgugagccugacagccaucgcgaaucaagccaccguccucaugggacuuggcaaaggguggccccuguccaagauggauauuggaguuccucugcucgcuaucggcuguuacucucaggugaaccccauuacgcugaccgccgcccuucugcuccugguggcccacuaugcuaucaucgggccuggacugcaggccaaggcgacaagagaggcccagaaacgggcugccgcuggcauuaugaagaauccgaccgucgacggcaucacagugauugaucucgaccccaucccuuacgaucccaaauucgaaaagcaacuugggcagguuaugcugcugauucucugcgugacccagguccugaugaugcgcacgacaugggcccuuugugaggcccugacccucgcgacaggaccuaucagcacccugugggaaggcaaccccgggagauuuuggaauaccacaaucgcuguguccauggccaacauuuuccggggaagcuaucuggcuggcgccgggcuccucuuuucuaucaugaaaaauacgaccaacacacgcagaggaaccggcaacauuggcgagacacugggggagaaguggaaaucccggcugaaugcccucggaaagagcgaguuccaaaucuacaagaaaucuggcauucaggaggucgaccgcacccuggcuaaggaagggaucaaaagaggagagacggaucaccaugccgugucccggggcagcgcgaaacuucgcugguuuguugagagaaacauggugacaccggaagggaaagucguggaccugggaugcggccggggcggguggucuuauuacuguggaggccucaagaauguuagagaggugaaggggcugaccaaaggaggcccugggcacgaggaacccauccccaugagcaccuauggauggaaccugguccgccuccaguccggcguggauguguucuucauuccucccgaaaagugcgacacacuucugugugauaucggcgagucuagcccuaauccgaccguugaggccgggcggacacugagaguccucaaccugguggaaaauuggcuuaacaauaacacgcaguuuugcauuaaagugcugaaucccuacaugccuuccgucaucgagaagauggaagcucuccaacgcaaauacggaggcgcccugguucggaacccccugagcagaaauuccacccaugagauguauugggugucuaacgcuagcgggaauauuguguccucugucaacaugaucagccgcaugcucauuaaccgguucacaaugagacacaagaaggccaccuacgaaccugacguggaccuuggauccggcacacgcaauaucgggaucgagucugagauucccaaccuggauaucauuggaaaacggaucgaaaagauuaaacaggagcaugaaaccagcuggcacuaugaccaggaucacccguacaagacgugggcguaucauggcuccuacgagaccaaacagacaggcagcgccucuuccaugguuaaugggguggucagacugcucaccaagccuugggacgugcugcccacaguuacccaaauggcuaugacagauaccacgccuuuuggacagcagcgcguguucaaggaaaaagucgacacacggacccaggagcccaaggagggcaccaagaaacuuaugaaaaucacagccgaauggcuguggaaagagcucgggaaaaagaagacgccuagaauguguacccgcgaagaguuuacaagaaaagugcggagcaacgcugcccugggagcuaucuucaccgaugagaauaaguggaaaucugcccgcgaagcgguggaggacuccagauuuugggaacuggucgauaaggagcggaaccuccaccuggaaggcaaaugcgagacauguguuuauaauaugauggggaagagagagaagaaacuuggagaguucggcaaggccaaaggcagccgggcuauuugguacauguggcugggggcccgcuuucucgaguucgaagcucugggauuucuuaacgaggaccauugguucucuagagaaaauucccugagcggcguggagggggagggacuccacaagcugggcuacauccugcgggauguguccaaaaaggaagggggcgccauguaugccgacgacaccgcgggaugggauacacgcauuacccucgaggaccugaagaacgaagagauggucacgaaucacauggaaggcgagcauaagaaacuugcugaggccaucuuuaaacugaccuaccaaaacaaagugguuagagugcagcggcccacaccgcgcgggaccgucauggauauuaucagcagacgggaccagcgcggaucuggccaaguggggacauauggacucaauaccuucacgaacauggaagcccagcugaucagacagauggagggcgaagggguuuucaaaaauauucagcaccuuacagugaccgaggaggucgcugugcaaaacuggcuggcccggguuggccgcgaaagacucagccggauggcuaucuccggagaugacugcguggucaagccucuggaugaccgcuuugccaacgcgcugacagcccucaaugauaugggcaagauuagaaaagacauccagcagugggagcccucuaagggguggaacgauuggacccaggugcccuucugcagccaucacuuucaugaacugauuaugaaagacggacggguccuugugguuccuuguagaaaucaagaugagcugaucggccgcgcucggauuucccagggggccggauggucucucagagaaacggcuugccugggcaagagcuacgcccagauguggucccuuauguauuuccaccgccgggaccugagacucgcggccaacgcuaucuguucugccgugccgagccacuggguccccaccucccgcacaaccuggagcauccaugcuaaacacgaguggaugacaaccgaggacaugcugacaguguggaaucggguguggauuagagaaaacccuuggauggaggauaagacccccguugaaucuugggaggaaaucccuuaccuggggaagcgcgaggaccaguggugcggcucccucauuggacugacgagccgggccacaugggcuaaaaauauccaagccgcgauuaaccaggugagaucucuuaucggcaaugaggaauauaccgauuacaugcccuccaugaagcgcuuucggagagaggaagaggaagccgggguccugugguga

SEQ ID NO: 19876 - RNA, 9876 nt, Artificial Sequence
  derived and/or modified CDS sequence (opt5) from DENV-2__FJ744714__SS-prME
agcgccggcaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacagacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagagaauccugggauacucccagaucggcgcuggcguguacaaagaagggaccuuccacacaauguggcaugucacccggggagccgugcuuaugcacaagggcaaacgcauugagcccuccugggccgauguuaagaaagaccugaucagcuaugggggaggcuggaagcucgagggggaauggaaggagggagaagaggugcagguccuggcucucgaaccuggcaaaaauccgagagccgugcagacaaagcccggccuguuuaaaaccaacacggggaccauuggagcggugucccuugauuucucuccuggcacaagcgggucccccaucauugacaagaaaggaaagguugucggccuguacgggaacggaguggugacccggagcggcgcuuaugucucugccaucgcccaaacagagaaguccaucgaggauaauccugaaauugaggacgauaucuuucgcaaaagacggcugaccauuauggaccuccaccccggcgcugggaagacaaaaagauaccugccugccaucgugcgcgaagcgauuaagcggggacuuagaacgcugauccucgcuccgacccgcguuguggccgccgagauggaagaggcucugcggggccuccccauuagauaucagaccccugccauccgcgcugagcauaccgggcgggaaaucgucgaccugaugugucacgccaccuucacaaugagacuucugagccccgugcgcguuccuaacuacaaucugauuaucauggaugaggcgcauuucacggaccccgccucuauugcugcccggggauauaucuccaccagaguggaaaugggcgaggcugccgggauuuuuaugacagccaccccgccuggcagccgggaucccuucccccaguccaacgcuccuaucaucgacgaggaacgcgagauucccgaaagaucuuggaauagcggacacgagugggucacagauuuuaaaggcaagaccgugugguucguuccuuccaucaaggcggggaacgacauugccgcuugccuccggaaaaauggaaagaaagugauccaacugagccgcaagacguuugauucugaauacgucaaaacaagaaccaacgacugggauuucguggugaccacagacauuuccgagaugggcgccaauuuuaaggccgagcgggucaucgauccgagacgcuguaugaaacccguuauccuuaccgacggggaggaacgggugauucuggcuggaccuaugcccgugacacauagcucugccgcgcagagacgcggccggaucgggagaaacccuaagaaugaaaacgaccaguacauuuauaugggcgagccccucgaaaaugaugaggacugcgcucacuggaaggaggccaaaaugcugcuggauaacaucaauaccccggaaggaauuaucccuagcauguucgagcccgaacgcgagaaggucgacgccauugauggcgaauaccggcucagaggggaggcucgcaaaacguuuguggaccuuaugagacggggagaucugccuguuuggcuggccuauaagguggcggccgagggcaucaacuacgcugaccgcagaugguguuucgaugggaucaaaaacaaucagauucucgaagagaacgucgaaguggagaucuggacaaaggagggagaacggaagaaacugaagccccgcuggcuugacgccagaauuuauuccgauccucuggcucucaaagaguuuaaggaguucgccgcuggccggaaaucucugacccugaaucucaucacagagauggggagacuucccaccuucaugacgcaaaagacccgcgacgcccuggauaaccuggcgguucuccacacagccgaagcuggcggacgggccuacaaucaugcucugagcgagcuuccggagacccuggaaacacuccugcugcucacccuucuggccacagugaccggcgggauuuuucuguuccucauguccggaagaggcaucgggaagaugacgcugggaaugugcugcaucauuacagccucuauccuucugugguaugcucagauucagccucacuggaucgcggccagcauuauccucgaguuuuuccugaucguccugcucauucccgaacccgagaaacagcgcaccccucaagacaaccagcuuaccuacguggucaucgcuauucugacagugguugccgccaccauggcuaaugaaaugggcuuucuggagaagaccaagaaggaccucggccugggguccaucgccacgcagcagccggagagcaacauucuugauaucgaccugcggcccgcgucugccuggacccucuacgcuguggccacaaccuucgugacaccuaugcugagacauuccauugaaaauagcuccgucaacguuucucugaccgcuaucgccaaucaagcgacggugcucaugggacuuggcaaaggguggccccugagcaagauggauaucggagugccucugcucgccauuggcuguuauucccaggucaaccccaucacccugacagcugcccuucugcuccugguggcucacuacgccauuaucgggccuggacugcaggcuaaggccacccgggaggcgcagaaacgcgccgcugccggcauuaugaagaauccgacaguugacggcaucaccgugaucgaucucgaccccauuccuuaugaucccaaauuugaaaagcaacuugggcaggucaugcugcugauccucugcgugacgcagguccugaugaugagaacaaccugggcucuuugugaggcccugacacucgccaccggaccuauuucuacccugugggaaggcaaccccgggcgguucuggaauacaacgaucgcggugagcauggcuaacauuuuucgcggauccuaccuggccggcgcugggcuccuuuucagcaucaugaaaaauaccacaaacaccagacggggaacaggcaacaucggcgagacccugggggagaaguggaaaucucgccugaaugcccucggaaaguccgaauuucaaauuuauaagaaaagcggcauccaggagguugacagaacgcuggccaaggaagggauuaaacggggagagacagaucaccaugcugugucucgcggcuccgccaaacuuagaugguucgucgagcggaacauggugaccccggaagggaaaguuguggaccugggaugcggcagaggcggguggagcuacuauuguggaggccucaagaauguccgcgaggugaaggggcugaccaaaggaggcccugggcacgaagaacccauccccaugucuacauacggauggaaccuggugcggcuccagagcggcguugaugucuuuuucauuccucccgaaaagugcgacacccuucugugugauaucggcgaguccucuccuaauccgacaguggaggcggggagaacgcugcgcgugcucaaccuggucgaaaauuggcuuaacaauaacacccaguucugcaucaaaguucugaaucccuacaugccuagcgugauugagaagauggaagcccuccaacggaaauauggaggcgcucuggugagaaacccccugucccgcaauagcacacaugagauguacugggucuccaacgccucugggaauaucgugagcuccguuaacaugauuucucggaugcucaucaacagauuuaccaugcgccacaagaaggcuacauaugaaccugacguggaccuuggaagcggcacccggaauauugggaucgaguccgagguccccaaccuggauauuaucggaaaaagaaucgaaaagauuaaacaggagcaugaaacgucuuggcacuacgaccaggaucacccguauaagaccugggccuaccauggcagcuaugagacaaaacagaccggcuccgcgagcucuauggugaaugggguugugcgccugcucacaaagccuugggacguccugcccaccgugacacaaauggccaugaccgauacgacaccuuucggacagcagcggguguuuaaggaaaaagucgacaccagaacccaggagcccaaggagggcaccaagaaacuuaugaaaaucacggcugaauggcuguggaaggagcucgggaaaaagaagaccccucgcauguguacaagagaagaguucacccggaaaguucgcuccaacgccgcucugggagccauuuuuacagaugagaauaaguggaaaagcgcuagagaagccguggaggacucucgguucugggaacugguggauaaggagagaaaccuccaccuggaaggcaaaugcgagaccugugucuacaauaugauggggaagcgggagaagaaacuuggagaauuuggcaaggcgaaaggcucccgcgccaucugguacauguggcugggggcuagauuccucgaguuugaagcccugggauuccuuaacgaggaccauugguuuagccgggaaaauucucuguccggcguggagggggagggacuccacaagcugggcuauauucugcgcgauguuagcaaaaaggaagggggcgcuauguacgccgacgacacagccggaugggauaccagaaucacgcucgaggaccugaagaacgaagagauggugaccaaucacauggaaggcgagcauaagaaacuugcggaggcuaucuucaaacugacauaucaaaacaaagucgugcggguucagcgccccaccccgagagggacagugauggauauuaucucccggcgcgaccagagaggaagcggccaagucgggaccuacggacucaauacguuuacaaacauggaagcccagcugauucggcagauggagggcgaagggguguucaaaaauauccagcaccuuaccguuacagaggagguggccguccaaaacuggcuggcucgcgugggcagagaacggcucucucgcauggccauuagcggagaugacugcgucgugaagccucuggaugacagauucgcuaacgcccugaccgcgcucaaugauaugggcaagauccggaaagacauccagcagugggagcccuccaagggguggaacgauuggacgcagguucccuuuugcucucaucacuuccaugaacugauuaugaaagacggaagagugcuugucgugccuugucgcaaucaagaugagcugaucggccgggccagaauuagccagggggcuggauggucccuccgcgaaaccgccugccugggcaagucuuaugcucagauguggagccuuauguacuuucaccggagagaccugcgccucgccgcgaacgccaucuguuccgcugugccgucucacuggguucccacaagccggaccacaugguccauucaugccaaacacgaguggaugaccacagaggacaugcugaccguguggaauagagucuggauccgcgaaaacccuuggauggaggauaagacgcccguggaaagcugggaggaaauuccuuaucuggggaagcgggaggaccaguggugcggcucucucaucggacugacauccagagcuaccugggccaaaaauauccaagcugccauuaaccagguucgcagccuuaucggcaaugaggaauacaccgauuacaugcccucuaugaagcgguucagacgggaggaagaggaagcgggggugcugugguga

SEQ ID NO: 19877 - RNA, 9876 nt, Artificial Sequence
  derived and/or modified CDS sequence (opt5) from DENV-2__FJ744716__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacagacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagagaauccugggauacucccagaucggcgcuggcguguacaaagaagggaccuuccacacaauguggcaugucacccggggagccgugcuuaugcacaagggcaaacgcauugagcccuccugggccgauguuaagaaagaccugaucagcuaugggggaggcuggaagcucgagggggaauggaaggagggagaagaggugcagguccuggcucucgaaccuggcaaaaauccgagagccgugcagacaaagcccggccuguuuaaaaccaacacggggaccauuggagcggugucccuugauuucucuccuggcacaagcgggucccccaucauugacaagaaaggaaagguugucggccuguacgggaacggaguggugacccggagcggcgcuuaugucucugccaucgcccaaacagagaaguccaucgaggauaauccugaaauugaggacgauaucuuucgcaaaagacggcugaccauuauggaccuccaccccggcgcugggaagacaaaaagauaccugccugccaucgugcgcgaagcgauuaagcggggacuuagaacgcugauccucgcuccgacccgcguuguggccgccgagauggaagaggcucugcggggccuccccauuagauaucagaccccugccauccgcgcugagcauaccgggcgggaaaucgucgaccugaugugucacgccaccuucacaaugagacuucugagccccgugcgcguuccuaacuacaaucugauuaucauggaugaggcgcauuucacggaccccgccucuauugcugcccggggauauaucuccaccagaguggaaaugggcgaggcugccgggauuuuuaugacagccaccccgccuggcagccgggaucccuucccccaguccaacgcuccuaucaucgacgaggaacgcgagauucccgaaagaucuuggaauagcggacacgagugggucacagauuuuaaaggcaagaccgugugguucguuccuuccaucaaggcggggaacgacauugccgcuugccuccggaaaaauggaaagaaagugauccaacugagccgcaagacguuugauucugaauacgucaaaacaagaaccaacgacugggauuucguggugaccacagacauuuccgagaugggcgccaauuuuaaggccgagcgggucaucgauccgagacgcuguaugaaacccguuauccuuaccgacggggaggaacgggugauucuggcuggaccuaugcccgugacacauagcucugccgcgcagagacgcggccggaucgggagaaacccuaagaaugaaaacgaccaguacauuuauaugggcgagccccucgaaaaugaugaggacugcgcucacuggaaggaggccaaaaugcugcuggauaacaucaauaccccggaaggaauuaucccuagcauguucgagcccgaacgcgagaaggucgacgccauugauggcgaauaccggcucagaggggaggcucgcaaaacguuuguggaccuuaugagacggggagaucugccuguuuggcuggccuauaagguggcggccgagggcaucaacuacgcugaccgcagaugguguuucgaugggaucaaaaacaaucagauucucgaagagaacgucgaaguggagaucuggacaaaggagggagaacggaagaaacugaagccccgcuggcuugacgccagaauuuauuccgauccucuggcucucaaagaguuuaaggaguucgccgcuggccggaaaucucugacccugaaucucaucacagagauggggagacuucccaccuucaugacgcaaaagacccgcgacgcccuggauaaccuggcgguucuccggacagccgaagcuggcggcagagccuacaaucacgcucugagcgagcuuccggagacccuggaaacacuccugcugcucacccuucuggccacagugaccggcgggauuuuucuguuccucauguccggacgcggcaucgggaagaugacgcugggaaugugcugcaucauuacagccucuauccuucugugguaugcucagauucagccucauuggaucgcggccagcauuauccucgaguuuuuccugaucguccugcucauucccgaacccgagaaacagcggaccccucaagacaaccagcuuaccuacguggucaucgcuauucugacagugguugccgccaccauggcuaaugaaaugggcuuucuggagaagaccaagaaggaccucggccugggguccaucgccacgcagcagccggagagcaacauucuugauaucgaccugagacccgcgucugccuggacccucuacgcuguggccacaaccuucgugacaccuaugcugcggcacuccauugaaaauagcuccgucaacguuucucugaccgcuaucgccaaucaagcgacggugcucaugggacuuggcaaaggguggccccugagcaagauggauaucggagugccucugcucgccauuggcuguuauucccaggucaaccccaucacccugacagcugcccuucugcuccugguggcucauuacgccauuaucgggccuggacugcaggcuaaggccacccgcgaggcgcagaaaagagccgcugccggcauuaugaagaauccgacaguugacggcaucaccgugaucgaucucgaccccauuccuuaugaucccaaauuugaaaagcaacuugggcaggucaugcugcugauccucugcgugacgcagguccugaugaugcggacaaccugggcucuuugugaggcccugacacucgccaccggaccuauuucuacccugugggaaggcaaccccgggcgcuucuggaauacaacgaucgcggugagcauggcuaacauuuuuagaggauccuaccuggccggcgcugggcuccuuuucagcaucaugaaaaauaccacaaacacccggcgcggaacaggcaacaucggcgagacccugggggagaaguggaaaucuagacugaaugcccucggaaaguccgaauuucaaauuuauaagaaaagcggcauccaggagguugaccggacgcuggccaaggaagggauuaaacgcggagagacagaucaccacgcugugucuagaggcuccgccaaacuucggugguucgucgagagaaacauggugaccccggaagggaaaguuguggaccugggaugcggccgcggcggguggagcuacuauuguggaggccucaagaauguccgggaggugaaggggcugaccaaaggaggcccugggcaugaagaacccauccccaugucuacauacggauggaaccuggugagacuccagagcggcguugaugucuuuuucauuccucccgaaaagugcgacacccuucugugugauaucggcgaguccucuccuaauccgacaguggaggcggggcgcacgcugcgggugcucaaccuggucgaaaauuggcuuaacaauaacacccaguucugcaucaaaguucugaaucccuacaugccuagcgugauugagaagauggaagcccuccaaagaaaauauggaggcgcucuggugcgcaacccccugucccggaauagcacacacgagauguacugggucuccaacgccucugggaauaucgugagcuccguuaacaugauuucuagaaugcucaucaaccgcuuuaccaugcggcauaagaaggcuacauaugaaccugacguggaccuuggaagcggcaccagaaauauugggaucgaguccgagguccccaaccuggauauuaucggaaaacgcaucgaaaagauuaaacaggagcacgaaacgucuuggcauuacgaccaggaucacccguauaagaccugggccuaccacggcagcuaugagacaaaacagaccggcuccgcgagcucuauggugaaugggguugugcggcugcucacaaagccuugggacguccugcccaccgugacacaaauggccaugaccgauacgacaccuuucggacagcagagaguguuuaaggaaaaagucgacacccgcacccaggagcccaaggagggcaccaagaaacuuaugaaaaucacggcugaauggcuguggaaggagcucgggaaaaagaagaccccuagaauguguacacgggaagaguucacccgcaaaguuagauccaacgccgcucugggagccauuuuuacagaugagaauaaguggaaaagcgcucgggaagccguggaggacucuagauucugggaacugguggauaaggagcggaaccuccaucuggaaggcaaaugcgagaccugugucuacaauaugauggggaagcgcgagaagaaacuuggagaauuuggcaaggcgaaaggcuccagagccaucugguacauguggcugggggcucgguuccucgaguuugaagcccugggauuccuuaacgaggaccacugguuuagccgcgaaaauucucuguccggcguggagggggagggacuccauaagcugggcuauauucugagagauguuagcaaaaaggaagggggcgcuauguacgccgacgacacagccggaugggauacccggaucacgcucgaggaccugaagaacgaagagauggugaccaaucacauggaaggcgagcacaagaaacuugcggaggcuaucuucaaacugacauaucaaaacaaagucgugcgcguucagagacccaccccgcgggggacagugauggauauuaucucccgcagagaccagcggggaagcggccaagucgggaccuacggacucaauacguuuacaaacauggaagcccagcugauucgccagauggagggcgaagggguguucaaaaauauccagcaucuuaccguuacagaggagguggccguccaaaacuggcuggcuagagugggccgggaacgccucucuagaauggccauuagcggagaugacugcgucgugaagccucuggaugaccgguucgcuaacgcccugaccgcgcucaaugauaugggcaagaucagaaaagacauccagcagugggagcccuccaagggguggaacgauuggacgcagguucccuuuugcucucaccauuuccacgaacugauuaugaaagacggacgcgugcuugucgugccuugucggaaucaagaugagcugaucggcagagcccgcauuagccagggggcuggauggucccuccgggaaaccgccugccugggcaagucuuaugcucagauguggagccuuauguacuuucauagacgcgaccugcggcucgccgcgaacgccaucuguuccgcugugccgucucacuggguucccacaagcagaaccacaugguccauucacgccaaacaugaguggaugaccacagaggacaugcugaccguguggaaucgcgucuggauccgggaaaacccuuggauggaggauaagacgcccguggaaagcugggaggaaauuccuuaucuggggaagagagaggaccaguggugcggcucucucaucggacugacaucccgcgcuaccugggccaaaaauauccaagcugccauuaaccagguucggagccuuaucggcaaugaggaauacaccgauuacaugcccucuaugaagagauuccggagagaggaagaggaagcgggggugcugugguga

SEQ ID NO: 19878 - RNA, 9876 nt, Artificial Sequence
  derived and/or modified CDS sequence (opt5) from DENV-2__FJ744718__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucggcggggucuuuacauccaucgggaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacagacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacgucaaaacacgcaccaacgacugggauuucguggugaccacagacauuuccgagaugggggccaauuuuaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaaagagagaaggucgacgccauugauggggaauaccgccuccggggagaggcuagaaaaacguuuguggaccuuaugcgcagaggcgaucugccuguuuggcuggccuauaagguggcggccgaggggaucaacuacgcugaccggcgcugguguuucgauggaaucaaaaacaaucagauucucgaagagaacgucgaaguggagaucuggacaaaggagggcgaaagaaagaaacugaagccccgguggcuugacgcccgcauuuauuccgauccucuggcucucaaagaguuuaaggaguucgccgcugggagaaaaucucugacccugaaucucaucacagagaugggccggcuucccaccuucaugacgcaaaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacagagaaccccucaagacaaccagcuuaccuacguggucaucgcuauucugacagugguugccgccaccauggcuaaugaaaugggcuuucuggagaagaccaagaaggaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaaacgggccgcugccggcauuaugaagaauccgacaguugacgggaucaccgugaucgaucucgaccccauuccuuaugaucccaaauuugaaaagcaacuuggacaggucaugcugcugauccucugcgugacgcagguccugaugaugcgcacaaccugggcucuuugugaggcccugacacucgccaccggcccuauuucuacccugugggaagggagccccggaagauucuggaacacaacgaucgcgguguccauggcuaauauuuuucggggcagcuaccuggccggggcuggacuccuuuucucuaucaugaaaaacaccacaaauacccgcagaggcacaggcaacaucggggagacccugggagagaaguggaaaucccggcugaacgcccucggcaagagcgaauuucaaauuuauaagaaaucugggauccaggagguugaccgcacgcuggccaaggaaggaauuaaaagaggcgagacagaucaccaugcugugucccgggggagcgccaaacuucgcugguucgucgagagaaauauggugaccccggaaggaaaaguuguggaccugggcugcggcagagggggauggucuuacuauuguggcgggcucaagaacguccgggaggugaagggacugaccaaaggcgggccuggacacgaagaacccauccccaugagcacauacggcuggaaucuggugcgccuccaguccggcguugaugucuuuuucauuccucccgaaaagugcgacacccuucugugugauaucggggagucuagcccuaacccgacaguggaggcgggacggacgcugagagugcucaaucuggucgaaaacuggcuuaauaacaauacccaguucugcaucaaaguucugaaccccuacaugccuuccgugauugagaagauggaagcccuccaacgcaaauauggcggggcucuggugcggaauccccugagcagaaacuccacacaugagauguacugggucucuaaugccagcggaaacaucguguccucuguuaauaugauuagccgcaugcucaucaaccgguuuaccaugagacacaagaaggcuacauaugaaccugacguggaccuuggcuccgggacccgcaacauuggaaucgagucugagguccccaaucuggauauuaucggcaaacggaucgaaaagauuaaacaggagcaugaaacgagcuggcacuacgaccaggaucacccguauaagaccugggccuaccauggcuccuaugagacaaaacagaccgggagcgcgucuuccauggugaacggaguugugagacugcucacaaagccuugggacguccugcccaccgugacacaaauggccaugaccgauacgacaccuuucggccagcagcgcguguuuaaggaaaaagucgacacccggacccaggagcccaaggaggggaccaagaaacuuaugaaaaucacggcugaauggcuguggaaggagcucggcaaaaagaagaccccuagaauguguacacgcgaagaguucaccagaaaaguucggagcaaugccgcucugggcgccauuuuuacagaugagaacaaguggaaaucugcucgcgaagccguggaggacuccagauucugggaacugguggauaaggagcggaaucuccaccuggaagggaaaugcgagaccugugucuacaacaugaugggaaagagagagaagaaacuuggcgaauuuggcaaggcgaaagggagccgggccaucugguacauguggcugggagcucgcuuccucgaguuugaagcccugggcuuccuuaaugaggaccauugguuuucuagagaaaacucccugagcgggguggagggagagggccuccacaagcugggguauauucugcgggauguuuccaaaaaggaaggcggagcuauguacgccgacgacacagccggcugggauacccgcaucacgcucgaggaccugaagaaugaagagauggugaccaaccacauggaaggggagcauaagaaacuugcggaggcuaucuucaaacugacauaucaaaauaaagucgugagaguucagcggcccaccccgcgcggaacagugauggauauuaucagcagacgggaccagcgcggcucugggcaagucggaaccuacggccucaacacguuuacaaauauggaagcccagcugauuagacagauggagggggaaggcguguucaaaaacauccagcaccuuaccguuacagaggagguggccguccaaaauuggcuggcucgggugggacgcgaaagacucagccggauggccauuuccggcgaugacugcgucgugaagccucuggaugaccgcuucgcuaacgcccugaccgcgcucaacgauauggggaagaucagaaaagacauccagcagugggagcccucuaagggauggaaugauuggacgcagguucccuuuugcagccaucacuuccaugaacugauuaugaaagacggccgggugcuugucgugccuuguagaaaccaagaugagcugaucgggcgcgcccggauuucccagggagcuggcuggucucucagagaaaccgccugccugggaaagagcuaugcucagauguggucccuuauguacuuucaccgccgggaccugagacucgccgcgaaugccaucuguucugcugugccgagccacuggguucccacaucccgcaccacauggagcauucaugccaaacacgaguggaugaccacagaggacaugcugaccguguggaaccgggucuggaucagagaaaauccuuggauggaggauaagacgcccguggaaucuugggaggaaauuccuuaucugggcaagcgcgaggaccaguggugcggaucccucaucggccugacaagccgggcuaccugggccaaaaacauccaagcugccauuaaucagguuagaucucuuaucgggaacgaggaauacaccgauuacaugcccuccaugaagcgcuuccggagagaggaagaggaagcgggagugcugugguga

SEQ ID NO: 19879 - RNA, 9876 nt, Artificial Sequence
  derived and/or modified CDS sequence (opt5) from DENV-2__FJ744722__SS-prME
agcgugggaaugaucauuaugcugauccccaccgugauggccuuccaccucacaacgcggaacggggagccucauaugauuguuuccauccaggaaaagggaaaaucucugcuuuuuaagaccgaggacggcgugaauaugugcacacugauggcuauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucugucgcccucgugccucauguugggaugggacuggagacacgcaccgaaacguggaugagcuccgagggcgcguggaaacacgcucagagaaucgagacauggauucugcggcaucccggcuucaccaucauggccgccauucucgcuuacacaaucgggaccacccacuuucagcgcacacugauuuucauccuucugacggccguggcuccuucuaugaccaugagaugcauuggaaucagcaaccgggauuuugucgaaggcguguccgggggaagcuggguugacaucgugcucgagcacggcucuugugucacaaccauggccaagaauaagcccacacuggauuucgaacuuauuaaaaccgaggcgaagcagccugccacgcugcgcaaauauugcaucgaagcuaagcucacaaacaccaccacagaguccagauguccgacccaaggggagcccaaucugaaagaagaacaggacaagcgguuugugugcaagcauagcaugguggaucgcggauggggcaacggcugugggcuguucggaaaaggcgggauugucacaugcgccauguuuacgugcaagaaaaauauggaaggaaagaucguucagccugagaaccucgaauacaccauuguggugacaccccacucuggcgaggagcaugcugucgggaaugacaccggaaaacacggcaaggaaaucaaagugacaccucaguccagcaucaccgaggccgaacugacgggcuaugggaccguuacaauggaguguucucccagaaccggacuugauuucaacgaaauggugcugcuccaaauggagaauaaggcguggcugguccaccggcagugguuucuugaccugccgcucccuuggcugcccggcgccgauacacagggguccaacuggauucagaaggagacccuggugacguucaaaaauccucaugcuaagaaacaagacguugugguccucggaagccaggaaggcgccaugcacacagcucugaccggggccacagagauccagauguccucuggcaaccuucuguuuaccggacaucucaagugccgccugagaauggacaaacuucaacugaagggcaugagcuacuccauguguaccgggaaguucaaaguggucaaggaaauugccgagacacagcacggaacgaucgugauucggguucaguaugagggcgaugggagccccugcaaaauccccuucgaaaucauggaccucgagaagagauacgugcugggacgccugauuaccgucaacccuaucgugacagaaaaagauucuccgguuaauauugaggcugaacccccuuuuggcgacuccuacaucauuaucgggguggagcccggccagcucaagcugaacugguucaagaaaggaagcucuauuggccaaauguuugagaccacaaugagaggggcgaagagaauggccauccuuggagauaccgcuugggacuucggcagccucggaggggucuuuacguccaucggcaaagcccuccaucagguguucggggccauuuauggcgcugccuuuucuggagugagcuggacaaugaagauccugauuggcguuaucauuaccuggaucgggaugaauagccgcagcaccucucuguccgucagccuugugcucgugggagucgugacacuguaccugggcguuauggugcaggcggauucugggugugucguguccuggaaaaacaaggaacucaagugcggaagcggcaucuucauuaccgacaauguucacacauggacggagcaguauaaauuucaaccugaaucccccucuaagcuggcuagcgccauccagaaagcccaggaggaagggauuuguggcauccgguccgugaccagacuugagaaccugauguggaagcagauuacaccggagcucaaucacauccuggcugaaaacgaggucaaacugaccaucaugacaggagauauuaagggcaucaugcaagccgggaaacgcucucuucggccucagcccaccgaacucaaguacagcuggaagacguggggaaaagcuaagaugcuguccaccgagagccauaaucagacauuccugauugacggcccugaaaccgccgagugccccaacacaaauagagcguggaacucucucgagguggaagauuauggguuuggaguuuucaccacaaauaucuggcugaaacuuaaggagaaacaggacgccuuuugugacuccaagcugaugagcgcugccauuaaggauaaccgcgcugugcacgccgacaugggcuacuggaucgaaucugcgcucaaugauaccuggaaaaucgagaaggccuccuucauugaggucaaaaacugccauuggccuaagagccacacgcuguggucuaacggcgugcuggaaagcgagaugaucauucccaaaaaucuugcugggccggugucccaacacaacuaucggccuggauaccauacacagaucgccggccccuggcaccucgggaagcuggaaauggacuucgauuuuugugacggaaccaccgucguugugacagaggauugcggcaauagagggcccagccugcgcaccacgacagcuucuggaaagcucauuaccgaauggugcugucgguccugcacacugccuccgcuuagauaccggggcgaggacggcuguugguaugggauggagauccgcccccugaaagaaaaggaggaaaaccucgugaauagccuggucaccgccggacauggccagguggauaacuucucccuggggguucuuggaauggcccucuuucuggaggaaaugcugagaacacgggugggcaccaaacacgcuauucuccuggucgcggugucuuucguuacgcuuaucaccgggaauaugagcuuuaaggaccugggaagaguggucgugaugguuggcgccacaaugaccgaugacaucggcaugggggugacauaccucgcucugcuggccgccuucaaaguccgcccuaccuuugcugccggacuuuuccugcggaagcucacguccaaggagcugaugaugacaaccauuggcaucgugcuccugucucaaagcacaauucccgagaccauccuugaacugaccgaugcgcucgcucuggggaugauggugcugaaaauggucagagacauggagaaguaucagcuugccguuacaauuauggccauccugugcgugccuaacgcugugauccuccagaaugccuggaaagucuccuguacgauucuggcggugguuucugugagcccccuccugcuuaccuccagccagcaaaagacagacuggaucccucuggcucucaccauuaaaggacugaaccccacagccaucuuucugaccacgcuuucucgcacaaauaagaaaagauccuggccgcugaacgaagccauuauggcugucggcauggugagcauccucgccucuucccugcucaagaaugauaucccuaugaccgggccccugguugcuggaggccuucugaccgugugcuacguccugacaggccggagcgccgaccucgagcuggaacgcgcgaccgaugugaagugggaggaccaggccgagauuucuggguccagcccuauccuuuccauuacaaucagcgaagauggaucuaugagcauuaaaaacgaggaagaggagcagacgcugaccauccucauuagaacaggccugcucgucaucuccgggcuguuccccgugucuaucccgauuaccgcugccgcuugguaucuuugggaaguuaagaaacagcgggccggagugcugugggacgucccuucucccccucccaugggcaaggccgagcuggaagauggggcuuaccgcaucaaacaaagagggauucugggcuauucccagaucggcgcggggguguacaaggagggaacauuucauaccauguggcacguuacgcggggcgccgugcugacccacaaggggaaacgcauugaacccuccugggcugacgucaagaaagaucuuaucagcuacggaggcggguggaagcuggagggagaguggaaagaaggcgaggaaguccaggugcucgcccuggagccuggcaagaauccgagagccguucagacaaagcccggacucuucaaaaccaacacaggaaccaucggcgcugucucccuggacuuuucuccugggacaagcggaucccccauuaucgauaagaaaggcaaggugguggggcuuuauggaaacggcgucgugacgcggagcggcgccuacguuucugcgauugcucaaaccgaaaaauccaucgaggacaauccugauauugaggacgacaucuuccgcaagagacggcugacaaucauggaucugcaucccggggccggaaagaccaaaagauaucucccugccauugugcgcgaagcuaucaagcggggccugagaacccuuauucuggccccgacacgcgucguggcggcugagauggaagaggcccuccgggggcugcccaucagauaccagacgccugccauucgcgcugaacacaccggacgggagaucguugaccucaugugucaugccacauucaccaugagacugcuuagccccgugcgcgucccuaacuauaaucugauuaucauggaugaggcucacuuuacagaccccgccucuaucgcggcccggggcuacauuuccaccagaguggaaaugggggaggcugccggcaucuucaugacggcuacaccgccuggaagccgggaucccuuuccccaguccaacgccccuauuaucgacgaagaacgcgagauucccgaaagaucuuggaauagcggccaugaguggguuaccgauuucaaagggaagaccgugugguuugucccuuccaucaaagccggaaacgacaucgcugcgugccugcggaagaauggcaagaaagugauucaacucagccgcaagacauucgauucugaauaugugaaaaccagaacaaacgacugggauuuugucguuaccacggacaucuccgagaugggggccaauuucaaggcugaacgggugauugacccgagacgcuguaugaaacccgugauccugacagauggagaggagcgggucauucuugccggcccuaugcccgugacccacagcucugccgcucagagacgcgggcggaucggcagaaacccuaagaaugaaaacgaccaguacaucuacaugggagagccccuggaaaaugaugaggacugcgcccacuggaaagaagcgaagaugcuccuggauaacauuaauacaccggagggcaucauuccuagcauguuugagcccgaacgcgagaagguugacgcuaucgauggggaauaucggcugagaggagaggcccgcaaaaccuucguggaccucaugagacggggcgaucuuccugucuggcuggccuacaagguggcugccgaagggauuaacuaugcggaccgcagaugguguuuugauggaaucaaaaacaaucagauucuggaggagaacguugaaguggagaucuggacgaaggaaggcgagcggaaaaagcucaagccccgcuggcuggacgccagaaucuacuccgauccucuugcucugaaagaguucaaggaguucgccgcugggcggaaaucucucacccugaaucugauuacagagaugggcagacuccccaccuuuaugacacaaaagacccgcgacgcccuugacaaccuggcuguccugcauacagccgaagcgggaggccgggccuauaaucacgcucucagcgagcugccggaaacccuugagacgcugcuccugcugacacuccuugccaccgugaccgggggaaucuuccuguuucugauguccggcagagggauuggaaaaaugacacucggcaugugcugcaucgucaccgcuucuauucugcuuugguacgcccagauccagccucauuggaucgccgcuagcauuauccuggaguucuuucucauugugcugcugauccccgaacccgagaagcagcgcacaccucaagauaaccagcucacguauguugugauugcgauccuuaccguggucgccgcuacaauggccaaugaaaugggcuuccuggagaagaccaaaaaggaccuggggcucggauccaucgccacacagcagccggaaagcaacauucuggauaucgaccuucggcccgcuucugccuggacccuguacgcgguugccacgaccuuugugacaccuaugcucagacacuccauugagaauagcuccgugaacgucucucugaccgcuaucgccaaucaagcuacagugcugaugggccucgggaaaggauggccccuuagcaagauggauauuggcgccccucugcuggcgaucggguguuacucccagguuaaccccauuacccucacggccgcucugcuucugcucguggcccacuaugcuaucaucggaccuggccugcaggccaaagcuacacgggaggcccagaagcgcgcggccgcuggcauuaugaagaauccgaccgucgacgggaucacagugauugaucuggaccccaucccuuacgaucccaaauucgaaaagcaacucggacaggucaugcuucuggugcugugcguuacccaggugcucaugaugagaaccacaugggcccugugugaggcucuuacgcuggccaccggcccuauuucuacacucugggaagggaaccccggacgguuuuggaauaccacaaucgccgucagcauggcgaacaucuuccgcggcuccuaucuggcuggggccggacugcucuuuagcauuaugaaaaauaccacgaacucuagacggggcacaggcaacaucggggagacccuuggagaaaaguggaaaucccgccugaaugcucugggcaagagcgaguuccaaauuuacaaaaagucugggauccaggagguggacagaacccucgccaaggaaggaauuaaacggggcgagacagaucaucacgccguuucccgcgggagcgcuaagcugagaugguuuguggaacggaacauggucaccccggagggaaaagugguggaccuuggcugcggcagagggggauggucuuauuacuguggcgggcugaagaauguucgcgaggucaaaggacucacaaagggcgggccuggacaugaggaacccauccccaugagcacguauggcuggaaccuggugcggcugcaguccggcguggaugucuucuucaucccucccgaaaagugcgacacccuccuuugugacauuggggagucuagcccuaauccgacaguugaagccggaagaacccugcgcgugcugaaccucguggagaauuggcugaacaauaacacacaguuuugcaucaaaguccuuaaucccuacaugccuuccgugauugagaagauggaaacccugcaacggaaauacggcggggcgcucguuagaaacccccugagccgcaauuccacgcacgagauguauugggugucuaacgccagcggaaauaucgucuccucugugaacaugauuagccggaugcugaucaacagauucaccaugcgccauaagaaagcuacauacgaaccugauguugaccucggcuccgggacccggaauaucggaauugagucugaaauccccaaccuugauauuaucggcaagagaauugagaagaucaaacaggagcacgaaacaagcuggcacuaugaccaggaucauccguacaagaccugggccuaucacggcuccuacgagacaaaacagaccgggagcgcuucuuccauggugaauggagucgugcgccugcugacgaagccuugggacgugcuccccacagucacccaaauggccaugaccgauacaacgccuuuuggccagcagcggguuuucaaagaaaagguggacaccagaacacaggagcccaaggaagggaccaaaaagcugaugaaaauuacagcggaguggcuuuggaaggagcugggcaagaagaaaaccccucgcauguguacaagagaagaguuuacccggaaggugcgcagcaacgccgcucucggcgccaucuucacggaugaaaauaaguggaaaucugcuagagaggccgucgaggacucccgguuuugggaacugguggauaaggagagaaaccugcaucucgaagggaaaugcgagaccuguguuuauaauaugaugggaaagcgggagaaaaagcugggcgaguucggcaaggcuaaagggagccgcgccaucugguacauguggcuuggagcgagauuucuggaguucgaagcccucggcuuucugaacgaggaccacugguucucucgggaaaauucccuuagcgggguggagggagaaggccugcaccgccucggguacauucugagagacgucuccaagaaagagggcggagcuauguaugccgaugacacagcuggcugggauacccggaucacacuggaggaccucaagaacgaagagauggugaccaaucauauggaaggggagcacaaaaagcuggccgaagccauuuuuaaacuuacguaccaaaacaaaguugugcgcguccagagacccacaccgcggggaaccgugauggauaucauuagccgcagagaccagcggggcucugggcaaguuggaacauauggccugaauaccuucacgaacauggaggcgcagcucauccgccagauggagggggaaggcguguucaagaauauccagcaucugaccgucacagaggaaauugcugugcaaaacuggcuugccagagucggacgggagcgccugagcagaauggccaucuccggcgaugacugcgugguuaaaccucucgaugaccgguuugcuucugcccugaccgcucugaacgauauggggaagauuagaaaagacauccagcagugggagcccagccgcggauggaaugauuggacacaggugcccuucugcucccaccauuuucacgaacucauuaugaaggacggccggguccugguggugccuuguagaaaccaagacgagcuuaucgggcgcgcccggaucucucagggagcgggcuggagccugagagaaaccgccugccucgggaaguccuacgcucagauguggucucugauguauuuccaccgccgggaucuuagacuggccgcuaaugccauuuguagcgcgguuccgucccauugggugcccacaagccgcaccacguggucuauccacgccaaacaugaguggaugacaaccgaagacaugcucaccgucuggaaccggguguggauucaggagaauccuuggauggaggauaagacacccguugaauccugggaggaaaucccuuaccugggcaaaagagaggaccaauggugcggaagccugauuggccucaccucucgcgcuacaugggccaagaacauccagguggcuauuaaucagguccggucccugaucgggaacgaagaguauacggauuacaugcccagcaugaaaagauuucggagagaggaagaggaagccggagugcuuugguga

SEQ ID NO: 19880 - RNA, 9876 nt, Artificial Sequence
  derived and/or modified CDS sequence (opt5) from DENV-2__FJ744723__SS-prME
agcgugggaaugaucauuaugcugauccccaccgugauggccuuccaccucacgacgcggaauggggagccucauaugauuguuuccauccaggaaaagggaaaaucucugcuuuuuaagaccgaggacggagugaauaugugcacacugauggcuauggaucucggggaacugugugaggacaccauuacauacaaaugcccgcuucugcggcaaaacgaacccgaggauaucgacuguuggugcaauuccaccuccacaugggugaccuauggaacguguaccacaaccggcgagcaccgcagagaaaagcggucugucgcccucgugccucauguugggaugggacuggagacacgcaccgaaacguggaugagcuccgagggcgcguggaaacacgcucagagaaucgagacauggauucugcggcaucccggcuucaccaucauggccgccauucucgcuuacacaaucgggaccacccacuuucagcgcacacugauuuucauccuucugacggccguggcuccuucuaugaccaugagaugcauuggaaucagcaaccgggauuuugucgaaggcguguccgggggaagcuggguugacaucgugcucgagcacggcucuugugucacaaccauggccaagaauaagcccacacuggauuucgaacuuauuaaaaccgaggcgaagcagccugccacgcugcgcaaauauugcaucgaagcuaagcucacaaacaccaccacagaguccagauguccgacccaaggggagcccagccugaaagaagaacaggacaagcgguuugugugcaagcauucuaugguggaucgcggauggggcaauggcugugggcuguucggaaaaggcgggauugucacaugcgccauguuuacgugcaagaaaaacauggaaggaaagaucguucagccugagaaucucgaauacaccauuguggugacaccccacuccggcgaggagcaugcugucgggaacgacaccggaaaacacggcaaggaaaucaaagugacaccucagagcucuaucaccgaggccgaacugacgggcuaugggaccguuacaauggaguguucccccagaaccggacuugauuucaaugaaauggugcugcuccaaauggagaacaaggcguggcugguccaccggcagugguuucuugaccugccgcucccuuggcugcccggcgccgauacacaggggagcaauuggauucagaaggagacccuggugacguucaaaaacccucaugcuaagaaacaagacguugugguccucggaucccaggaaggcgccaugcacacagcucugaccggggccacagagauccagaugucuagcggcaaucuucuguuuaccggacaucucaagugccgccugagaauggacaaacuucaacugaagggcauguccuacagcauguguaccgggaaguucaaaguggucaaggaaauugccgagacacagcacggaacgaucgugauucggguucaguaugagggcgaugggucucccugcaaaauccccuucgaaaucauggaccucgagaagagauacgugcugggacgccugauuaccgucaacccuaucgugacagaaaaagauuccccgguuaacauugaggcugaacccccuuuuggcgacagcuacaucauuaucgggguggagcccggccagcucaagcugaauugguucaagaaaggaucuagcauuggccaaauguuugagaccacaaugagaggggcgaagagaauggccauccuuggagauaccgcuugggacuucggcucccucggcggggucuuuacgucuaucgggaaagcccuccaucagguguucggggccauuuauggcgcugccuuuagcggaguguccuggacaaugaagauccugauuggcguuaucauuaccuggaucgggaugaacagccgcucuaccucccugagcgucucucuugugcucgugggagucgugacacuguaccugggcguuauggugcaggcggauuccgggugugucgugagcuggaaaaauaaggaacucaagugcggauccggcaucuucauuaccgacaacguucacacauggacggagcaguauaaauuucaaccugaaucucccagcaagcuggcuuccgccauccagaaagcccaggaggaagggauuuguggcauccggucugugaccagacuugagaaucugauguggaagcagauuacaccggagcucaaccacauccuggcugaaaaugaggucaaacugaccaucaugacaggagauauuaagggcaucaugcaagccgggaaacgcagccuucggccucagcccaccgaacucaaguacuccuggaagacguggggaaaagcuaagaugcugagcaccgagucucauaaccagacauuccugauugacggcccugaaaccgccgagugccccaauacaaacagagcguggaacucccucgagguggaagauuauggguuuggaguuuucaccacaaacaucuggcugaaacuuaaggagaaacaggacgccuuuugugacagcaagcugaugucugcugccauuaaggauaaucgcgcugugcacgccgacaugggcuacuggaucgaauccgcgcucaacgauaccuggaaaaucgagaaggccagcuucauugaggucaaaaauugccauuggccuaagucucacacgcuguggagcaacggcgugcuggaauccgagaugaucauucccaaaaaccuugcugggccggugagccaacacaauuaucggccuggauaccauacacagaucgccggccccuggcaccucgggaagcuggaaauggacuucgauuuuugugacggaaccaccgucguugugacagaggauugcggcaacagagggcccucucugcgcaccacgacagcuuccggaaagcucauuaccgaauggugcugucggagcugcacacugccuccgcuuagauaccggggcgaggacggcuguugguaugggauggagauccgcccccugaaagaaaaggaggaaaaucucgugaacucccuggucaccgccggacauggccagguggauaauuucucucuggggguucuuggaauggcccucuuucuggaggaaaugcugagaacacgggugggcaccaaacacgcuauucuccuggucgcggugagcuucguuacgcuuaucaccgggaacauguccuuuaaggaccugggaagaguggucgugaugguuggcgccacaaugaccgaugacaucggcaugggggugacauaccucgcucugcuggccgccuucaaaguccgcccuaccuuugcugccggacuuuuccugcggaagcucacgucuaaggagcugaugaugacaaccauuggcaucgugcuccugagccaauccacaauucccgagaccauccuugaacugaccgaugcgcucgcucuggggaugauggugcugaaaauggucagagacauggagaaguaucagcuugccguuacaauuauggccauccugugcgugccuaaugcugugauccuccagaacgccuggaaagucucuuguacgauucuggcggugguuagcgugagcccccugcugcuuaccagcucucagcaaaagacagacuggaucccucuggcucucaccauuaaaggacugaaucccacagccaucuuucugaccacgcuuucccgcacaaacaagaaaagaagcuggccgcugaaugaagccauuauggcugucggcauggugucuauccucgccuccagccugcucaagaacgauaucccuaugaccgggccccugguugcuggaggccuucugaccgugugcuacguccugacaggccggucugccgaccucgagcuggaacgcgcgaccgaugugaagugggaggaccaggccgagauuuccgggagcuccccuauccuuagcauuacaaucucugaagauggaagcauguccauuaaaaaugaggaagaggagcagacgcugaccauccucauuagaacaggccugcucgucaucucugggcuguuccccgugagcaucccgauuaccgcugccgcuugguaucuuugggaaguuaagaaacagcgggccggagugcugugggacgucccuucucccccucccaugggcaaggccgagcuggaagauggggcuuaccgcaucaaacaaagaggcauucucggcuauagccagaucggcgcggggguguacaaggagggaacauuucauaccauguggcacguuacgcggggcgccgugcugacccacaaggggaaacgcauugaacccagcugggcugacgucaagaaagaucuuaucuccuacggaggcggguggaagcuggagggagaguggaaagaaggcgaggaaguccaggugcucgcccuggagccuggcaagaacccgagagccguucagacaaagcccggacucuucaaaaccaauacaggaaccaucggcgcugucucucuggacuuuagcccugggacauccggaagccccauuaucgauaagaaaggcaaggugguggggcuuuauggaaacggcgucgugacgcggucuggcgccuacguuuccgcgauugcucaaaccgagaaguccaucgaggacaacccugauauugaggacgacaucuuccgcaagagacggcugacaaucauggaucugcaucccggggccggaaagaccaaaagauaucucccugccauugugcgcgaagcuaucaagcggggccugagaacccuuauucuggccccgacacgcgucguggcggcugagauggaagaggcccuccgggggcugcccaucagauaccagacgccugccauucgcgcugaacacaccggacgggagaucguugaccucaugugucaugccacauucaccaugagacugcuuucucccgugcgcgucccuaauuauaaccugauuaucauggaugaggcucacuuuacagaccccgccuccaucgcggcccggggcuacauuagcaccagaguggaaaugggggaggcugccggcaucuucaugacggcuacaccgccuggaucccgggaucccuuuccccagucuaaugccccuauuaucgacgaagaacgcgagauucccgaaagaagcuggaacuccggccaugaguggguuaccgauuucaaagggaagaccgugugguuugucccuagcaucaaagccggaaaugacaucgcugcgugccugcggaagaacggcaagaaagugauucaacucucucgcaagacauucgauuccgaauaugugaaaaccagaacaaaugacugggauuuugucguuaccacggacaucagcgagaugggggccaacuucaaggcugaacgggugauugacccgagacgcuguaugaaacccgugauccugacagauggagaggagcgggucauucuugccggcccuaugcccgugacccacucuagcgccgcucagagacgcgggcggaucggcagaaauccuaagaacgaaaaugaccaguacaucuacaugggagagccccuggaaaacgaugaggacugcgcccacuggaaagaagcgaagaugcuccuggauaauauuaacacaccggagggcaucauuccuuccauguuugagcccgaacgcgagaagguugacgcuaucgauggggaauaucggcugagaggagaggcccgcaaaaccuucguggaccucaugagacggggcgaucuuccugucuggcuggccuacaagguggcugccgaagggauuaauuaugcggaccgcagaugguguuuugauggaaucaaaaacaaccagauucuggaggagaauguugaaguggagaucuggacgaaggaaggcgagcggaaaaagcucaagccccgcuggcuggacgccagaaucuacucugauccucuugcucugaaagaguucaaggaguucgccgcugggcggaaaagccucacccugaaccugauuacagagaugggcagacuccccaccuuuaugacacaaaagacccgcgacgcccuugacaaucuggcuguccugcauacagccgaagcgggaggccgggccuauaaccacgcucucuccgagcugccggaaacccuugagacgcugcuccugcugacacuccuugccaccgugaccgggggaaucuuccuguuucugaugucuggcagagggauuggaaaaaugacacucggcaugugcugcaucgucaccgcuagcauucugcuuugguacgcccagauccagccucauuggaucgccgcuuccauuauccuggaguucuuucucauugugcugcugauccccgaacccgagaagcagcgcacaccucaagauaaucagcucacguauguugugauugcgauccuuaccguggucgccgcuacaauggccaacgaaaugggcuuccuggagaagaccaaaaaggaccuggggcucggaagcaucgccacacagcagccggaaucuaauauucuggauaucgaccuucggcccgcuuccgccuggacccuguacgcgguugccacgaccuuugugacaccuaugcucagacacagcauugagaacuccucugugaaugucagccugaccgcuaucgccaaccaagcuacagugcugaugggccucgggaaaggauggccccuuuccaagauggauauuggcgccccucugcuggcgaucggguguuacucucagguuaaucccauuacccucacggccgcucugcuucugcucguggcccacuaugcuaucaucggaccuggccugcaggccaaagcuacacgggaggcccagaagcgcgcggccgcuggcauuaugaagaacccgaccgucgacgggaucacagugauugaucuggaccccaucccuuacgaucccaaauucgaaaagcaacucggacaggucaugcuucuggugcugugcguuacccaggugcucaugaugagaaccacaugggcccugugugaggcucuuacgcuggccaccggcccuauuagcacacucugggaagggaaucccggacgguuuuggaacaccacaaucgccgucuccauggcgaauaucuuccgcggcagcuaucuggcuggggccggacugcucuuuucuauuaugaaaaacaccacaaauuccagacggggcacaggcaacaucggggagacccuuggagaaaaguggaaaagccgccugaacgcucugggcaagucugaguuccaaauuuacaaaaaguccgggauccaggagguggacagaacccucgccaaggaaggaauuaaacggggcgagacagaucaucacgccguuagccgcgggucugcuaagcugagaugguuuguggaacggaauauggucaccccggagggaaaagugguggaccuuggcugcggcagagggggauggagcuauuacuguggcgggcugaagaacguucgcgaggucaaaggacucacaaagggcgggccuggacaugaagaacccauccccauguccacguauggcuggaaucuggugcggcugcagucuggcguggaugucuucuucaucccucccgaaaagugcgacacccuccuuugugacauuggggagagcuccccuaacccgacaguugaagccggaagaacccugcgcgugcugaaucucguggagaacuggcugaauaacaauacacaguuuugcaucaaaguccuuaaccccuacaugccuagcgugauugagaagauggaaacccugcaacggaaauacggcggggcgcucguuagaaauccccugucccgcaacucuacgcacgagauguauugggugagcaaugccuccggaaacaucgucucuagcgugaauaugauuucccggaugcugaucaacagauucaccaugcgccauaagaaagcuacauacgaaccugauguugaccucggcucugggacccggaacaucggaauugagagcgaaauccccaaucuugauauuaucggcaagagaauugagaagaucaaacaggagcacgaaacauccuggcacuaugaccaggaucauccguacaagaccugggccuaucacggcagcuacgagacaaaacagaccgggucugcuuccagcauggugaacggagucgugcgccugcugacgaagccuugggacgugcuccccacagucacccaaauggccaugaccgauacaacgccuuuuggccagcagcggguuuucaaagaaaagguggacaccagaacacaggagcccaaggaagggaccaaaaagcugaugaaaauuacagcggaguggcuuuggaaggagcugggcaaaaagaaaaccccucgcauguguacaagagaagaguuuacccggaaggugcgcucuaaugccgcucucggcgccaucuucacggaugaaaacaaguggaaauccgcuagagaggccgucgaggacagccgguuuugggaacugguggauaaggagagaaaucugcaucucgaagggaaaugcgagaccuguguuuauaacaugaugggaaagcgggagaaaaagcugggcgaguucggcaaggcuaaagggucucgcgccaucugguacauguggcuuggagcgagauuucuggaguucgaagcccucggcuuucugaaugaggaccacugguucucccgggaaaacagccuuuccgggguggagggagaaggccugcaccgccucggguacauucugagagacgucagcaagaaagagggcggagcuauguaugccgaugacacagcuggcugggauacccggaucacacuggaggaccucaagaaugaagagauggugaccaaccauauggaaggggagcacaaaaagcuggccgaagccauuuuuaaacuuacguaccaaaauaaaguugugcgcguccagagacccacaccgcggggaaccgugauggauaucauuucucgcagagaccagcggggcagcgggcaaguuggaacauauggccugaacaccuucacgaauauggaggcgcagcucauccgccagauggagggggaaggcguguucaagaacauccagcaucugaccgucacagaggaaaccgcugugcaaaauuggcuugccagagucggacgggagcgccuguccagaauggccauuucuggcgaugacugcgugguuaaaccucucgaugaccgguuugcuagcgcccugacagcucugaacgauauggggaagaucagaaaagacauucagcagugggagcccucccgcggauggaacgauuggacccaggugcccuucugcucucaccauuuucacgaacucaucaugaaggacggccggguccugguggugccuuguagaaaucaagacgagcuuauugggcgcgcccggaucagccagggagcgggcuggucccugagagaaacagccugccucgggaagucuuacgcucagauguggagccugauguauuuccaccgccgggaucuuagacuggccgcuaacgccaucuguuccgcgguuccgagccauugggugcccaccucucgcacgacaugguccauucacgccaaacaugaguggaugaccaccgaagacaugcucacagucuggaaucggguguggauccaggagaacccuuggauggaggauaagacccccguugaaagcugggaggaaauuccuuaccugggcaaaagagaggaccaauggugcggaucucugaucggccucacaucccgcgcuacgugggccaagaauauucagguggcuaucaaccagguccggagccugauugggaaugaagaguauaccgauuacaugcccuccaugaaaagauuucggagagaggaagaggaagccggagugcuuugguga

SEQ ID NO: 19881 - RNA, 9876 nt, Artificial Sequence
  derived and/or modified CDS sequence (opt5) from DENV-2__FJ744724__SS-prME
agcgccggaaugaucauuaugcugauccccacagugauggcuuuccaccugacgacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcauuguggaucgcggcuggggcaauggguguggacuguucggcaaagggggaaucgucacaugcgcuauguuuacaugcaagaaaaacauggaaggcaagauuguucagccugagaaucucgaauacacgaucguggugacaccccacucuggggaggagcaugccgucggaaacgacacaggcaaacacggcaaggaaaucaaagugaccccucaguccagcguuacagaggcggaacugaccggguauggaacggugaccauggaguguucucccagaacaggccuugauuucaaugaaaugguccugcuccaaauggagaacaaggccuggcuggugcaccggcagugguuucuugaccugccgcucccuuggcugcccggggcugauaagcaggaguccaauuggauucagaaagaaacccugguuacauucaagaacccucaugccaaaaagcaagacguggucgugcucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaaggucgugaaagagauugcugagacccagcacggaaccaucguuauucgggugcaguaugaaggcgaugggagccccugcaagauccccuucgagaucauggaccucgagaagcgguacguccugggacgccugauuacagugaacccuaucguuacggagaaggauucuccggugaacauugaagcggagcccccuuuuggcgacuccuacaucauuaucggggucgagcccggccagcucaagcugaauugguucaaaaagggaagcucuauuggccaaauguuugaaaccacaaugagaggggccaaaagaauggcuauccuuggagauaccgccugggacuucggcagccucgggggaguguuuacauccaucggcaaggcccuccaucagguguucggggcuauuuauggcgccgcguuuucuggaguuagcuggaccaugaaaauccugauuggcgucaucauuacguggaucgggaugaacucccgcagcacaucucuguccgugagccuugugcucgucggaaucgugacccuguaccugggcguuauggugcaggcugauucugggugugucguguccuggaagaauaaggagcucaaaugcggaagcggcauuuucaucaccgacaacguucacacauggaccgaacaguauaaguuucaaccugagucccccucuaaacuggccagcgccauucagaaggcucaggaagaggggaucuguggcauucgguccgugacaagacuugagaaucugauguggaaacagaucacgccggaacucaaccacauccuggccgagaaugaagucaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaaguggaggauuacggguuuggaguuuucaccacaaacauuuggcugaaacuuaaagaaaagcaggacgcuuuuugugacuccaagcugaugagcgccgcuaucaaagauaaucgcgccgugcaugcggacaugggcuauuggaucgagucugcccucaacgauaccuggaagauugagaaggcuagcuucaucgaagucaagaauugccacuggccuaaaagccauacacuguggucuaacggcgugcuggagagcgaaaugauuauccccaagaaccuugccgggccggugucccaacacaauuaccggccuggauaccacacccagauugcuggccccuggcaucucgggaagcuggagauggacuucgauuuuugugacggaacgacagucguugugaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauucgcccccugaaggagaaagaagagaaucucgugaacagccuggucaccgccggacacggccagaucgauaauuucucccugggggugcuuggaauggcucucuuucuggaagagaugcugagaacacggguuggcaccaagcaugcgauccuccugguggccgucucuuucgugacacuuauuaccgggaacaugagcuuuaaagaccugggaagaguuguggucauggugggcgcuacgauggccgaugacaucggcauggggguuaccuaucucgcccugcuggcugccuucaaggugcgcccuacauuugcggcuggacuucugcuccggaagcugaccuccaaagagcucaugaugacaaccauuggcaucguccugcuuucucaaagcacgauucccgaaacagugcuggagcucaccgaugcccuggcccuggggaugauggugcuuaagaucgucagagacauggaaaaauaccagcuggcuguuacaaucauggccauucucugcgugccuaaugcggugauccugcagaacgcuuggaaggucuccuguaccauucucgccgugguuucugugagcccccugcuucugaccuccagccagcagaagacggacuggaucccucucgcccugacgauuaagggacugaaucccaccgcuaucuuccuuacaacccugucucgcacaaacaaaaagagauccuggccgcucaaugaggccaucauggcugucggcauggugagcauucuggccucuucccuccugaagaacgauaucccuaugaccgggccccuuguugcgggaggccugcugacggugugcuauguccucacaggccggagcgccgaccuggaacuugagcgcgcuaccgaugugaaaugggaggaccaggccgaaauuucuggguccagcccuauccuguccauuaccaucagcgaggauggaucuaugagcauuaagaaugaagaggaggaacagacacucaccauccugaucagaacaggccuccuggucauuuccgggcuuuuucccaucucuauuccgaucacggcugccgccugguaccugugggaggugaaaaagcagcgggcuggaguucugugggacgugccuucucccccucccaugggcaaagcggaacucgaggauggggccuaucgcauuaagcaaaagggaauccugggcuacucccagaucggcgcuggggucuacaaagaaggaaccuuccacacaauguggcaugugaccagaggcgccguucuuaugcacaaggggaaacggauugagcccuccugggccgacgugaagaaagaucugaucagcuauggaggcggguggaagcucgagggagaauggaaggagggcgaagagguccaggugcuggcucucgaaccuggcaaaaacccgcgcgccgugcagacaaagcccgggcuguuuaaaaccaauacgggaaccauuggcgcgguuucccuugacuucucuccugggacaagcggaucccccaucauugauaagaaaggcaaggucguggggcuguacggaaacggcguggucaccagaagcggcgcuuaugugucugccaucgcccaaacagagaaguccaucgaggacaacccugaaauugaggaugacaucuuucggaaacgcagacugaccauuauggaccuccaccccggggcuggaaagacaaaacgguaccugccugccaucguuagagaagcgauuaagcgcggccuucggacgcugauccucgcuccgaccagaguggucgccgccgagauggaagaggcucugcgcgggcuccccauucgguaucagaccccugccaucagagcugagcauaccggacgcgaaaucguggaucugaugugucacgccaccuucacaaugcggcuucugagccccguuagagugccuaauuacaaccugauuaucauggacgaggcgcauuucacggaucccgccucuauugcugcccgcggcuauaucuccacccgggucgaaaugggggaggcugccggcauuuuuaugacagccaccccgccuggaagcagagaccccuucccccaguccaaugcuccuaucaucgaugaggaacgggagauucccgaacgcucuuggaacagcggccacgagugggugacagacuuuaaagggaagaccguuugguucgugccuuccaucaaggcgggaaaugauauugccgcuugccuccgcaaaaacggcaagaaagucauccaacugagccggaagacguuugacucugaauacgugaaaacacgcaccaaugauugggacuucguggucaccacagauauuuccgagaugggggccaacuuuaaggccgagagaguuaucgacccgcggagauguaugaaacccgugauccuuaccgacggagaggaacgcgugauucuggcuggcccuaugcccgucacacauagcucugccgcgcagcggagagggcgcaucggccggaauccuaagaacgaaaaugaucaguacauuuauaugggagagccccucgaaaacgacgaggauugcgcucacuggaaggaggccaaaaugcugcuggacaauaucaacaccccggaaggcauuaucccuagcauguucgagcccgaaagagagaagguggaugccauugacggggaauaccgccuccggggagaggcuagaaaaacguuuguugaucuuaugcgcagaggcgaccugccuguguggcuggccuauaaggucgcggccgaggggaucaauuacgcugaucggcgcugguguuucgacggaaucaaaaacaaccagauucucgaagagaauguggaaguugagaucuggacaaaggagggcgaaagaaagaaacugaagccccgguggcuugaugcccgcauuuauuccgacccucuggcucucaaagaguuuaaggaguucgccgcugggagaaaaucucugacccugaaccucaucacagagaugggccggcuucccaccuucaugacgcaaaagaccagagaugcccuggacaaucuggcggugcuccacacagccgaagcuggaggccgcgccuacaaccaugcucugagcgagcuuccggagacccuggaaacacuccugcugcucacccuucuggccacagucaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucgugcugcucauucccgaacccgagaaacagagaaccccucaagacaaucagcuuaccuacgucgugaucgcuauucugacaguuguggccgccaccauggcuaacgaaaugggcuuucuggagaagaccaagaaggaucucgggcugggauccaucgccacgcagcagccggagagcaauauucuugacaucgaucugcgccccgcgucugccuggacccucuacgcuguggccacaaccuucgucacaccuaugcugcggcauuccauugaaaacagcuccguuaaugugucucugaccgcuaucgccaaccaagcgacggugcucaugggccuugggaaaggauggccccugagcaagauggacaucggcgucccucugcucgccauuggguguuauucccaggugaaucccaucacccugacagcugcccuucugcuccugguugcucacuacgccauuaucggaccuggccugcaggcuaaggccaccagagaggcgcagaaacgggccgcugccggcauuaugaagaacccgacaguggaugggaucaccgucaucgaccucgaucccauuccuuaugaccccaaauuugaaaagcaacuuggacaggugaugcugcugauccucugcgucacacaggugcugaugaugcgcacaaccugggcucuuugugaggcccugacacucgccaccggcccuauuucuacccugugggaagggaaucccggaagauucuggaacacaacgaucgcgguuagcauggcuaauauuuuucggggcuccuaccuggccggggcuggacuccuuuucagcaucaugaaaaacaccacaaauacccgcagaggcacaggcaacaucggggagacccugggagagaaguggaaaucucggcugaacgcccucggcaaguccgaauuucaaauuuauaagaaaagcgggauccaggagguggaucgcacgcuggccaaggaaggaauuaaaagaggcgagacagaccaccaugcugucucucggggguccgccaaacuucgcugguucguggagagaaauaugguuaccccggaaggaaaaguggucgaucugggcugcggcagagggggauggagcuacuauuguggcgggcucaagaacgugcgggaggugaagggacugaccaaaggcgggccuggacacgaagaacccauccccaugucuacauacggcuggaaucugguucgccuccagagcggcgucgacguguuuuucauuccucccgaaaagugcgauacccuucugugugacaucggggaguccucuccuaacccgacaguggaggcgggacggacgcugagaguccucaaucugguugaaaacuggcuuaauaacaauacccaguucugcaucaaagugcugaaccccuacaugccuagcgugauugagaagauggaagcccuccaacgcaaauauggcggggcucugguccggaauccccuguccagaaacagcacacaugagauguacuggguguccaaugccucuggaaacaucguuagcuccgugaauaugauuucucgcaugcucaucaaccgguuuaccaugagacacaagaaggcuacauaugaaccugacgucgaucuuggcagcgggacccgcaacauuggaaucgaguccgaggugcccaaucuggacauuaucggcaaacggaucgaaaagauuaaacaggagcaugaaacgucuuggcacuacgaucaggaccacccguauaagaccugggccuaccauggcagcuaugagacaaaacagaccggguccgcgagcucuaugguuaacggaguggucagacugcucacaaagccuugggaugugcugcccaccgugacacaaauggccaugaccgacacgacaccuuucggccagcagcgcgucuuuaaggaaaaaguugauacccggacccaggagcccaaggaggggaccaagaaacuuaugaaaaucacggcugaauggcuguggaaggagcucggcaaaaagaagaccccuagaauguguacacgcgaagaguucaccagaaaagugcgguccaaugccgcucugggcgccauuuuuacagacgagaacaaguggaaaagcgcucgcgaagccguggaggauucuagauucugggaacuggucgacaaggagcggaaucuccaccuggaagggaaaugcgagaccuguguguacaacaugaugggaaagagagagaagaaacuuggcgaauuuggcaaggcgaaagggucccgggccaucugguacauguggcugggagcucgcuuccucgaguuugaagcccugggcuuccuuaaugaggaucauugguuuagcagagaaaacucucuguccgggguugagggagagggccuccacaagcugggguauauucugcgggacgugagcaaaaaggaaggcggagcuauguacgccgacgauacagccggcugggacacccgcaucacgcucgaggaucugaagaaugaagagauggucaccaaccacauggaaggggagcauaagaaacuugcggaggcuaucuucaaacugacauaucaaaauaaagugguuagagugcagcggcccaccccgcgcggaacagucauggacauuaucuccagacgggaucagcgcggcagcgggcaagugggaaccuacggccucaacacguuuacaaauauggaagcccagcugauuagacagauggagggggaaggcguuuucaaaaacauccagcaccuuaccgugacagaggaggucgccgugcaaaauuggcuggcucgggucggacgcgaaagacucucucggauggccauuagcggcgacgauugcgugguuaagccucuggacgaucgcuucgcuaacgcccugaccgcgcucaacgacauggggaagaucagaaaagauauccagcagugggagcccuccaagggauggaaugacuggacacaggugcccuuuugcucucaucacuuccaugaacugauuaugaaagauggccggguccuuguggugccuuguagaaaccaagacgagcugaucgggcgcgcccggauuagccagggagcuggcuggucccucagagaaaccgccugccuggggaagucuuaugcucagauguggagccuuauguacuuucaccgccgggaccugagacucgccgcgaaugccaucuguuccgcuguuccgucucacugggugcccacaagccgcaccacaugguccauucaugccaaacacgaguggaugaccacagaggauaugcugaccgucuggaaccggguguggaucagagaaaauccuuggauggaggacaagacgcccguugaaagcugggaggaaauuccuuaucugggcaagcgcgaggaucaguggugcggaucucucaucggccugacaucccgggcuaccugggccaaaaacauccaaaccgcuauuaaucaggugagaagccuuaucgggaacgaggaauacacagacuacaugcccucuaugaagcgcuuccggagagaggaagaggaagccggaguccugugguga

SEQ ID NO: 19882 - RNA, 9876 nt, Artificial Sequence
  derived and/or modified CDS sequence (opt5) from DENV-2__FJ906957__SS-prME
agcgcuggaaugaucauuaugcugauccccaccgugauggcuuuccaccugaccacgcggaauggggagccucauaugauugucuccauccaggagaagggaaagucucugcuuuuuaagaccgaggacggcguuaauaugugcacgcugauggccauggaucucggggaacugugugaggacaccauuacauacaagugcccgcuucugcggcaaaaugaacccgaggauaucgacuguuggugcaauuccaccuccacaugggugaccuauggaacguguaccacaaccggcgagcacagaagagaaaagcggucuguggcgcucguuccucauguggggaugggacuggagacacgcaccgaaacguggaugagcuccgagggcgcuuggaagcacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaggaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauaagcaggggagcaauuggauucagaaagagacccuggucacauucaagaacccucaugcuaaaaagcaagacgugguugugcucggaucccaggaaggcgccaugcacaccgcccugacgggggcuacagagauccagaugucuagcggcaaucuucuguuuaccggacaucucaaaugccgccugagaauggacaaacuucaacugaagggcauguccuacagcauguguacagggaaauucaaggucgugaaagaaauugcggagacccagcacggaaccaucgucauucgggugcaguaugagggcgaugggucucccugcaagauccccuucgaaaucauggaccucgagaaaagauacguucugggacgccugauuacagugaacccuaucgucacggaaaaggauuccccggugaacauugaggccgaacccccuuuuggcgacagcuacaucauuaucgggguugagcccggccagcucaagcugaauugguucaaaaagggaucuagcauuggccaaauguuugagaccacaaugagaggggcuaaaagaauggccauccuuggagauaccgccugggacuucggcucccucgggggaguguuuacaucuaucggcaaggcucuccaucaggucuucggggccauuuauggcgcggcuuuuagcggaguguccuggaccaugaaaauccugauuggcgugaucauuacguggaucgggaugaacagccgcucuacaucccugagcguuucucuuguccucgugggaaucgugacccuguaccugggcgucauggugcaggccgauuccggguguguugugagcuggaagaauaaggaacucaaaugcggauccggcauuuucaucaccgacaacguccacacauggaccgagcaguauaaguuucaaccugaaucucccagcaaacuggccuccgcuauucagaaggcccaggaggaagggaucuguggcauucggucugugacaagacuugagaaucugauguggaaacagaucacgccggagcucaaccacauccuggcugaaaaugagguuaagcugaccauuaugacaggagauaucaaaggcauuaugcaagccgggaagcgcagccuucggccucagcccaccgaacucaaguacuccuggaaaacauggggaaaggcgaaaaugcugagcaccgagucucauaaccagacguuccugaucgacggcccugaaaccgccgagugccccaauacaaacagagcuuggaacucccucgagguggaagauuauggguuuggagucuucaccacaaacauuuggcugaaacuuaaagagaagcaggacgccuuuugugacagcaagcugaugucugcugccaucaaagauaaucgcgcggugcacgccgacaugggcuacuggaucgaauccgcucucaacgauaccuggaagauugagaaagccagcuucaucgagguuaagaauugccauuggccuaaaucucacacacuguggagcaacggcgugcuggaauccgagaugauuauccccaagaaccuugcugggccggucagccaacacaauuaucggccuggauaccauacccagauugccggccccuggcaccucgggaagcuggaaauggacuucgauuuuugugacggaacgacagugguggucaccgaggauugcggcaacagagggcccucucugcgcaccacaaccgccuccggaaaacucaucacggaauggugcugucggagcugcacacugccuccgcuuagauaccggggcgaggacggcuguugguaugggauggagauucgcccccugaaggaaaaagaggaaaaucucguuaacucccuggugaccgcuggacauggccagguggauaauuucucucuggggguccuuggaauggcgcucuuucuggaggaaaugcugagaacacgggugggcaccaagcacgccauccuccugguugcugccagcuucgugacacuuaucaccgggaacauguccuuuaaagaccugggaagagucgugguuauggugggcgccacgaugaccgaugacauuggcaugggggucacauaccucgcucugcuggccgcguucaaggugcgcccuaccuuugcugccggacuucugcuccggaagcugacaucuaaagagcucaugaugaccacgaucggcauuguucugcuuagccaauccacaauccccgagaccauucuggaacucacagaugcccuggcucuggggaugauggugcuuaagaucgucagaaauauggagaaauaucagcuggccgugaccaucauggcgauucucugcgugccuaacgcugucauccugcagaaugccuggaagguuucuuguaccauucucgccguggugagcgucagcccccugcuucugacaagcucucagcagaagacggacuggaucccucucgcucugaccauuaagggacugaaccccacagccaucuuccuuaccacacugucccgcaccaauaaaaagagaagcuggccgcucaacgaagcuaucauggccgugggcaugguuucuauucuggcguccagccuccugaagaaugacaucccuaugacggggccccuuguggccggaggccugcugacagucugcuacgugcucaccggccggucugcugaucuggagcuugaacgcgccaccgacguuaaaugggaggaucaggcugagauuuccgggagcuccccuauccugagcauuacaaucucugaagacggaagcauguccauuaagaacgaggaagaggagcagacccucacaauccugaucagaacgggccuccuggugauuucugggcuuuuucccgucagcaucccgauuaccgccgccgcuugguaucugugggaagugaaaaagcagcgggcgggaguccugugggaugugccuucucccccucccaugggcaaagccgagcucgaagacggggcuuaccgcaucaagcaaaaggggauucugggcuauagccagaucggcgccgggguuuacaaagagggaacauuccauaccauguggcacgugacaagaggcgccguccuuaugcacaaggggaaacggaucgaacccagcugggcugaugugaagaaagaccugauuuccuacggaggcggguggaagcucgagggagaguggaaggaaggcgaggaaguucaggugcuggcccucgagccuggcaaaaauccgcgcgcgguccagaccaagcccgggcuguuuaaaacgaacaccggaacaaucggcgcugugucucuugauuucagcccugggaccuccggaagccccauuaucgacaagaaaggcaaggugguugggcuguauggaaacggcgucgugacaagaucuggcgccuacguguccgccauugcucaaaccgaaaagagcaucgaggauaauccugagaucgaagacgauauuuuucggaaacgcagacugacaaucauggaccuccaucccggggccggaaagacgaaacgguaucugccugcgauugucagagaggcuaucaagcgcggccuucggacccugauucucgccccgacaagagugguugccgcugaaauggaggaagcccugcgcgggcuccccauccgguaccagaccccugcuauuagagccgagcacaccggacgcgagaucguggaccugaugugucaugcgacauucacgaugcggcuucugucucccgucagagugccuaacuauaaucugaucauuauggaugaagcccacuucaccgaccccgcuuccaucgccgcucgcggcuacauuagcacacggguugagaugggggaagccgccggcaucuuuaugaccgcuacaccgccuggauccagagaucccuucccccagucuaacgcgccuauuaucgacgaggagcgggaaauccccgagcgcagcuggaacuccggccaugaaugggugaccgauuuuaaagggaagacggucugguucgugccuagcauuaaggccggaaacgacaucgcugccugccuccgcaaaaauggcaagaaaguuauucaacugucucggaagacauuugauuccgaguaugugaaaacccgcaccaacgacugggauuucgucgugacaaccgacaucagcgaaaugggggccaauuuuaaggcugagagagugauugauccgcggagauguaugaaacccgucauccuuacagacggagaggaacgcguuauccuggccggcccuaugcccgugacccacucuagcgcggcucagcggagagggcgcauuggccggaacccuaagaaugagaacgaccaguacaucuacaugggagaaccccucgagaaugaugaagacugcgcccacuggaaggaggccaaaaugcugcuggauaacauuaauacgccggagggcaucauuccuuccauguucgaacccgagagagaaaagguggacgcuaucgauggggaguaucgccuccggggagaagccagaaaaacauuugucgaccuuaugcgcagaggcgaucugccuguguggcuggcguacaagguugccgcugaggggauuaacuaugccgaccggcgcugguguuucgauggaaucaaaaacaaucagauccucgaggaaaacguggaggucgaaauuuggaccaaggagggcgagagaaagaaacugaagccccgguggcuugacgcucgcaucuacucugauccucuggcccucaaagaauuuaaggaguucgcugccgggagaaaaagccugacacugaaucucauuaccgaaaugggccggcuucccacguucaugacccaaaagacaagagacgcgcuggauaaccuggccgugcuccauaccgcugaggccggaggccgcgcuuauaaucacgcccuguccgaacuuccggagacacuggagacccuccugcugcucacacuucuggccaccguuacagggggaaucuuucuguuccucaugucuggccgggggauuggaaagaugacacugggcaugugcugcaucaucaccgcuagcauucuucugugguacgcgcagauccagccucauuggauugccgcuuccaucauucucgaauuuuuccugaucgugcugcucauccccgagcccgaaaaacagagaaccccucaagacaaccagcuuacauaugucgugauugccauccugaccgucguggccgcuacaauggccaaugagaugggcuuucuggaaaagacgaaaaaggaccucgggcugggaagcauugcgacccagcagccggagucuaacauccuugauauugaccugcgccccgccuccgcuuggacacucuacgccguugcuaccacauucgugaccccuaugcugcggcacagcaucgaaaauuccucugugaacgucagccugacggccauugcgaaucaagccaccguucucaugggccuugggaaaggauggccccuguccaagauggauaucggcgugccucugcucgcuaucggguguuacucucaggugaaccccauuacacugaccgccgcccuucugcuccuggucgcccacuaugcuaucauuggaccuggccugcaggccaaggcgacaagagaagcccagaaacgggcugccgcuggcaucaugaagaauccgaccguggacgggauuacgguuaucgaucucgaccccaucccuuacgaucccaaauuugagaagcaacuuggacaggugaugcugcugauucucugcgucacacaggugcugaugaugcgcaccacaugggcccuuugugaagcccugacccucgcgaccggcccuaucagcacacugugggaggggaaccccggaagauucuggaauacgaccauugcugucuccauggccaacaucuuucggggcagcuaucuggcuggggccggacuccuuuucucuauuaugaaaaauacaaccaacacacgcagaggcaccggcaacaucggggaaacgcugggagagaaguggaaaucccggcugaaugcccucggcaagagcgaguuucaaaucuacaagaaaucugggauucaggaaguggaccgcacacuggcuaaggagggaaucaaaagaggcgaaaccgaucaucacgccguuucccgggggagcgcgaaacuucgcugguucguggagagaaacauggucaccccggagggaaaagugguugaccugggcugcggccggggaggauggucuuauuacuguggcgggcucaagaaugugagagaagucaagggacugacaaaaggcgggccuggacaugaggaacccauucccaugagcaccuauggcuggaaccuggugcgccuccaguccggcguggaugucuuuuucaucccucccgagaagugcgacacacuucugugugauauuggggaaucuagcccuaauccgacggucgaggccggacggacccugagagugcucaaccugguggagaauuggcuuaacaauaacacacaguucugcaucaaaguccugaaucccuacaugccuuccguuaucgaaaagauggaggcucuccaacgcaaauacggcggggcccuggugcggaacccccugagcagaaauuccacccacgaaauguauugggugucuaacgcuagcggaaauauugucuccucugugaacaugaucagccgcaugcucauuaaccgguuuacaaugagacauaagaaggccaccuacgagccugacguugaccuuggcuccgggacgcgcaauaucggaauugaaucugagauccccaaccuggauauuaucggcaaacggaucgagaagauuaaacaggaacacgagaccagcuggcacuaugaccaggaucauccguacaagacaugggcguaucacggcuccuacgaaaccaaacagacagggagcgccucuuccauggugaauggagucgugagacugcucaccaagccuugggacguucugcccacagugacccaaauggcuaugacggauacaaccccuuucggccagcagcgcgucuuuaaggagaaaguggacacccggacacaggaacccaaggaggggacgaagaaacuuaugaaaaucaccgccgaguggcuguggaaagaacucggcaagaagaagacaccuagaauguguacccgcgaggaguucacaagaaaagugcggagcaacgcugcccugggcgcuauuuuuaccgaugagaauaaguggaaaucugcccgcgaggcggucgaagacuccagauucugggagcugguugauaaggaacggaaccuccaucuggaggggaaaugcgaaacauguguguauaauaugaugggaaagagagagaagaaacuuggcgaguuuggcaaggccaaagggagccgggcuaucugguacauguggcugggagcccgcuuccucgaauuugaggcucugggcuuccuuaacgaagaccacugguuuucuagagaaaauucccugagcgggguggaaggagagggccuccacaagcugggguacauucugcgggaugucuccaaaaaggagggcggagccauguaugccgacgacaccgcgggcugggauacgcgcaucacccucgaagaccugaagaacgaggaaauggugacaaaucauauggagggggaacacaagaaacuugcugaggccaucuucaaacugaccuaccaaaacaaaguugugagaguccagcggcccacaccgcgcggaaccgugauggauauuaucagcagacgggaccagcgcggcucugggcaaguuggaacguauggccucaauacauuuaccaacauggaggcccagcugauuagacagauggaaggggagggcguguucaaaaauauccagcaucuuacagucaccgaagagauugcugugcaaaacuggcuggcccggguuggacgcgagagacucagccggauggcuaucuccggcgaugacugcguggucaagccucuggaugaccgcuucgccaacgcgcugacggcccucaaugauauggggaagaucagaaaagacauucagcagugggaacccucuaagggauggaacgauuggacccaggugcccuuuugcagccaccauuuccacgagcugaucaugaaagacggccggguccuugugguuccuuguagaaaucaagaugaacugauugggcgcgcucggaucucccagggagccggcuggucucucagagagacagcuugccuggggaaguccuacgcccagauguggucccuuauguauuuucaccgccgggaccugagacucgcggccaacgcuauuuguucugccgugccgagccauuggguccccaccucccgcacaaccuggagcauccacgcuaaacaugaauggaugacaaccgaggacaugcugacgguguggaaucggguguggauucaggagaacccuuggauggaagauaagacacccguugagucuugggaagagaucccuuaccugggcaagagagaagaccaauggugcggaucccucaucggccugaccagccgcgccaccugggcuaaaaauauucaggccgcgaucaaccaggugcggucucuuauugggaaugaggaguauacagauuacaugcccuccaugaagagauuccgccgggaagaggaagaggccggaguccugugguga

SEQ ID NO: 19883 - RNA, 9876 nt, Artificial Sequence
  derived and/or modified CDS sequence (opt5) from DENV-2__FJ906958__SS-prME
uccgucggcaugaucauuaugcugauccccaccgucauggccuuccaccugaccacgcggaauggggagccucauaugauuguuuccauccaggaaaagggaaagucucugcuuuuuaagaccgaggacggcgugaauaugugcacacugauggcuauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucugucgcccucgugccucauguugggaugggacuggagacacgcaccgaaacguggauguccuccgagggcgcguggaaacacgcucagagaaucgagacauggauucugcggcaucccggcuucaccaucauggccgccauucucgcuuacacaaucgggaccacccacuuucagcgcgcccugauuuucauccuucugacagcuguggccccuucuaugacgaugagaugcauuggaaucagcaaccgggauuuugucgaaggcguguccgggggaagcuggguugacaucgugcucgagcacggcucuugugucaccacaauggcgaagaauaagcccacccuggauuucgaacuuauuaaaacagaggccaagcagccugcuacccugcgcaaauauugcaucgaagccaagcucacgaacacaaccaccgaguccagauguccgacacaaggggagcccagccugaaagaagaacaggacaagcgguuugugugcaagcauucuaugguggaucgcggauggggcaauggcugugggcuguucggaaaaggcgggauugugaccugcgcuauguuuacaugcaagaaaaacauggaaggaaagaucguucagccugagaaucucgaauacacgauuguggugacaccccacuccggcgaggagcaugccgucgggaacgacacaggaaaacacggcaaggaaaucaaagugaccccucagagcucuaucacagaggcggaacugaccggcuaugggacgguuaccauggaguguucccccagaacaggacuugauuucaaugaaauggugcugcuccaaauggagaacaaggccuggcugguccaccggcagugguuucuugaccugccgcucccuuggcugcccggcgcugauacccaggggagcaauuggauucagaaggagacacuggugaccuucaaaaacccucaugccaagaaacaagacguugugguccucggaucccaggaaggcgcuaugcacacggcccugacaggggccaccgagauccagaugucuagcggcaaucuucuguuuacaggacaucucaagugccgccugagaauggacaaacuucaacugaagggcauguccuacagcauguguaccgggaaguucaaaguggucaaggaaauugcugagacccagcacggaacaaucgugauucggguucaguaugagggcgaugggucucccugcaaagugcccuucgaaaucauggaccucgagaagagauacguccugggacgccugaucacggugaacccuguugugaccgaaaaagauuccccggucaacauugaggcggaacccccuuuuggcgacagcuacaucauuaucgggguggagcccggccagcucaagcugaauugguucaagaaaggaucuagcauuggccaaauguuugagacaaccaugagaggggccaagagaauggcuauccuuggagauacagccugggacuucggcucccucgggggaguguuuaccucuauuggcaaagcccuccaucagguuuucggggcuaucuauggcgccgcguuuagcggagucuccuggacgaugaagauccugauuggcgugaucauuacauggaucgggaugaacagccgcucuaccucccugagcgugucucuuguccucgugggaauuguuacccuguaccugggcgugaugguccaggcugauuccgggugugugguuagcuggaaaaauaaggaacucaagugcggauccggcaucuucaucacagacaacgugcacaccuggacagagcaguauaaauuucaaccugaaucucccagcaagcuggccuccgccauucagaaagcucaggaggaagggaucuguggcauucggucugucacgagacuugagaaucugauguggaagcagaucaccccggagcucaaccacauucuggccgaaaaugaggugaaacugacaaucaugaccggagauaucaagggcauuaugcaagcugggaaacgcagccuucggccucagcccacagaacucaaguacuccuggaagaccuggggaaaagccaagaugcugagcacggagucucauaaccagaccuuccugaucgacggcccugaaacagcggagugccccaauaccaacagagccuggaacucccucgagguugaagauuauggguuuggaguguucacaaccaacauuuggcugaaacuuaaggagaaacaggacgcuuuuugugacagcaagcugaugucugccgcugucaaggauaaucgcgccgugcacgcggacaugggcuacuggaucgaauccgcccucaacgauacauggaaaauugagaaggcuagcuucaucgaggugaaaaauugccauuggccuaagucucacacccuguggagcaacggcguccuggaauccgagaugaucauucccaaaaaccuugccgggccgguuagccaacacaauuaucggccuggauaccauacgcagaucgcuggccccuggcaccucgggaagcuggaaauggacuucgauuuuugugacggaacaaccgugguggucaccgaggauugcggcaacagagggcccucucugcgcacaaccacggccuccggaaagcucauuacagaauggugcugucggagcugcacccugccuccgcuuagauaccggggcgaggacggcuguugguaugggauggagauccgcccccugaaagaaaaggaggaaaaucucgugaacucccugguuacagccggacagggccaaguggauaauuucucucuggggguccuuggaauggcucucuuucuggaggaaaugcugagaacccgggugggcacaaaacaugcgauucuccugguugccgugagcuucgucacccuuaucacggggaacauguccuuuaaggaccugggaagagugguugugauggucggcgcuaccaugacagaugacauuggcaugggggugaccuaccucgcccugcuggccgcuuucaaagugcgcccuacauuugccgcgggacuucugcuccggaagcugaccucuaaggagcucaugaugacgacaaucggcaucguccugcuuagccaguccaccauucccgagacaauccuggaacucaccgaugcucuggcccuggggaugaugguucuuaaaauugugagagacauggagaaguaucagcuggccgugaccaucauggcuauucucugcgucccuaaugccgugauccugcagaacgcguggaaaguuucuuguacaauccucgcuguggucagcgugagcccccugcuucugacgagcucucaacagaagaccgacuggauuccucucgcccugacaaucaaaggacugaaucccaccgccauuuuccuuacaacccugucccgcacgaacaagaaaagaagcuggccgcucaaugaagcuaucauggccguuggcauggugucuauucuggcuuccagccuccugaagaacgauaucccuaugacagggccccuugucgccggaggccugcugaccgugugcuacguccucaccggccggucugcggaccuggagcuugaacgcgccacagaugugaagugggaggaccaggcugagaucuccgggagcuccccuauucugagcaucaccauuucugaagauggaagcauguccaucaaaaaugaggaagaggagcagacacucacgauucugaucagaaccggccuccugguuauuucugggcuuuuucccgugagcaucccgaucacagccgcugccugguaucugugggaagucaagaaacaacgggccggagugcugugggacguuccuucucccccucccaugggcaaggcugagcucgaagauggggcguaccgcauuaaacagaagggaauccugggcuauagccagauuggcgccgggguguacaaggagggaaccuuccacacaauguggcaugucaccagaggcgcugugcuuaugcacaaagggaagcggaucgaacccagcugggccgacgugaaaaaggaucugauuuccuacggaggcggguggaaacucgagggagaguggaaggaaggcgaggaaguucagguccuggcccucgagccuggcaagaacccgcgcgcugugcaaacgaaacccgggcuguuuaagaccaauacaggaaccaucggcgccgugucucuugacuucagcccugggacauccggaagccccaucauugauaaaaagggcaaagucguggggcuguauggaaacggcguugugaccagaucuggcgcguacgucuccgcuaucgcccagacagaaaagagcauugaggacaacccugauaucgaggacgacauuuuucggaagcgcagacugacgaucauggaucuccaccccggggccggaaaaaccaagcgguaucugccugcuaucgugagagaagccauuaaacgcggccuucggacacugauccucgcgccgaccagaguuguggcugccgagauggaagaggcccugcgcgggcuccccauucgguaccagaccccugcuaucagagccgaacauacaggacgcgagauugucgaccugaugugucacgcuacguucaccaugcggcuucugucucccgugagaguuccuaauuauaaccugaucauuauggaugaggcccauuucacagaccccgcguccaucgccgcucgcggcuacaucagcacccggguggaaaugggggaggccgcuggcauuuuuaugacagccaccccgccuggauccagagaucccuucccccaaucuaaugccccuaucauugacgaggaacgggagauccccgaacgcagcuggaacuccggccacgagugggucacggauuuuaaggggaaaacagugugguucgugccuagcauuaaggcuggaaaugacaucgcggccugccucagaaagaacggcaaaaaggucauccagcugucucggaaaaccuuugauuccgaauaugcuaagacccgcacaaaugacugggauuucguugugaccacagacauuagcgagaugggggccaacuuuaaagccgaaagagugaucgacccgcggagauguaugaagcccgucauucuuaccgauggagaggagcgcgugauccuggcuggcccuaugcccguuacgcauucuagcgccgcgcagcggagagggcgcauuggccggaauccuaaaaacgaaaaugaccaguacaucuacaugggagagccccucgaaaacgaugaggacugcgcucacuggaaggaagccaagaugcugcuggauaauaucaacacaccggagggcauuaucccuuccauguucgagcccgaaagagagaaaguggacgccauugauggggaauaucgccuccggggagaggcuagaaagaccuuugucgaccuuaugcgcagaggcgaucugccuguguggcuggccuacaaaguugcggccgaagggaucaauuaugcugaccggcgcugguguuucgauggaauuaagaacaaccaaauccucgaggagaauguggaagucgagauuuggacaaaagaaggcgagagaaagaagcugaaaccccgguggcuugacgcccgcaucuacucugauccucuggcucucaaggaguuuaaagaguucgccgcugggagaaagagccugacccugaaccucaucacggagaugggccggcuucccaccuucaugacacagaaaaccagagacgcccuggacaaucuggcggugcuccacacagccgaagcuggaggccgcgccuauaaccaugcucuguccgagcuuccggaaacccuggagacacuccugcugcucacccuucuggccacggucacagggggaauuuuucuguuccucaugucuggccgggggaucggaaagaugacccugggcaugugcugcauugugaccgccagcauccuucugugguacgcucagauucagccucacuggaucgcggccuccaucauucucgaguuuuuccugaucguucugcucauucccgaacccgagaagcaaagaacaccucaggauaaucagcuuaccuauguggugaucgcuauucugacagucguugccgccacgauggcuaacgaaaugggcuuucuggagaaaaccaagaaagaccucgggcugggaagcaucgccacacagcaaccggaaucuaauauccuugauauugaccugcgccccgcguccgccuggacccucuacgcuguggccacaaccuucgugacgccuaugcugcggcauagcaucgagaacuccucugucaaugugagccugaccgcuauugccaaccaggcgacaguucucaugggccuugggaagggauggccccuguccaaaauggauaucggcgugccucugcucgccauuggguguuacucucaggucaaucccaucacccugacagcugcccuucugcuccugguggcucacuaugccauuaucggaccuggccugcaggcuaaggccaccagagaggcgcaaaagcgggccgcugccggcaucaugaaaaacccgacggucgacgggauuacagugaucgaucucgaccccauuccuuacgaucccaaguuugaaaaacagcuuggacagguuaugcugcuggugcucugcgucacccaagugcugaugaugcgcacaaccugggcucuuugugaggcccugacccucgccacaggcccuaucagcacgcugugggaagggaaucccggaagauucuggaacaccacaauugcgguuuccauggcuaauaucuuucggggcagcuaucuggccggggcuggacuccuuuucucuaucaugaagaacaccacaaauacccgcagaggcacgggcaacauuggggagacacugggagaaaaauggaagucccggcugaacgcccucggcaaaagcgaguuucagaucuacaagaagucugggauucaggagguggaccgcacccuggccaaagaaggaaucaagagaggcgagaccgaucaccaugcugucucccgggggagcgccaaacuucgcugguucguggaaagaaauauggugacaccggagggaaagguugucgaccugggcugcggcagagggggauggucuuauuacuguggcgggcucaaaaacgugcgggaggugaagggacugaccaagggcgggccuggacacgaggaacccauucccaugagcacauauggcuggaaucugguccgccuccaguccggcguugauguguuuuucaucccucccgaaaaaugcgacacgcuucugugugacaucggggagucuagcccuaacccgaccguggaagcgggacggacacugagaguccucaaucugguggagaacuggcuuaauaacaauacccaauucugcauuaagguucugaaccccuacaugccuuccgugaucgagaaaauggaaacacuccagcgcaaguacggcggggcccugguccggaauccccugagcagaaacuccacccaugagauguauugggugucuaaugcuagcggaaacauuguuuccucugugaauaugaucagccgcaugcucauuaaccgguuuacgaugagacacaaaaaggccaccuacgaaccugaugucgaccuuggcuccgggacacgcaacaucggaaucgagucugaaauucccaaucuggauaucauuggcaagcggaucgagaaaauuaagcaggagcaugaaaccagcuggcacuaugaccaggaucacccguacaaaacaugggcuuaucauggcuccuacgagaccaagcaaacagggagcgccucuuccauggugaacggaguggucagacugcucaccaaaccuugggacguucugcccacggugacacagauggcgaugaccgauaccacaccuuucggccagcagcgcguguuuaaggaaaaggucgacacgcggacccaagagcccaaagaagggacaaagaaacuuaugaagaucaccgccgaguggcuguggaaagagcucggaaagaaaaagacaccuagaauguguacccgcgaagaguucacaagaaaggugcggagcaaugcugcccugggcgcuauuuuuaccgaugaaaacaaauggaagucugcccgcgaggcuguugaggacuccagauucugggaacugguggauaaagagcggaaucuccaccuggaagggaagugcgagacgugugucuauaacaugaugggaaaaagagaaaagaaacuuggcgaguuuggcaaagccaaggggagccgggcgaucugguacauguggcugggagcccgcuuccucgaguuugaagcucugggcuuccuuaaugaggaccauugguuuucuagagaaaacucccugagcgggguggagggagaaggccuccacaaacugggguacauccugcgggacguuuccaagaaagagggcggagccauguaugcugaugacaccgccggcugggauacacgcauuacccucgaggaccugaagaaugaagagauggugacaaaccacauggaaggggagcauaagagacuugccgaagcgaucuucaaacugaccuaccagaauaaggucgugcggguucagcgccccacgccgagaggaacagugauggauauuaucagccggcgcgaccaaagaggcucugggcaggucggaaccuauggccucaacacauuuaccaauauggaggcucagcugauucggcagauggagggggaaggcguguucaaaaacauccaacaccuuacggucaccgaggaaaucgccgugcagaauuggcuggcccgcguuggaagagagcggcucagccgcauggcuauuuccggcgaugacugcguggucaagccucuggaugacagauucgccucugcucugacagcccucaacgauauggggaaaauccggaaggacauucagcagugggagcccagcagaggauggaacgauuggacccaagugcccuuuugcucccaucacuuccaugaacugaucaugaaggacggccgcgugcuuguugugccuugucggaaucaggacgagcugauugggagagcgcgcaucucucagggagccggcuggagccuccgggaaacagcuugccuggggaaauccuacgcccagauguggucucuuauguauuuucacagacgcgaucugcggcucgcugccaacgcgaucuguagcgccgucccgucccacugggugcccaccagcagaacaaccuggucuauucaugcuaagcacgaguggaugacgacagaagacaugcugaccguuuggaaucgcguguggauccaagagaacccuuggauggaggauaaaacccccgucgaauccugggaggaaauuccuuaccugggcaagcgggaggaccaguggugcggaagccucaucggccugacaucuagagccaccugggcuaaaaauauucaggccgcuaucaaccaggugcgcucccuuauugggaaugaagaguauacagauuacaugcccagcaugaagcgguucagacgggaggaagaggaagccggaguccugugguga

SEQ ID NO: 19884 - RNA, 9876 nt, Artificial Sequence
  derived and/or modified CDS sequence (opt5) from DENV-2__FJ898452__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacggacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacgucaaaacacgcaccaacgacugggauuucguggugaccacagacauuuccgagaugggggccaauuuuaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaaagagagaaggucgacgccauugauggggaauaccgccuccggggagaggcuagaaaaacguuuguggaccuuaugcgcagaggcgaucugccuguuuggcuggccuauaagguggcggccgaggggaucaacuacgcugaccggcgcugguguuucgauggaaucaaaaacaaucagauucucgaagagaacgucgaaguggagaucuggacaaaggagggcgaaagaaagaaacugaagccccgguggcuugacgcccgcauuuauuccgauccucuggcucucaaagaguuuaaggaguucgccgcugggagaaaaucucugacccugaaucucaucacagagaugggccggcuucccaccuucaugacgcaaaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacagagaaccccucaagacaaccagcuuaccuacguggucaucgcuauucugacagugguugccgccaccauggcuaaugaaaugggcuuucuggagaagaccaagaaggaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaaacgggccgcugccggcauuaugaagaauccgacaguugacgggaucaccgugaucgaucucgaccccauuccuuaugaucccaaauuugaaaagcaacuuggacaggucaugcugcugauccucugcgugacgcagguccugaugaugcgcacaaccugggcucuuugugaggcccugacacucgccaccggcccuauuucuacccugugggaagggaaccccggaagauucuggaauacaacgaucgcggugagcauggcuaacauuuuucggggcuccuaccuggccggggcuggacuccuuuucagcaucaugaaaaauaccacaaacacccgcagaggcacaggcaacaucggggagacccugggagagaaguggaaaucucggcugaaugcccucggcaaguccgaauuucaaauuuauaagaaaagcgggauccaggagguugaccgcacgcuggccaaggaaggaauuaaaagaggcgagacagaucaccaugcugugucucggggguccgccaaacuucgcugguucgucgagagaaacauggugaccccggaaggaaaaguuguggaccugggcugcggcagagggggauggagcuacuauuguggcgggcucaagaauguccgggaggugaagggacugaccaaaggcgggccuggacacgaagaacccauccccaugucuacauacggcuggaaccuggugcgccuccagagcggcguugaugucuuuuucauuccucccgaaaagugcgacacccuucugugugauaucggggaguccucuccuaauccgacaguggaggcgggacggacgcugagagugcucaaccuggucgaaaauuggcuuaacaauaacacccaguucugcaucaaaguucugaaucccuacaugccuagcgugauugagaagauggaagcccuccaacgcaaauauggcggggcucuggugcggaacccccuguccagaaauagcacacaugagauguacugggucuccaacgccucuggaaauaucgugagcuccguuaacaugauuucucgcaugcucaucaaccgguuuaccaugagacacaagaaggcuacauaugaaccugacguggaccuuggcagcgggacccgcaauauuggaaucgaguccgagauucccaaccuggauaucaucggcaaacggauugaaaagaucaaacaggagcaugaaacgucuuggcacuacgaccaggaucacccguauaagaccugggccuaccauggcagcuaugagacaaaacagaccggguccgcgagcucuauggucaauggagugguuagacugcucacaaagccuugggacgugcugcccaccgucacacaaauggccaugaccgauacgacaccuuucggccagcagcgcguguuuaaggaaaaaguggacacccggacccaggagcccaaggaggggaccaagaaacuuaugaaaauuacggcugaauggcuguggaaggagcucggcaaaaagaagaccccuagaauguguacacgcgaagaguucaccagaaaaguccgguccaacgccgcucugggcgccaucuuuacagaugagaauaaguggaaaagcgcucgcgaagccguugaggacucuagauucugggaacugguggauaaggagcggaaccuccaccuggaagggaaaugcgagaccuguguguacaauaugaugggaaagagagagaagaaacuuggcgaauuuggcaaggcgaaagggucccgggccauuugguacauguggcugggagcucgcuuccucgaguuugaagcccugggcuuccuuaacgaggaccauugguuuagcagagaaaauucucuguccggggucgagggagagggccuccacaagcugggguauauccugcgggaugugagcaaaaaggaaggcggagcuauguacgccgacgacacagccggcugggauacccgcaucacgcucgaggaccugaagaacgaagagaugguuaccaaucacauggaaggggagcauaagaaacuugcggaggcuauuuucaaacugacauaucaaaacaaaguggucagagugcagcggcccaccccgcgcggaacaguuauggauaucauuuccagacgggaccagcgcggcagcgggcaagugggaaccuacggccucaauacguuuacaaacauggaagcccagcugaucagacagauggagggggaaggcgucuucaaaaauauucagcaccuuaccgugacagaggagguugccgugcaaaacuggcuggcucgggucggacgcgaaagacucucucggauggccaucagcggcgaugacugcguggucaagccucuggaugaccgcuucgcuaacgcccugaccgcgcucaaugauauggggaagaucagaaaagacauucagcagugggagcccuccaagggauggaacgauuggacacaggugcccuuuugcucucaucacuuccaugaacugaucaugaaagacggccggguucuuguggucccuuguagaaaucaagaugagcugauugggcgcgcccggaucagccagggagcuggcuggucccucagagaaaccgccugccuggggaagucuuaugcucagauguggagccuuauguacuuucaccgccgggaccugagacucgccgcgaacgccauuuguuccgcugugccgucucacugggugcccacaagccgcaccacaugguccauccaugccaaacacgaguggaugaccacagaggacaugcugaccguuuggaaucggguguggauuagagaaaacccuuggauggaggauaagacgcccgucgaaagcugggaggaaaucccuuaucugggcaagcgcgaggaccaguggugcggaucucucaucggccugacaucccgggcuaccugggccaaaaauauucaagcugccaucaaccaggugagaagccuuauugggaaugaggaauacaccgauuacaugcccucuaugaagcgcuuccggagagaggaagaggaagcgggaguucugugguga

SEQ ID NO: 19885 - RNA, 9876 nt, Artificial Sequence
  derived and/or modified CDS sequence (opt5) from DENV-2__GQ868591__SS-prME
agcgccggcaugaucauuaugcugauccccaccgugauggcuuuccaccucacaacgagaaacggggagccucauaugauugucucccggcaggaaaagggaaaaucucugcuuuuuaagaccgaggacggcguuaauaugugcacacugauggccauggaucucggggaacugugugaggacaccaucacauacaaaugcccgcuucugcgccaaaacgaacccgaggauauugacuguuggugcaauagcaccuccacaugggugaccuauggaacguguaccacaaugggcgagcacagacgggaaaagcgcucuguggcgcucgucccucauguggggaugggacuggagaccagaacagaaaccuggaugagcuccgagggcgcuuggaaacacguucagcggaucgagacguggauccugcgccaucccggcuucacaaugauggccgccauucucgcuuacaccaucgggacaacccacuuucagagagcccugauuuucauccuucugaccgcugugacaccuucuaugacgaugcggugcauuggaaugagcaaccgcgauuuugucgaaggcguguccgggggaagcuggguugacaucgugcucgagcacggcucuugugucaccacaauggccaagaauaagcccacccuggauuucgaacuuauuaaaacagaggcgaagcagccugccacccugagaaaauauugcaucgaagcuaagcucacgaacacaaccaccgagucccgguguccgacacaaggggagcccagccugaaugaagagcaggacaaacgcuuugugugcaagcauucuaugguggauagaggauggggcaacggcugugggcuguucggaaagggcgggaucgucaccugcgccauguuucggugcaaaaagaauauggaaggaaaaguugugcagccugagaaccucgaauacacaauugugaucacgccccacuccggcgaggagcaugcugucgggaaugacaccggaaagcacggcaaagaaauuaagaucacaccucagagcucuauuaccgaggccgaacugacaggcuaugggaccgugacgauggaguguuccccccgcaccggacuugauuucaacgaaaugguucugcuccaaauggagaauaaagcguggcuggugcacagacagugguuucuugaccugccgcucccuuggcugcccggcgccgauacacaggggagcaacuggauccagaaggagacccuggucacauucaagaauccucaugcuaaaaagcaagacgugguugugcucggaucccaggaaggcgccaugcacaccgcucugacgggggccacagagauccagaugucuagcggcaaccuucuguuuaccggacaucucaaaugccggcugagaauggacaagcuucaacugaaaggcauguccuacagcauguguacagggaaguucaaggucgugaaagaaauugccgagacccagcacggaaccaucgucauucgcgugcaguaugagggcgaugggucucccugcaagauccccuucgaaauuauggaccucgagaaacggcauguucugggaagacugaucacagugaacccuaucgucacggaaaaggauuccccggugaauauugaggcugaacccccuuuuggcgacagcuacaucauuaucgggguugagcccggccagcucaaacugaacugguucaagaagggaucuagcauuggccaaauguuugagaccacaaugcgcggggcgaaacggauggccauccuuggagauaccgcuugggacuucggcucccuggggggaguguuuacaucuauuggcaaggcccuccaccaggucuucggggccaucuacggcgcugccuuuagcggaguguccuggaccaugaaaauccugauuggcgugaucauuacguggaucgggaugaauagcagaucuacaucccugagcguuacccuuguccucgugggaauugugacccuguaucugggcgucauggugcaggcggauucuggguguguuguguccuggaagaacaaagaacucaagugcggaagcggcaucuucaucacagacaauguccacaccuggacagagcaguacaaguuucaaccugaaucccccucuaaacuggcuagcgccauucagaaggcccaugaggaagggaucuguggcauucgcuccgugacgcggcuugagaaccugauguggaaacagaucaccccggagcucaaucacauucugucugaaaacgagguuaagcugacaaucaugaccggagauaucaaaggcauuaugcaggcugggaagagaagccuucgcccucaacccacagaacucaaauauuccuggaagaccuggggaaaggccaaaaugcugagcacggagucucauaaucagaccuuccugaucgacggcccugaaacagcugagugccccaacaccaaucgggccuggaacucccucgagguggaagauuacggguuuggagucuucacaaccaauauuuggcugaagcuuaaagagaagcaggacguguuuugugacagcaaacugaugucugcggccaucaaggauaacagagcuguucacgccgacaugggcuauuggauugaauccgcucucaaugauacauggaagaucgagaaagccagcuucaucgaggugaagaacugccacuggccuaaaucucauacccuguggagcaacggcguccuggaauccgagaugauuauccccaagaaucuugcggggccggugagccagcacaacuaccgcccuggauaucauacgcaaauuacaggccccuggcaccucgggaaacuggaaauggacuucgauuuuugugacggaaccaccguggucguuacagaggauugcggcaaucgggggcccucucugagaaccacgacagccuccggaaagcucaucaccgaauggugcugucggagcugcacacugccuccgcuucgcuacagaggcgaggacggcuguugguacgggauggagauucggccccugaaggaaaaagaggaaaaccucgugaauucccuggugaccgcuggacauggccaggucgauaacuucucucugggggugcuuggaauggcccucuuucuggaggaaaugcugagaacacgcguuggcaccaagcacgcuauccuccugguggccgucagcuucgugacgcuuauuaccgggaauauguccuuucgggaccugggaagaguuauggugauggucggcgccacaaugaccgaugacaucggcaugggggugacauaucucgcucugcuggcggccuucaaaguucgcccuaccuuugcugccggacuucugcucagaaagcugacgucuaaagagcucaugaugacaaccaucggcauugugcugcuuagccaguccacaauccccgagaccauucuggaacucaccgaugcccuggcucuggggaugaugguccuuaagauggugcggaacauggagaaguaccaacuggccgugacaaucauggcgauucucugcgucccuaaugcuguuauccugcagaacgccuggaaagugucuuguacgauccucgccguggucagcguguccccccugcuucugaccagcucucagcagaagacagacuggauuccucucgcucugaccaucaaaggacugaaucccacagccauuuuccuuaccacgcugucccgcacaagcaagaaaagaucuuggccgcucaacgaagcgaucauggcuguuggcaugguguccauucuggccagcucucuccugaagaaugacaucccuaugaccgggccccuugucgccggaggccugcugaccgugugcuauguucucacaggccgguccgcugaucuggagcuugaacgcgccgcugacgugaaaugggaggaucaagccgagaucagcggguccagcccuauucugucuaucaccauuagcgaagacggauccaugucuaucaagaacgaggaagaggagcagacacucacgauucugaucagaaccggccuccuggucauuagcgggcuuuuucccguguccaucccgaucacagcggccgcuugguaccugugggaagucaagaaacagcgggccggagugcugugggauguuccuucucccccucccaugggcaaggcugagcucgaagacggggccuaucgcauuaaacagaagggaauccugggcuacagccaaauuggcgccgggguguauaaagagggaaccuuccacacaauguggcaugucaccagaggcgcugugcuuaugcacaaggggaagcggaucgaacccuccugggcggauguuaaaaaggaccugauuucuuacggaggcggguggaaacucgagggagaguggaaggaaggcgaggaagugcagguccuggcccucgagccuggcaaaaauccgcgcgcugugcagacgaagcccgggcuguuuaagaccaacgccggaacaaucggcgccgugagccuugauuucuccccugggaccagcggaucucccaucauugacaaaaagggcaaaguugucgggcuguacggaaacggcguggugacaagauccggcgcuuaugucagcgccaucgcgcagaccgaaaagucuauugaggauaauccugagaucgaagacgauauuuuucggaaaagacgccugacaaucauggaccuccaucccggggcuggaaagacgaagcgguaccugccugccaucgugagagaggccauuaaacgcggccuucggacccugauccucgcuccgacaagaguuguggccgcggaaauggaggaagcucugcgcgggcuccccauucgguaucaaaccccugccaucagagccgagcacaccggacgcgagauugucgaccugaugugucaugcuacauucacgaugcggcuucugucccccgugagaguuccuaacuacaaucugaucauuauggaugaagcccacuucaccgaccccgcuagcaucgccgcgcggggcuauaucuccacacgcguggagaugggggaagccgcuggcauuuuuaugaccgccacaccgccuggaucuagagaucccuucccccagagcaacgcuccuaucauugacgaggagcgggaaauccccgagcgcuccuggaauagcggccacgaaugggucaccgauuuuaaggggaaaacggugugguucguuccuucuauuaaggccggaaacgacaucgccgcuugccucagaaaaaauggcaagaaggugauccagcugucccggaaaacauuugauagcgaguacgucaagaccagaaccaacgacugggauuucguggugacaaccgacauuucugaaaugggggcgaauuuuaaagccgagcgcgucaucgauccgcggagauguaugaagcccguuauucuuacagacggagaggaacgcgugauccuggcuggcccuaugcccgugacccauagcuccgccgcccaacggagagggcgcauuggccggaacccuaaaaaugagaacgaccaguauaucuacaugggagaaccccucgagaaugaugaagacugcgcucacuggaaggaggccaaaaugcugcuggauaacaucaauacgccggagggcauuaucccuucuauguucgaacccgagagagaaaaggucgacgcgauugauggggaguaccgccucagaggagaagcucggaagacauuuguggaccuuaugcgcagaggcgaucugccuguuuggcuggccuaucggguggccgcugaggggaucaacuacgccgaccgcagaugguguuucgauggagucaaaaacaaucagauucucgaggaaaacguggagguugaaaucuggaccaaggagggcgagcggaaaaagcugaaacccagauggcuugacgcgcgcauuuauagcgauccucuggcccucaaggaauuuaaggaguucgcugccgggcggaaaucccugacacugaaucucaucaccgaaaugggcagacuucccacguucaugacccagaaggcucgcgacgcccuggauaaccuggcugugcuccauacagccgaggcgggaggccgggccuacaaucacgcucugucugaacuuccggagacccuggagacacuccugcugcucacccuucuggccacagucaccgggggaaucuuucuguuccucaugagcggcagagggauuggaaaaaugacgcugggcaugugcugcaucauuacagcuuccauccuucugugguaugcccaaauucagccucacuggaucgccgcuagcaucauucucgaauuuuuccugaucgugcugcucauucccgagcccgaaaagcagcggaccccucaggacaaccaacuuaccuacgucgugaucgcgauucugacaguuguggccgcuaccauggccaaugagaugggcuuucuggaaaaaacaaagaaggaccucgggcugggaucuaucgccacgcagcagccggaguccaacauccuugauauugaccugcgccccgcuagcgccuggacccucuaugcgguggccacaaccuucgucacaccuaugcugagacauuccaucgagaauucuagcguuaacgugucccugaccgcuauugccaaucaggcuacggugcucaugggccuugggaaaggauggccccugucuaagauggauaucggcgucccucugcucgccauuggguguuacagccaagugaaccccaucacccugacagcggcccuuuuucugcucguugcucacuacgccauuaucggaccuggccugcaggcuaaagccacccgggaagcucagaagcgcgccgcggccggcaucaugaaaaauccgacaguggacgggauuaccgucaucgaucuggaccccauuccuuaugaucccaaguucgagaagcagcucggacaagugaugcuucugguccugugcgugacgcagguucucaugaugagaacaaccugggcucugugugaagcccuuacacuggcuaccggcccuaucuccacccucugggaggggaaccccggacgguuuuggaauacaacgauugccgugagcauggccaacaucuuccgcggcucuuaccuggcgggggcuggacugcucuuuuccaucaugaaaaauaccacaaacaccagacggggcacaggcaacauuggggaaacccuuggagagaaguggaaaagccgccugaaugcccugggcaagucugaguuccagaucuauaaaaaguccgggauucaagaagucgacagaacgcucgcuaaagagggaaucaagcggggcgaaacagaucaucacgccgugagcagagggucugccaagcugcgcugguuuguugagcggaacauggugaccccggagggaaaagucguggaccuuggcugcggcagagggggauggagcuacuauuguggcgggcugaagaaugugcgcgaaguuaaaggacucaccaagggcgggccuggacaugaggaacccauucccauguccacauacggcuggaaccugguccggcugcagucuggcguggauguguucuucaucccucccgagaaaugcgacacccuccuuugugauaucggggaaagcuccccuaauccgacagucgaggcuggaagaacgcugcgcguucugaaccucguggagaauuggcugaacaauaacacccaguuuugcauuaaggugcuuaaucccuauaugccuagcgucaucgaaaagauggaggcccugcagcggaaauacggcggggcgcucgugagaaacccccugucccgcaauucuacacacgaaauguacuggguuagcaacgccuccggaaauauugugucuagcgucaacaugaucucccggaugcugauuaacagauucaccaugcgcuauaagaaagcuacauacgagccugacguggaccucggcucugggacccggaauaucggaaucgaaagcgagauucccaaccuugauaucauuggcaagagaaucgagaaaauuaagcaagaacacgagacguccuggcauuaugaccaggaucacccguacaagaccugggccuaucauggcagcuacgaaacaaaacagaccgggucugcuuccagcaugguuaauggagugguccgccugcugacaaagccuugggacguggugcccauggucacccagauggccaugacagauaccacgccuuuuggccaacagagaguuuucaaagagaagguggacacacggacccaggaacccaaagaggggaccaagaagcucaugaaaaucacagcggaguggcuguggaaggaacuuggaaaaaagaaaacgccucgcauguguaccagagaggaauuuacacggaaggugagaucuaacgccgcucugggcgccauuuucgcugaugagaauaaauggaaguccgcccgggaggcugucgaagacagccgcuuuugggagcucguggauaaggaaagaaaccugcaccuggaggggaaaugcgaaaccuguguuuauaauaugaugggaaagcgggagaaaaagcucggcgaguucggcaaagccaaggggucucgcgcgaucugguacauguggcugggagccagauuucuugaauucgaggcucugggcuuucucaacgaagaccacugguucucccgggagaauagccuguccgggguggaaggagagggccuucauaagcugggguacauccuccgcgaugucagcaaaaaggagggcggagccauguaugcugacgacacagccggcugggauaccagaauuacacuggaagaccugaaaaacgaggaaauggugaccaaucacauggagggggaacauaagaaacucgccgaggcgaucuuuaagcugacguaccagaacaagguugugcggguccaacgccccaccccgagaggaacagugauggauauuaucucucggcgcgaccagagaggcagcgggcagguuggaaccuauggccuuaauacauucaccaacauggaggcucaacugauucggcagauggaaggggagggcguguucaaauccauccagcaccucacgaucacagaagagauugccguccagaauuggcuggcccgcgugggaagagagcggcuuucuagaauggcuaucagcggcgaugacugcgucgugaagccucuggaugaccgcuuugccuccgcucucaccgcccugaacgauauggggaaaauucggaaggacauccaacagugggaacccucuagaggauggaacgauuggacacagguucccuucugcagccaucacuuucacgagcugauuaugaaagacggccgcgugcucgucgugccuugucggaaucaggaugaacugaucgggagagcgcgcaucucccaaggagccggcuggucucuucgggagaccgcuugccuggggaagagcuacgcccagauguggucccucauguauuuccauagacgcgaccugcggcuugcugccaacgcgauuuguagcgccgugccgucucacuggguucccacguccagaaccacauggagcauccaugcuaagcacgaauggaugaccacagaggacaugcugaccguguggaaucgcgucuggauucaggagaacccuuggauggaagauaaaacacccguggagucuugggaagagaucccuuaccucggcaagcgggaagaccaguggugcggaucccugauuggccugaccagcagagccacgugggcuaaaaauauccaagccgcuauuaaccagguucggucccucaucgggaaugaggaguauacagauuacaugcccucuaugaagagauuucgccgggaagaggaagaggccggagugcugugguga

SEQ ID NO: 19886 - RNA, 9876 nt, Artificial Sequence
  derived and/or modified CDS sequence (opt5) from DENV-2__GQ868542__SS-prME
uccgccggaaugaucauuaugcugauccccaccgugauggcuuuccaccugaccacgcggaauggggaaccucauaugauugucuccauccaggaaaagggaaaaucucugcuuuuuaagaccgaggacggcguuaauaugugcacacugauggccauggaucucggggaacugugugaggacaccauuacauacaaaugcccgcuucugcggcaaaaugaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggaugagcuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaagacaagcgguuugucugcaagcauucuaugguggaucgcggauggggcaauggcugugggcuguucggaaaaggcgggauugugaccugcgccauguuuacaugcaagaaaaacauggaaggaaagaucguccagccugagaaucucgaauacacgauuguugugacaccccacuccggcgaggagcaugcgguggggaacgacacaggaaaacacggcaaggaaaucaaagucaccccucagagcucuaucacagaggccgaacugaccggcuaugggacggugaccauggaguguucccccagaacaggacuugauuucaaugaaaugguucugcuccaaauggagaacaaggcuuggcuggugcaccggcagugguuucuugaccugccgcucccuuggcugcccggcgccgauacccaggggagcaauuggauucagaaggagacacuggucaccuucaaaaacccucaugcuaagaaacaagacgugguugugcucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaagucgugaaggaaauugcggagacccagcacggaacaaucgucauucgggugcaguaugagggcgaugggucucccugcaaaauccccuucgaaaucauggaccucgagaagagauacguucugggacgccugauuacggugaacccuaucgucaccgaaaaagauuccccggugaacauugaggccgaacccccuuuuggcgacagcuacaucauuaucgggguugagcccggccagcucaagcugaauugguucaagaaaggaucuagcauuggccaaauguuugagacaaccaugagaggggcuaagagaauggccauccuuggagauacagccugggacuucggcucccucgggggaguguuuaccucuaucggcaaagcucuccaucaggucuucggggccauuuauggcgcggcuuuuagcggaguguccuggacgaugaagauccugauuggcgugaucauuacauggaucgggaugaacagccgcucuaccucccugagcguuucucuuguccucgugggaaucgugacccuguaccugggcgucauggugcaggccgauuccggguguguugugagcuggaaaaauaaggaacucaagugcggauccggcauuuucaucacagacaacguccacaccuggacagagcaguauaaauuucaaccugaaucucccagcaagcuggccuccgcuauucagaaagcccaggaggaagggaucuguggcauucggucugugacgagacuugagaaucugauguggaagcagaucaccccggagcucaaccacauccuggcugaaaaugagguuaaacugacaauuaugaccggagauaucaagggcauuaugcaagccgggaaacgcagccuucggccucagcccacagaacucaaguacuccuggaagaccuggggaaaagcgaagaugcugagcacggagucucauaaccagaccuuccugaucgacggcccugaaacagccgagugccccaauaccaacagagcuuggaacucccucgagguggaagauuauggguuuggagucuucacaaccaacauuuggcugaaacuuaaggagaaacaggacgccuuuugugacagcaagcugaugucugcugccaucaaggauaaucgcgcggugcacgccgacaugggcuacuggaucgaauccgcucucaacgauacauggaaaauugagaaggccagcuucaucgagguuaaaaauugccauuggccuaagucucacacccuguggagcaacggcgugcuggaauccgagaugauuauccccaaaaaccuugcugggccggucagccaacacaauuaucggccuggauaccauacgcagauugccggccccuggcaccucgggaagcuggaaauggacuucgauuuuugugacggaacaaccgugguggucaccgaggauugcggcaacagagggcccucucugcgcacaaccacggccuccggaaagcucaucacagaauggugcugucggagcugcacccugccuccgcuuagauaccggggcgaggacggcuguugguaugggauggagauucgcccccugaaagaaaaggaggaaaaucucguuaacucccuggugacagcuggacauggccagguggauaauuucucucuggggguccuuggaauggcgcucuuucuggaggaaaugcugagaacccgggugggcacaaaacacgccauccuccugguugcugugagcuucgucacccuuaucacggggaacauguccuuuaaggaccugggaagagugguugugauggucggcgccaccaugacagaugacauuggcaugggggugaccuaccucgcccugcuggcugccuucaaaguucgcccuacauuugcggcuggacuucugcuccggaagcugaccucuaaggagcucaugaugacgacaaucggcauugugcugcuuagccaauccaccauccccgagacaauucuggaacucaccgaugcccuggcccuggggaugaugguccuuaaaaucgugagaaauauggagaaguaucagcuggcugugaccaucauggccauucucugcgucccuaacgcgguuauccugcagaaugcuuggaaagugucuuguacaauucucgccguggucagcgugagcccccugcuucugacgagcucucagcaaaagaccgacuggaucccucucgcccugacaauuaaaggacugaaccccaccgcuaucuuccuuacaacccugucccgcacgaauaagaaaagaagcuggccgcucaacgaagccaucauggcuguuggcauggugucuauucuggccuccagccuccugaagaaugacaucccuaugacagggccccuugucgcgggaggccugcugaccgugugcuacguucucaccggccggucugccgaucuggagcuugaacgcgcuacagacgugaagugggaggaucaggccgagauuuccgggagcuccccuauccugagcauuaccaucucugaagacggaagcauguccauuaaaaacgaggaagaggagcagacacucacgauccugaucagaaccggccuccuggucauuucugggcuuuuucccgugagcaucccgauuacagcugccgccugguaucugugggaagucaagaaacagcgggcuggagugcugugggauguuccuucucccccucccaugggcaaggcggagcucgaagacggggccuaccgcaucaaacaaaagggcauucugggcuauagccagaucggcgcugggguguacaaggagggaaccuuccauacaauguggcacgucaccagaggcgccgugcuuaugcacaaagggaagcggaucgaacccagcugggccgauguuaaaaaggaccugauuuccuacggaggcggguggaaacucgagggagaguggaaggaaggcgaggaagugcagguccuggcucucgagccuggcaagaauccgcgcgccgugcagacgaaacccgggcuguuuaagaccaacacaggaaccaucggcgcggugucucuugauuucagcccugggacauccggaagccccauuaucgacaaaaagggcaaaguugucgggcuguauggaaacggcguggugaccagaucuggcgcuuacgucuccgccauugcccaaacagaaaagagcaucgaggauaauccugagaucgaagacgauauuuuucggaagcgcagacugacgaucauggaccuccaucccggggcuggaaaaaccaagcgguaucugccugccauugugagagaggcgaucaaacgcggccuucggacacugauucucgcuccgaccagaguuguggccgccgaaauggaggaagcucugcgcgggcuccccauccgguaccagaccccugccauuagagcugagcacacaggacgcgagaucgucgaccugaugugucaugccacguucaccaugcggcuucugucucccgugagaguuccuaacuauaaucugaucauuauggaugaagcgcacuucacagaccccgccuccaucgcugcccgcggcuacauuagcacccggguggagaugggggaagcugccggcaucuuuaugacagccaccccgccuggauccagagaucccuucccccagucuaacgcuccuauuaucgacgaggagcgggaaauccccgagcgcagcuggaacuccggccaugaaugggucacggauuuuaaggggaaaacagugugguucguuccuagcauuaaggcgggaaacgacaucgccgcuugccucagaaagaauggcaaaaaggugauucaacugucucggaaaaccuuugauuccgaguaugucaagacccgcacaaacgacugggauuucguggugaccacagacaucagcgaaaugggggccaauuuuaaagccgagagagucauugauccgcggagauguaugaagcccguuauccuuaccgacggagaggaacgcgugauccuggcuggcccuaugcccgugacgcacucuagcgccgcgcagcggagagggcgcauuggccggaacccuaaaaaugagaacgaccaguacaucuacaugggagaaccccucgagaaugaugaagacugcgcucacuggaaggaggccaagaugcugcuggauaacauuaauacaccggagggcaucauuccuuccauguucgaacccgagagagaaaaagucgacgccaucgauggggaguaucgccuccggggagaagcuagaaagaccuuuguggaccuuaugcgcagaggcgaucugccuguuuggcuggccuacaaaguggcggccgaggggauuaacuaugcugaccggcgcugguguuucgauggaaucaagaacaaucagauccucgaggaaaacgucgagguggaaauuuggacaaaagagggcgagagaaagaagcugaaaccccgguggcuugacgcccgcaucuacucugauccucuggcucucaaggaauuuaaagaguucgccgcugggagaaagagccugacccugaaucucauuacggaaaugggccggcuucccaccuucaugacacagaagaccagagacgcccuggauaaccuggcgguucuccauacagccgaggcuggaggccgcgccuauaaucacgcucuguccgaacuuccggagacccuggagacacuccugcugcucacccuucuggccacggugacagggggaaucuuucuguuccucaugucuggccgggggauuggaaagaugacccugggcaugugcugcaucaucaccgccagcauucuucugugguacgcucagauccagccucauuggauugcggccuccaucauucucgaauuuuuccugaucguccugcucauccccgagcccgaaaagcagagaacaccucaagacaaccagcuuaccuauguggucauugcuauccugacagugguugccgccacgauggcuaaugagaugggcuuucuggagaagaccaagaaagaccucgggcugggaggcauugccacacagcagccggagagcaacauccuugauauugaccugcgccccgcgucugccuggacccucuacgcuguggccacaaccuucgugacgccuaugcugcggcacuccaucgagaauagcuccgucaacguuucucugaccgcuauugccaaucaagcgacagugcucauggggcuuggaaagggcuggccccugagcaaaauggauaucggggugccucugcucgccaucggauguuacucccaggucaaccccauuacccugacagcugcccuucugcuccugguggcucacuaugccaucauuggcccuggccugcaggcuaaggccaccagagaagcgcagaagcgggccgcugccgggaucaugaaaaauccgacgguugacggaauuacagugaucgaucucgaccccaucccuuacgaucccaaguuugagaaacaacuuggccaggucaugcugcuggugcucugcgucacccaggugcugaugaugcgcacaaccugggcucuuugugaagcccugacccucgccacagggccuauuucuacgcugugggagggaaaccccggcagauucuggaauaccacaaucgcgguuagcauggcuaacauuuuucggggguccuaucuggccggagcuggccuccuuuucagcaucaugaagaauaccacaaacacccgcagaggcacggggaacauuggagaaacacugggcgagaaauggaagucucggcugaaugcccucgggaaauccgaguuucaaaucuacaagaaguccggaauccaggaaguggaccgcacccuggccaaagagggcauuaagagaggggaaaccgaucaucacgcugucucucggggauccgccaaacuucgcugguucguggagagaaacaugguuacaccggagggcaagguggucgaccugggcugcgggcggggaggcuggagcuauuacugugggggacucaaaaaugugagagaagugaagggccugaccaaagggggaccuggccaugaggaacccauccccaugucuacauauggcuggaaccugguucgccuccagagcggggucgauguguuuuucauuccucccgagaaaugcgacacgcuucugugugauaucggagaauccucuccuaauccgaccguggaggcgggccggacacugagaguccucaaccugguugagaauuggcuuaacaauaacacccaguucugcauuaaggugcugaaucccuacaugccuagcgugaucgagaaaauggaggcccuccaacgcaaguacgggggagcucugguccggaacccccuguccagaaauagcacacacgaaauguauuggguguccaacgccucuggcaauaucguuagcuccgugaacaugauuucucgcaugcucaucaaccgguuuaccaugagacauaaaaaggcuacguacgagccugacgucgaccuugggagcggaacccgcaauauuggcaucgaauccgaggugcccaaccuggauauuaucggcaagcggauugagaaaaucaagcaggaacacgagacaucuuggcacuaugaccaggaucauccguacaaaaccugggccuaucacgggagcuacgaaacaaagcagaccggauccgcgagcucuaugguuaauggcguggucagacugcucacaaaaccuugggacgugcugcccaccgugacgcaaauggccaugacagauaccaccccuuucgggcagcagcgcgucuuuaaggagaagguugacacacggacgcaggaacccaaagagggaaccaagaaacuuaugaagaucacagcugaguggcuguggaaagaacucggcaagaaaaagaccccuagaauguguacacgcgaggaguucaccagaaaggugcgguccaacgccgcucugggggccauuuuuacagaugagaauaaauggaaaagcgcucgcgaggccguggaagacucuagauucugggagcuggucgauaaggaacggaaccuccaucuggagggaaagugcgaaaccuguguguauaauaugaugggcaaaagagagaagaaacuuggcgaguuugggaaagcgaagggaucccgggccaucugguacauguggcugggcgcucgcuuccucgaauuugaggcccugggguuccuuaacgaagaccacugguuuagcagagaaaauucucuguccggaguugaaggcgaggggcuccacaaacugggcuacauucugcgggaugugagcaagaaagagggaggcacgauguaugcugacgacaccgccgggugggauacacgcaucacccucgaagaccugaagaacgaggaaauggucacaaaucauauggagggagaacacaagaaacuugccgaggcgauuuucaagcugaccuaccaaaacaaagugguuagagugcagcggcccacgccgcgcggcacagucauggauaucaucuccagacgggaccagcgcgggagcggacaagugggcaccuaugggcucaauacauuuaccaacauggaggcucagcugauuagacagauggaaggcgagggaguuuucaagaauauccagcaucuuacggugaccgaagagauugccguccaaaacuggcuggcccgggugggccgcgagagacucucucggauggcuaucagcggggaugacugcgucgugaaaccucuggaugaccgcuucgccuccgcucugacagcccucaacgauaugggaaagauuagaaaggacauccagcagugggaacccucucggggcuggaaugauuggacccagguucccuuuugcagccaccauuuccacgagcugaucaugaaagacgggagagugcuugucgugccuugucgcaaccaagaugaacugauuggacgggcgagaaucucccagggcgccggguggucucuccgcgagacagcuugccugggcaagagcuacgcccagauguggucccuuauguauuuucaccggagagaccugcgccucgcugccaaugcgauuuguucugccgugccgagccauuggguucccaccucccggacaaccuggagcauccacgcuaaacaugaauggaugacgacagaggacaugcugaccguguggaacagagucuggauucaggagaauccuuggauggaagauaagacccccguggacucuugggaggaaaucccuuaccugggaaaacgcgaggaucaauggugcggcucccucauugggcugacaagccgggccaccugggcuaagaacauccaggccgcuaucaaucagguuagaucucuuauuggaaacgaagaguauacagacuacaugcccuccaugaagcgcuuccggagagaggaagaggaagccggcgugcugugguga

SEQ ID NO: 19887 - RNA, 9876 nt, Artificial Sequence
  derived and/or modified CDS sequence (opt5) from DENV-2__GQ868544__SS-prME
uccgucggaaugaucauuaugcugauccccaccgucauggccuuccaccugaccacgcggaauggggagccucauaugauuguuuccauccaggaaaagggaaagucucugcuuuuuaagaccgaggacggcgugaauaugugcacacugauggcuauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucugucgcccucgugccucauguugggaugggacuggagacacgcaccgaaacguggauguccuccgagggcgcguggaaacacgcucagagaaucgagacauggauucugcggcaucccggcuucaccaucauggccgccauucucgcuuacacaaucgggaccacccacuuucagcgcgcccugauuuucauccuucugacagcuguggccccuucuaugacgaugagaugcauuggaaucagcaaccgggauuuugucgaaggcguguccgggggaagcuggguugacaucgugcucgagcacggcucuugugucaccacaauggcgaagaauaagcccacccuggauuucgaacuuauuaaaacagaggccaagcagccugcuacccugcgcaaauauugcaucgaagccaagcucacgaacacaaccaccgaguccagauguccgacacaaggggagcccagccugaaagaagaacaggacaagcgguuugugugcaagcauucuaugguggaucgcggauggggcaauggcugugggcuguucggaaaaggcgggauugugaccugcgcuauguuuacaugcaagaaaaacauggaaggaaagaucguucagccugagaaucucgaauacacgauuguggugacaccccacuccggcgaggagcaugccgucgggaacgacacaggaaaacacggcaaggaaaucaaagugaccccucagagcucuaucacagaggcggaacugaccggcuaugggacgguuaccauggaguguucccccagaacaggacuugauuucaaugaaauggugcugcuccaaauggagaacaaggccuggcugguccaccggcagugguuucuugaccugccgcucccuuggcugcccggcgcugauacccaggggagcaauuggauucagaaggagacacuggugaccuucaaaaacccucaugccaagaaacaagacguugugguccucggaucccaggaaggcgcuaugcacacggcccugacaggggccaccgagauccagaugucuagcggcaaucuucuguuuacaggacaucucaagugccgccugagaauggacaaacuucaacugaagggcauguccuacagcauguguaccgggaaguucaaaguggucaaggaaauugcugagacccagcacggaacaaucgugauucggguucaguaugagggcgaugggucucccugcaaagugcccuucgaaaucauggaccucgagaagagauacguccugggacgccugaucacggugaacccuauuguuaccgaaaaagauuccccggugaacaucgaggcggaacccccuuuuggcgacagcuacauuaucauuggggucgagcccggccagcucaagcugaauugguucaagaaaggaucuagcaucggccaaauguuugagacaaccaugagaggggcuaagagaauggcuauucuuggagauacagccugggacuucggcucccucgggggaguguuuaccucuaucggcaaagcccuccaucagguguucggggcuaucuauggcgccgcguuuagcggaguuuccuggacgaugaagauucugaucggcgucauuaucacauggauugggaugaacagccgcucuaccucccugagcgugucucuugugcucgucggaaucgugacccuguaccugggcguuauggugcaggcugauuccgggugugucgugagcuggaaaaauaaggaacucaagugcggauccggcaucuucauuacagacaacguucacaccuggacagagcaguauaaauuucaaccugaaucucccagcaagcuggccuccgccauccagaaagcucaggaggaagggauuuguggcauccggucugugacgagacuugagaaucugauguggaagcagauuaccccggagcucaaccacauccuggccgaaaaugaggucaaacugacaaucaugaccggagauauuaagggcaucaugcaagcugggaaacgcagccuucggccucagcccacagaacucaaguacuccuggaagaccuggggaaaagccaagaugcugagcacggagucucauaaccagaccuuccugauugacggcccugaaacagcggagugccccaauaccaacagagccuggaacucccucgagguggaagauuauggguuuggaguuuucacaaccaacaucuggcugaaacuuaaggagaaacaggacgcuuuuugugacagcaagcugaugucugccgcuauuaaggauaaucgcgccgugcacgcggacaugggcuacuggaucgaauccgcccucaacgauacauggaaaaucgagaaggcuagcuucauugaggucaaaaauugccauuggccuaagucucacacccuguggagcaacggcgugcuggaauccgagaugaucauucccaaaaaccuugccgggccggugagccaacacaauuaucggccuggauaccauacgcagaucgcuggccccuggcaccucgggaagcuggaaauggacuucgauuuuugugacggaacaaccgucguugugaccgaggauugcggcaacagagggcccucucugcgcacaaccacggccuccggaaagcucauuacagaauggugcugucggagcugcacccugccuccgcuuagauaccggggcgaggacggcuguugguaugggauggagauccgcccccugaaagaaaaggaggaaaaucucgugaacucccuggucacagccggacagggccaaauugauaauuucucucugggggugcuuggaauggcucucuuucuggaggaaaugcugagaacccggguuggcacaaaacaugcgauccuccugguggccgucagcuucgugacccuuaucacggggaacauguccuuuaaggaccugggaagaguuguggucauggugggcgcuaccaugacagaugacauuggcauggggguuaccuaccucgcccugcuggccgcuuucaaagugcgcccuacauuugccgcgggacuucugcuccggaagcugaccucuaaggagcucaugaugacgacaaucggcauuguccugcuuagccaguccaccauccccgagacaauucuggaacucaccgaugcucuggcccuggggaugauggugcuuaaaaucgugagagacauggagaaguaucagcuggccgucaccaucauggcuauucucugcguuccuaaugccgugauccugcagaacgcguggaaagugucuuguacaauucucgcugucgugagcguuagcccccugcuucugacgagcucucaacagaagaccgacuggaucccucucgcccugacaauuaaaggacugaaucccaccgccaucuuccuuacaacccugucccgcacgaacaagaaaagaagcuggccgcucaaugaagcuaucauggccgugggcauggucucuauucuggcuuccagccuccugaagaacgauaucccuaugacagggccccuuguggccggaggccugcugaccguuugcuacgugcucaccggccggucugcggaccuggagcuugaacgcgccacagaugucaagugggaggaccaggcugagauuuccgggagcuccccuauccugagcauuaccaucucugaagauggaagcauguccauuaaaaaugaggaagaggagcagacacucacgauccugaucagaaccggccuccuggugauuucugggcuuuuucccgucagcaucccgauuacagccgcugccugguaucugugggaagugaagaaacaacgggccggaguucugugggacgugccuucucccccucccaugggcaaggcugagcucgaagauggggcguaccgcaucaaacagaagggcauucugggcuauagccagaucggcgccggggucuacaaggagggaaccuuccacacaauguggcaugugaccagaggcgcuguucuuaugcacaaagggaagcggaucgaacccagcugggccgacgugaaaaaggaucugauuuccuacggaggcggguggaaacucgagggagaguggaaggaaggcgaggaaguccaggugcuggcccucgagccuggcaagaacccgcgcgcugugcaaacgaaacccgggcuguuuaagaccaauacaggaaccaucggcgccguuucucuugacuucagcccugggacauccggaagccccauuaucgauaaaaagggcaaagucguggggcuguauggaaacggcguggucaccagaucuggcgcguacguguccgcuauugcccagacagaaaagagcaucgaggacaacccugauaucgaggacgacauuuuucggaagcgcagacugacgaucauggaucuccaccccggggccggaaaaaccaagcgguaucugccugcuauuguuagagaagccaucaaacgcggccuucggacacugauucucgcgccgaccagaguggucgcugccgagauggaagaggcccugcgcgggcuccccauccgguaccagaccccugcuauuagagccgaacauacaggacgcgagaucguggaccugaugugucacgcuacguucaccaugcggcuucugucucccguuagagugccuaauuauaaccugaucauuauggaugaggcccauuucacagaccccgcguccaucgccgcucgcggcuacauuagcacccgggucgaaaugggggaggccgcuggcaucuuuaugacagccaccccgccuggauccagagaucccuucccccaaucuaaugccccuauuaucgacgaggaacgggagauccccgaacgcagcuggaacuccggccacgagugggugacggauuuuaaggggaaaacaguuugguucgugccuagcauuaaggcuggaaaugacaucgcggccugccucagaaagaacggcaaaaaggucauucagcugucucggaaaaccuuugauuccgaauaugugaagacccgcacaaaugacugggauuucguggucaccacagacaucagcgagaugggggcuaacuuuaaagccgaaagaguuauugacccgcggagauguaugaagcccgugauccuuaccgauggagaggagcgcgugauccuggccggcccuaugcccgucacgcauucuagcgcugcccagcggagagggcgcauuggccggaauccuaaaaacgaaaaugaccaguacaucuacaugggagagccccucgaaaacgaugaggacugcgcgcacuggaaggaagcuaagaugcugcuggauaauauuaacacaccggagggcaucauuccuuccauguucgagcccgaaagagagaaaguggacgccaucgauggggaauaucgccuccggggagaggccagaaagaccuuuguugaccuuaugcgcagaggcgaucugccuguguggcuggcuuacaaagucgccgcggaagggauuaauuaugccgaccggcgcugguguuucgauggaaucaagaacaaccaaauccucgaggagaauguggaaguugagauuuggacaaaagaaggcgagagaaagaagcugaaaccccgguggcuugacgcucgcaucuacucugauccucuggcccucaaggaguuuaaagaguucgcugccgggagaaagagccugacccugaaccucauuacggagaugggccggcuucccaccuucaugacacagaaaaccagagacgcucuggacaaucuggccgugcuccacacagcggaagccggaggccgcgcuuauaaccaugcccuguccgagcuuccggaaacccuggagacacuccugcugcucacccuucuggcuacggucacagggggaaucuuucuguuccucaugucuggccgggggauuggaaagaugacccugggcaugugcugcaucgugaccgccagcauccuucugugguacgcccagauucagccucacuggaucgcugcguccauuauccucgaguuuuuccugauuguccugcucauccccgaacccgagaagcaaagaacaccucaggauaaucagcuuaccuaugugguuaucgccauucugacagugguggcugccacgauggccaacgaaaugggcuuucuggagaaaaccaagaaagaccucgggcugggaagcaucgcuacacagcaaccggaaucuaauauucuugauaucgaccugcgccccgccuccgcguggacccucuacgccgucgcuacaaccuucguuacgccuaugcugcggcauagcauugagaacuccucugugaaugugagccugaccgccaucgcuaaccaggccacaguccucaugggccuugggaagggauggccccuguccaaaauggauauuggcgugccucugcucgcgaucggguguuacucucagguuaaucccaucacccugacagccgcccuucugcuccugguggcccacuaugcuauuaucggaccuggccugcaggccaaggcuaccagagaggcccaaaagcgggcggccgcuggcauuaugaaaaacccgacggucgacgggaucacagugauugaucucgaccccaucccuuacgaucccaaguuugaaaaacagcuuggacaggucaugcugcuggugcucugcguuacccaagugcugaugaugcgcacaaccugggcccuuugugaggcucugacccucgccacaggcccuaucagcacgcugugggaagggaaucccggaagauucuggaacaccacaauugccgucuccauggcgaauaucuuucggggcagcuaucuggcuggggccggacuccuuuucucuauuaugaagaacaccacaaauacccgcagaggcacgggcaacaucggggagacacugggagaaaaauggaagucccggcugaacgcucucggcaaaagcgaguuucagauuuacaagaagucugggauccaggagguggaccgcacccuggccaaagaaggaaucaagagaggcgagaccgaucaccaugccguuucccgggggagcgcuaaacuucgcugguucguggaaagaaauauggucacaccggagggaaaggugguggaccugggcugcggcagagggggauggucuuauuacuguggcgggcucaaaaacguucgggaggucaagggacugaccaagggcgggccuggacacgaggaacccauucccaugagcacauauggcuggaaucuggugcgccuccaguccggcguggaugucuuuuucaucccucccgaaaaaugcgacacgcuucugugugacauuggggagucuagcccuaacccgaccguugaagccggacggacacugagagugcucaaucugguggagaacuggcuuaauaacaauacccaauucugcaucaagguccugaaccccuacaugccuuccgugauugagaaaauggaaacacuccagcgcaaguacggcggggcgcugguucggaauccccugagcagaaacuccacccaugagauguauugggugucuaaugccagcggaaacaucgucuccucugugaauaugaucagccgcaugcucauuaaccgguuuacgaugagacacaaaaaggcuaccuacgaaccugauguugaccuuggcuccgggacacgcaacaucggaauugagucugaaauccccaaucuggauauuaucggcaagcggauugagaaaaucaagcaggagcaugaaaccagcuggcacuaugaccaggaucacccguacaaaacaugggccuaucauggcuccuacgagaccaagcaaacagggagcgcuucuuccauggugaacggagucgugagacugcucaccaaaccuugggacgugcugcccacggucacacagauggccaugaccgauaccacaccuuucggccagcagcgcguuuuuaaggaaaagguggacacgcggacccaagagcccaaagaagggacaaagaaacuuaugaagaucaccgcggaguggcuguggaaagagcucggaaagaaaaagacaccuagaauguguacccgcgaagaguucacaagaaaggugcggagcaaugccgcucugggcgccauuuuuaccgaugaaaacaaauggaagucugcucgcgaggccgucgaggacuccagauucugggaacugguggauaaagagcggaaucuccaccuggaagggaagugcgagacguguguuuauaacaugaugggaaaaagagaaaagaaacuuggcgaguuuggcaaagcuaaggggagccgggccaucugguacauguggcugggagcgcgcuuccucgaguuugaagcccugggcuuccuuaaugaggaccauugguuuucuagagaaaacucccugagcgggguggagggagaaggccucuacaaacugggguauauucugcgggacgucuccaagaaagagggcggagcuauguacgccgaugacaccgcuggcugggauacacgcaucacccucgaggaccugaagaaugaagagauggugacaaaccacauggaaggggagcacaagaaacuugccgaagccauuuucaagcugaccuaucagaauaaaguugugagaguccagcggcccacgccgcgcggaacagugauggauaucaucagcagacgggaccaacgcggcucugggcagguuggaaccuacggccucaacacauuuaccaauauggaggcgcagcugauuagacagauggagggggaaggcguguucaagaacauccaacaucuuacggucaccgaggaaauugcugugcagaauuggcuggcccgggucggacgcgagagacucagccggauggccaucuccggcgaugacugcgugguuaaaccucuggaugaccgcuucgcuucugcccugacagcucucaacgauauggggaagauuagaaaggacauccagcagugggagcccagccggggauggaacgauuggacccaagugcccuuuugcucccaccauuuccacgaacugaucaugaaagacggcagaguccuuguggugccuugucgcaaucaggacgagcugauugggcgggccagaaucucucagggagcgggcuggagccuccgcgaaacagccugccuggggaaguccuaugcucagauguggucucuuauguacuuucaucggagagaucugcgccucgccgcuaacgccauuuguagcgcgguuccgucccacugggugcccaccagccggacaaccuggucuauccacgccaaacaugaguggaugacgacagaagacaugcugaccgucuggaauagaguguggauucaagagaacccuuggauggaggauaagacccccguugaauccugggaggaaaucccuuaucugggcaaacgcgaggaccaguggugcggaagccucauuggccugacaucucgggcuaccugggccaagaauauccaggcugccaucaaccaggugagaucccuuauugggaaugaagaguacacagauuacaugcccagcaugaagcgcuuccggagagaggaagaggaagcuggaguccugugguga

SEQ ID NO: 19888 - RNA, 9876 nt, Artificial Sequence
  derived and/or modified CDS sequence (opt5) from DENV-2__GQ868545__SS-prME
uccgccggaaugaucauuaugcugauccccaccgugauggcuuuccaccugacaacgcggaauggggagccucauaugauugucuccauccaggaaaagggaaaaucucugcuuuuuaagaccgaggacggcguuaauaugugcacacugauggccauggaucucggggaacugugugaggacaccauuacauacaaaugcccgcuucugcggcaaaacgaacccgaggauaucgacuguuggugcaauagcaccuccacaugggugaccuauggaacguguaccacaaccggcgagcaccgcagagaaaagcggucuguggcgcucgucccucauguggggaugggacuggagacacgcaccgaaacguggauguccuccgagggcgcuuggaaacacgcccagagaaucgagacauggauucugcggcaucccggcuucaccaucauggccgcuauucucgccuacacaaucgggaccacccacuuucagcgcgcucugauuuucauccuucugacagccguugcgccuucuaugacgaugagaugcauuggaaucagcaaccgggauuuuguggaaggcgucuccgggggaagcuggguggacaucguucucgagcacggcucuugugugaccacaauggccaagaauaagcccacccuggauuucgaacuuauuaaaacagaggcuaagcagccugccacccugcgcaaauauugcaucgaagcuaagcucacgaacacaaccaccgaguccagauguccgacacaaggggagcccagccugaaagaagaacaagacaagcgguuugucugcaagcauucuauuguggaucgcggauggggcaauggcugugggcuguucggaaaaggcgggaucgugaccugcgccauguuuacaugcaagaaaaacauggaaggaaagauuguccagccugagaaucucgaauacacgaucguugugacaccccacuccggcgaggagcaugcgguggggaacgacacaggaaaacacggcaaggaaaucaaagucaccccucagagcucugugacagaggccgaacugaccggcuaugggacgguuaccauggaguguucccccagaacaggacuugauuucaaugaaauggugcugcuccaaauggagaacaaggcuuggcugguccaccggcagugguuucuugaccugccgcucccuuggcugcccggcgccgauacccaggggagcaauuggauucagaaggagacacuggugaccuucaaaaacccucaugcuaagaaacaagacguugugguccucggaucccaggaaggcgccaugcacacggcccugacaggggcuaccgagauccagaugucuagcggcaaucuucuguuuacaggacaucucaagugccgccugagaauggacaaacuucaacugaagggcauguccuacagcauguguaccgggaaguucaaaguggucaaggaaauugcggagacccagcacggaacaaucgugauucggguucaguaugagggcgaugggucucccugcaaaauccccuucgaaaucauggaccucgagaagagauacgugcugggacgccugauuacggucaacccuaucgugaccgaaaaagauuccccgguuaacauugaggccgaacccccuuuuggcgacagcuacaucauuaucgggguggagcccggccagcucaagcugaauugguucaagaaaggaucuagcauuggccaaauguuugagacaaccaugagaggggcuaagagaauggccauccuuggagauacagccugggacuucggcucccucgggggagucuuuaccucuaucggcaaagcucuccaucagguguucggggccauuuauggcgcggcuuuuagcggaguguccuggacgaugaagauccugauuggcguuaucauuacauggaucgggaugaacagccgcucuaccucccugagcgucucucuugugcucgugggaaucgucacccuguaccugggcgugaugguucaggccgauuccggguguguggucagcuggaaaaauaaggaacucaagugcggauccggcauuuucaucacagacaacgugcacaccuggacagagcaguauaaauuucaaccugaaucucccagcaagcuggccuccgcuauucagaaagcccaggaggaagggaucuguggcauucggucuguuacgagacuugagaaucugauguggaagcagaucaccccggagcucaaccacauccuggcugaaaaugaggugaaacugacaauuaugaccggagauaucaagggcauuaugcaagccgggaaacgcagccuucggccucagcccacagaacucaaguacuccuggaagaccuggggaaaagcgaagaugcugagcacggagucucauaaccagaccuuccugaucgacggcccugaaacagccgagugccccaauaccaacagagcuuggaacucccucgaggucgaagauuauggguuuggaguguucacaaccaacauuuggcugaaacuuaaggagaaacaggacgccuuuugugacagcaagcugaugucugcugccaucaaggauaaucgcgcgguucacgccgacaugggcuacuggaucgaauccgcucucaacgauacauggaaaauugagaaggccagcuucaucgaggugaaaaauugccauuggccuaagucucacacccuguggagcaacggcguccuggaauccgagaugauuauccccaaaaaccuugcugggccggugagccaacacaauuaucggccuggauaccauacgcagauugccggccccuggcaccucgggaagcuggaaauggacuucgauuuuugugacggaacaaccguggucguuaccgaggauugcggcaacagagggcccucucugcgcacaaccacggccuccggaaagcucaucacagaauggugcugucggagcugcacccugccuccgcuuagauaccggggcgaggacggcuguugguaugggauggagauucgcccccugaaagaaaaggaggaaaaucucgugaacucccuggugacagcuggacauggccagaucgauaauuucucucuggggguccuuggaauggcgcucuuucuggaggaaaugcugagaacccgggugggcacaaaacacgccauccuccugguugcugugagcuucgucacccuuauuacggggaacauguccuuuaaggaccugggaagagugguugugauggucggcgccaccaugacagaugacaucggcaugggggugaccuaccucgcccugcuggcugccuucaaaguucgcccuacacuugcggcuggacugcuccugcggaagcucaccucuaaggagcugaugaugacgacaauuggcaucgugcuucugagccaauccaccauucccgagacaauccucgaacugaccgaugcccuggcccuugggaugaugguccugaaaaucgugagagacauggagaaguaucagcucgcugugaccauuauggccacacugugcgucccuaaugcgguuauccuccagaacgcuuggaaagugucuuguacgauucuggccguggucagcgugagcccccuucugcucaccagcucucagcaaaagacagacuggaucccucuggcccugaccauuaaaggacuuaaucccacagcuaucuuucugaccacgcucucccgcacaaacaagaaaagaagcuggccgcugaaugaagccaucauggcuguuggcauggugucuauucucgccuccagccugcuuaagaacgauaucccuaugaccgggccccuggucgcgggaggccugcucaccgugugcuacguucugacaggccggucugccgaccuugagcuggaacgcgcuaccgaugugaagugggaggaccaggccgagauuuccgggagcuccccuauccucagcauuacaaucucugaagauggaagcauguccauuaaaaaugaggaagaggagcagacgcugaccauccucaucagaacaggccugcuugucauuucugggcuguuccccgugagcaucccgauuaccgcugccgccugguaucugugggaagucaagaaacagcgggcuggagugcucugggacguuccuucucccccucccaugggcaaggcggagcuggaagauggggccuaccgcaucaaacaaaagggcauucuuggcuauagccagaucggcgcugggguguacaaggagggaacauuucauaccauguggcacgucacgagaggcgccgugcugaugcacaaagggaagcggaucgaacccagcugggccgacguuaaaaaggaucucauuuccuacggaggcggguggaaacuggagggagaguggaaggaaggcgaggaagugcagguccucgcucuggagccuggcaagaacccgcgcgccgugcagaccaaacccgggcuuuucaagacaaauaccggaacaaucggcgcggugucucuggacuuuagcccugggaccuccggaagccccauuaucgauaaaaagggcaaaguugucgggcuguauggaaacggcguggugacaagaucuggcgcuuacgucuccgccauugcccaaacggaaaagagcaucgaggacaacccugauaucgaggacgacauuuuccggaagcgcagacucaccaucauggaucugcaucccggggcuggaaaaacaaagcgguaucuuccugccauugugagagaagcgaucaaacgcggccugcggacccucauucuggcuccgaccagaguuguggccgccgagauggaagaggcucuccgcgggcugcccauccgguaccagaccccugccauuagagcugaacacacgggacgcgagaucgucgaccuuaugugucaugccaccuuuacaaugcggcugcugucucccgugagaguuccuaauuauaaccucaucauuauggaugaggcgcacuucaccgaccccgccuccaucgcugcccgcggcuacauuagcacacggguggaaaugggggaggcugccggcaucuucaugaccgccacgccgccuggauccagagaucccuuuccccagucuaaugcuccuauuaucgacgaggaacgggagauccccgaacgcagcuggaacuccggccaugagugggucacagauuucaaggggaaaaccgugugguuuguuccuagcauuaaggcgggaaaugacaucgccgcuugccugagaaagaacggcaaaaaggugauucaacuuucucggaaaaccuucgauuccgaauaugucaagacacgcaccaaugacugggauuuuguggugacaaccgacaucagcgagaugggggccaacuucaaagccgaaagagucauugacccgcggagauguaugaagcccguuauccugacggauggagaggagcgcgugauccucgcuggcccuaugcccgugacacacucuagcgccgcgcagcggagagggcgcauuggccggaauccuaaaaacgaaaaugaccaguacaucuacaugggagagccccuggaaaacgaugaggacugcgcucacuggaaggaagccaagaugcugcucgauaauauuaacaccccggagggcaucauuccuuccauguuugagcccgaaagagagaaagucgacgccaucgauggggaauaucgccuucggggagaggcuagaaagacauucguggaccugaugcgcagaggcgaucugccuguuuggcucgccuacaaaguggcggccgaagggauuaauuaugcugaccggcgcugguguuuugauggaaucaagaacaaccagauccuggaggagaaugucgaaguggagauuuggaccaaagaaggcgagagaaagaaacuuaaaccccgguggcuggacgcccgcaucuacucugauccucucgcucugaaggaguucaaagaauuugccgcugggagaaagagccugacgcucaaccuuauuaccgagaugggccggcugcccacauucaugacccagaagacaagagacgcccuggacaaucucgcgguucugcauaccgccgaagcuggaggccgcgccuauaaccacgcucuuuccgagcugccggaaacacucgagacccugcugcuccuuacgcugcuggccacagugaccgggggaaucuuccucuuucugaugucuggccgggggauuggaaagaugacccuuggcaugugcugcaucaucacagccagcauucugcucugguacgcucagauccagccucauuggauugcggccuccaucauucuggaguucuuucugaucguccuccuuauccccgaacccgagaagcagagaaccccucaagauaaucagcugacauauguggucauugcuauccugacggugguugccgccaccauggcuaacgaaaugggcuuccucgagaaaacaaagaaagaccuggggcuuggaagcauugccacccagcagccggaaucuaauauccuggauauugaccuccgccccgcguccgccuggacacuguacgcuguggccaccacguuugugaccccuaugcugcggcacagcaucgagaacuccucugucaauguuagccucacagcuauugccaaccaagcgaccgugcuuaugggccuggggaagggauggccccuguccaaaauggauaucggcgugccucuccuggccaucggguguuacucucaggucaaucccauuacacuuaccgcugcccugcuccugcugguggcucacuaugccaucauuggaccuggccuccaggcuaaggccacgagagaggcgcagaagcgggccgcugccggcaucaugaaaaacccgacaguugacgggauuaccgugaucgaucuugaccccaucccuuacgaucccaaguucgaaaaacaacugggacaggucaugcugcucgugcugugcgucacacaggugcuuaugaugcgcaccaccugggcucugugugaggcccucacacuggccacgggcccuauuagcacccugugggaagggaaucccggaagauuuuggaacacaaccaucgcgguuuccauggcuaauauuuuccggggcagcuaucucgccggggcuggacuucuguuuucuaucaugaagaacacaaccaauacgcgcagaggcacaggcaacauuggggagacccugggagaaaaauggaagucccggcucaacgcccugggcaaaagcgaguuccaaaucuacaagaagucugggauccaggagguggaccgcacccuugccaaagaaggaauuaagagaggcgagacagaucaucacgcugucucccgggggagcgccaaacugcgcugguuuguggaaagaaauaugguuaccccggagggaaagguggucgaccucggcugcggcagagggggauggucuuauuacuguggcgggcugaaaaacgugcgggaggugaagggacugacaaagggcgggccuggacaugaggagcccauccccaugagcacguauggcuggaaucucguucgccuucaguccggcgucgauguguucuuuauuccucccgaaaaaugcgacacccugcugugugacaucggggagucuagcccuaacccgacaguggaagcgggacggacccucagaguccugaaucuuguugagaacuggcugaauaacaauacacaguucugcauuaaggugcucaaccccuacaugccuuccgugaucgagaaaauggaaacccugcaacgcaaguacggcggggcccugguccggaauccccucagcagaaacuccacgcacgagauguauugggugucuaaugcuagcggaaacaucguuuccucugugaauaugauuagccgcaugcuuaucaaccgguucaccaugagacauaaaaaggccacauacgaaccugaugucgaccugggcuccgggacccgcaacauuggaaucgagucugaaauucccaaucuggauaucauuggcaagcggaucgagaaaaucaagcaggagcacgaaacaagcuggcacuaugaccaggaucauccguacaaaaccugggcuuaucacggcuccuacgagacaaagcagaccgggagcgccucuuccauggugaacggaguugugagacuccugacgaaaccuugggacguccuucccacagugacccaaauggcgaugaccgauacaacgccuuuuggccagcagcgcguguucaaggaaaaggucgacacccggacacaggagcccaaagaagggaccaagaaacugaugaagauuacagccgaguggcucuggaaagagcugggaaagaaaaagaccccuagaauguguacacgcgaagaguuuaccagaaagguucggagcaaugcugcccugggcgcuaucuucacggaugaaaacaaauggaagucugcccgcgaggcuguggaggacuccagauuuugggaacucguggauaaagagcggaagcugcaucuugaagggaaaugcgagaccugugucuauaauaugaugggaaagagagaaaagaaacugggcgaguucggcaaggccaaagggagccgggcgauuugguacauguggcucggagcccgcuuucuggaguucgaagcucuuggcuuucugaacgaggaccacugguucucuagagaaaauucccucagcgggguggagggagaaggccugcacaagcugggguacauccuccgggacguuuccaaaaaggagggcggagccauguaugcugaugacacagccggcugggauacccgcauuacacuggaggaccuuaagaacgaagagauggugaccaaucauauggaaggggagcacaaaaagcuggccgaagcgaucuuuaaacucacguaccaaaacaaggucgugagaguucagcggcccacaccgcgcggaaccgugauggauaucauuagcagacgggaccagcgcggcucugggcaagucggaacauauggccugaauaccuucacgaacauggaggcucagcuuaucagacagauggagggggaaggcguguuuaaaaauauucagcaucugaccguuacagaggaaaucgccgugcaaaacuggcucgcccgggucggacgcgagagacugagccggauggcuauuuccggcgaugacugcguggucaagccucuggaugaccgcuucgccucugcucucaccgcccugaaugauauggggaagaucagaaaagacauccagcagugggagcccagccggggauggaacgauuggacacaggugcccuucugcucccaccauuuucacgaacuuauuaugaaggacggcagaguucugguggucccuugucgcaaccaagacgagcucaucgggcgggcgagaauuucucagggagccggcuggagccugcgcgaaaccgcuugccuugggaaauccuacgcccagauguggucucugauguauuuccaccggagagaucuccgccuggcugccaaugcgaucuguagcgccgugccgucccauugggugcccacaagccggaccacguggucuauucacgcuaagcaugaguggaugacaaccgaagacaugcugaccguuuggaacagaguguggauccaggagaauccuuggauggaggauaaaacacccgucgaauccugggaggaaauuccuuaccucggcaagcgcgaggaccaauggugcggaagccugaucggccuuaccucucgggccacaugggcuaagaacauccaggccgcuauuaaucaggugagaucccugaucgggaacgaagaguauacggauuacaugcccagcaugaaacgcuuucggagagaggaagaggaagccggaguucucugguga

SEQ ID NO: 19889 - RNA, 9876 nt, Artificial Sequence
  derived and/or modified CDS sequence (opt5) from DENV-2__GQ868543__SS-prME
agcgccggaaugaucauuaugcugauccccaccgugauggcuuuccaccucaccacgagaaauggggagccucauaugauugucgggauccaggaaaagggaaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaggaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggagaacaaggcuuggcuggugcaccggcagugguuucuugaccugccgcucccuuggcugcccggggccgauaagcagggauccaauuggauucagaaagagacccuggucacauucaagaacccucaugcuaaaaagcaagacgugguugugcucggcagccaggaaggggccaugcacaccgcccugacgggcgcuacagagauccagauguccucuggaaaucuucuguuuaccggccaucucaaaugccgccugagaauggacaaacuucaacugaaggggaugagcuacuccauguguacaggaaaauucaaggucgugaaagaaauugcggagacccagcacggcaccaucgucauucgggugcaguaugagggggauggaagccccugcaagauccccuucgaaaucauggaccucgagaaaagauacguucugggccgccugauuacagugaacccuaucgucacggaaaaggauucuccggugaacauugaggccgaacccccuuuuggggacuccuacaucauuaucggcguugagcccggacagcucaagcugaauugguucaaaaagggcagcucuauugggcaaauguuugagaccacaaugcggggagcuaaaagaauggccauccuuggcgauaccgccugggacuucgggagccugggaggcauguuuacauccaucgggaaggcucuccaucagguguucggcgccauuuauggagcggcuuuuucuggcgucagcuggaccaugaaaauccugauuggggugaucauuacguggaucggaaugaacucccgcagcacaucucuguccgugagccuuguucucgucggcaucgugacccuguaccugggggugaugguccaggccgauucuggaugugugguuuccuggaagaauaaggaacucaaaugcggcagcgggauuuucaucaccgacaacgugcacacauggaccgagcaguauaaguuucaaccugaaucccccucuaaacuggccagcgcuauucagaaggcccaggaggaaggcaucuguggcauucgguccgucacaagacuugagaaucugauguggaaacagaucacgccggagcucaaccacauccuggcugaaaaugaggugaagcugaccauuaugacaggcgauaucaaagggauuaugcaagccggaaagcgcucucuucggccucagcccaccgaacucaaguacagcuggaaaacauggggcaaggcgaaaaugcuguccaccgagagccauaaccagacguuccugaucgacgggccugaaaccgccgagugccccaauacaaacagagcuuggaacucucucgagguugaagauuauggauuuggcguguucaccacaaacauuuggcugaaacuuaaagagaagcaggacgccuuuugugacuccaagcugaugagcgcugccaucaaagauaaucgcgcgguccacgccgacaugggcuacuggaucgaaucugcucucaacgauaccuggaagauugagaaagccuccuucaucgaggugaagaauugccauuggccuaaaagccacacacuguggucuaacgggguucuggaaagcgagaugauuauccccaagaaccuugcuggaccggugucccaacacaauuaucggccuggcuaccauacccagauugccgggcccuggcaccucggaaagcuggaaauggacuucgauuuuugugacggcacgacagucguggugaccgaggauugcgggaacagaggacccagccugcgcaccacaaccgccucuggcaaacucaucacggaauggugcugucgguccugcacacugccuccgcuuagauaccggggcgaggacggguguugguauggaauggagauucgcccccugaaggaaaaagaggaaaaucucgucaacagccugguuaccgcuggccauggacagguggauaauuucucccugggagugcuuggcauggcgcucuuucuggaggaaaugcugagaacacgggucgggaccaagcacgccauccuccugguggcuguuucuuucgugacacuuaucaccggaaacaugagcuuuaaagaccugggcagagucgugguuauggugggcgccacgaugaccgaugacauugggaugggagucacauaccucgcccugcuggcugccuucaaggugcgcccuaccuuugcggcuggccuucugcuccggaagcugacauccaaagagcucaugaugaccacgaucgggauuguucugcuuucucaaagcacaauccccgagaccauucuggaacucacagaugcccuggcccugggaaugauggugcuuaagaucgucagaaauauggagaaauaucagcuggcugugaccaucauggccauucucugcgugccuaacgcggucauccugcagaaugcuuggaagguuuccuguaccauucucgccguggugucugucagcccccugcuucugacauccagccagcagaagacggacuggaucccucucgcccugaccauuaagggccugaaccccacagcuaucuuccuuaccacacugucucgcaccaauaaaaagagauccuggccgcucaacgaagccaucauggcuguggggaugguuagcauucuggccucuucccuccugaagaaugacaucccuaugacgggaccccuuguggcgggcggccugcugacagucugcuacgugcucaccgggcggagcgccgaucuggagcuugaacgcgcuaccgacguuaaaugggaggaucaggccgagauuucuggauccagcccuauccuguccauuacaaucagcgaagacggcucuaugagcauuaagaacgaggaagaggagcagacccucacaauccugaucagaacggggcuccuggugauuuccggacuuuuucccgucucuaucccgauuaccgcugccgccugguaucugugggaagugaaaaagcagcgggcuggcguccugugggaugugccuucucccccucccauggggaaagcggagcucgaagacggagccuaccgcaucaagcaaaagggcauucugggcuauucccagaucggggcuggaguuuacaaagagggcacauuccauaccauguggcacgugacaagaggggccguccuuaugcacaagggaaaacggaucgaacccuccugggccgaugugaagaaagaccugauuagcuacggcgggggauggaagcucgagggcgaguggaaggaaggcgaggaaguucaggugcuggcucucgagccugggaaaaauccgcgcgccguccagaccaagcccggacuguuuaaaacgaacaccggcacaaucggggcggugucccuugauuucucuccuggaaccagcggcucccccauuaucgacaagaaagggaaggugguuggacuguauggcaacggcgucgugacaagaagcggggcuuacgugucugccauugcccaaaccgaaaaguccaucgaggauaauccugagaucgaagacgauauuuuucggaaacgcagacugacaaucauggaccuccaucccggagcuggcaagacgaaacgguaucugccugccauugucagagaggcgaucaagcgcgggcuucggacccugauucucgcuccgacaagagugguugccgccgaaauggaggaagcucugcgcggacuccccauccgguaccagaccccugccauuagagcugagcacaccggccgcgagaucguggaccugaugugucaugccacauucacgaugcggcuucugagccccgucagagugccuaacuauaaucugaucauuauggaugaagcgcacuucaccgaccccgccucuaucgcugcccgcggguacauuuccacacggguugagaugggcgaagcugccggaaucuuuaugaccgccacaccgccuggcagcagagaucccuucccccaguccaacgcuccuauuaucgacgaggagcgggaaauccccgagcgcucuuggaauagcgggcaugaaugggugaccgauuuuaaaggaaagacggucugguucgugccuuccauuaaggcgggcaacgacaucgccgcuugccuccgcaagaaugggaagaaaguuauucaacugagccggaagacauuugauucugaguaugugaaaacccgcaccaacgacugggauuucgucgugacaaccgacaucuccgaaaugggagccaauuuuaaggccgagagagugauugauccgcggagauguaugaaacccgucauccuuacagacggcgaggaacgcguuauccuggcugggccuaugcccgugacccacagcucugccgcgcagcggagaggccgcauuggacggaacccuaagaaugagaacgaccaguacaucuacaugggcgaaccccucgagaaugaugaagacugcgcucacuggaaggaggccaaaaugcugcuggauaacauuaauacgccggaggggaucauuccuagcauguucgaacccgagagagaaaagguggacgccaucgauggagaguaucgccuccggggcgaagcuagaaaaacauuugucgaccuuaugcgcagaggggaucugccuguguggcuggccuacaagguugcggccgagggaauuaacuaugcugaccggcgcugguguuucgauggcaucaaaaacaaucagauccucgaggaaaacguggaggucgaaauuuggaccaaggagggggagagaaagaaacugaagccccgguggcuugacgcccgcaucuacuccgauccucuggcucucaaagaauuuaaggaguucgccgcuggcagaaaaucucugacacugaaucucauuaccgaaaugggacggcuucccacguucaugacccaaaagacaagagacgcccuggauaaccuggcggugcuccauaccgccgaggcuggcgggcgcgccuauaaucacgcucugagcgaacuuccggagacacuggagacccuccugcugcucacacuucuggccaccguuacgggaggcaucuuucuguuccucauguccgggcggggaauuggcaagaugacacugggcaugugcugcaucaucaccgccucuauucuucugugguacgcucagauccagccucauuggauugcggccagcaucauucucgaauuuuuccugaucgugcugcucauccccgagcccgaaaaacagagaaccccucaagacaaccagcuuacauaugucgugauugcuauccugaccgucguggccgccacaauggcuaaugagaugggguuucuggaaaagacgaaaaaggaccucggacugggcuccauugccacccagcagccggagagcaacauccuugauauugaccugcgccccgcgucugccuggacacucuacgcuguugccaccacauucgugaccccuaugcugcggcacuccaucgagaauagcuccgugaacgucucucugacggcuauugccaaucaagcgaccguucucauggggcuuggaaaaggcuggccccugagcaagauggauaucggggugccucugcucgccaucggauguuacucccaggugaaccccauuacacugaccgcugcccuucugcuccuggucgcucacuaugccaucauuggcccuggccugcaggcuaaggccacaagagaagcgcagaaacgggccgcugccgggaucaugaagaauccgaccguggacggaauuacgguuaucgaucucgaccccaucccuuacgaucccaaauuugagaagcaacuuggccaggugaugcugcugauucucugcgucacacaggugcugaugaugcgcaccacaugggcucuuugugaagcccugacccucgucaccgggccuaucucuacacugugggagggaaaccccggcagauucuggaauacgaccauugccgugagcauggcgaacaucuuucggggguccuaucuggcuggagccggccuccuuuucagcauuaugaaaaauacaaccaacacacgcagaggcaccgggaacaucggagaaacgcugggcgagaaguggaaaucucggcugaaugcucucgggaaguccgaguuucaaaucuacaagaaaagcggcauucaggaaguugaccgcacacuggccaaggagggcaucaaaagaggggaaaccgaucaucacgccgugucucggggauccgcuaaacuucgcugguucgucgagagaaacauggugaccccggagggcaaaguuguggaccugggcugcgggcggggaggcuggagcuauuacugugggggacucaagaaugucagagaagugaagggccugacaaaagggggaccuggccaugaggaacccauucccaugucuaccuauggcuggaaccuggugcgccuccagagcgggguugaugucuuuuucaucccucccgagaagugcgacacacuucugugugauauuggagaauccucuccuaauccgacgguggaggccggccggacccugagagugcucaaccuggucgagaauuggcuuaacaauaacacacaguucugcaucaaaguucugaaucccuacaugccuagcgugaucgaaaagauggaggcgcuccaacgcaaauacgggggagcccuggugcggaacccccuguccagaaauagcacccacgaaauguauugggucuccaacgcuucuggcaauauugugagcuccguuaacaugaucucucgcaugcucauuaaccgguuuacaaugagacauaagaaggccaccuacgagccugacguggaccuugggagcggaacgcgcaauaucggcauugaauccgagauccccaaccuggauauuaucggcaaacggaucgagaagauuaaacaggaacacgagaccucuuggcacuaugaccaggaucauccguacaagacaugggcuuaucacgggagcuacgaaaccaaacagacaggauccgccagcucuauggucaauggcgugguuagacugcucaccaagccuugggacgugcugcccacagucacccaaauggcgaugacggauacaaccccuuucgggcagcagcgcguguuuaaggagaaaguggacacccggacacaggaacccaaggagggaacgaagaaacuuaugaaaaucaccgccgaguggcuguggaaagaacucggcaaaaagaagacaccuagaauguguacccgcgaggaguucacaagaaaaguccgguccaacgcugcccugggggcuauuuuuaccgaugagaauaaguggaaaagcgcccgcgaggcuguugaagacucuagauucugggagcugguggauaaggaacggaaccuccaucuggagggaaaaugcgaaacauguguguauaauaugaugggcaagagagagaagaaacuuggcgaguuugggaaggccaaaggaucccgggcgaucugguacauguggcugggcgcccgcuuccucgaauuugaggcucugggguuccuuaacgaagaccacugguuuagcagagaaaauucucuguccggagucgaaggcgaggggcuccacaagcugggcuacauucugcgggaugugagcaaaaaggagggaggcgccauguaugcugacgacaccgccgggugggauacgcgcaucacccucgaagaccugaagaacgaggaaaugguuacaaaucauauggagggagaacacaagaaacuugccgaggcgaucuucaaacugaccuaccaaaacaaaguggucagagugcagcggcccacaccgcgcggcaccguuauggauauuaucuccagacgggaccagcgcgggagcggacaagugggcacguaugggcucaauacauuuaccaacauggaggcucagcugauuagacagauggaaggcgagggagucuucaaaaauauccagcaucuuacagugaccgaagagguugccgugcaaaacuggcuggcccgggucggccgcgagagacucucucggauggcuauuagcggggaugacugcguggucaagccucuggaugaccgcuucgccaacgcucugacggcccucaaugauaugggaaagaucagaaaagacauccagcagugggaacccuccaagggcuggaacgauuggacccaggugcccuuuugcucucaccauuuccacgagcugauuaugaaagacgggcggguucuuguggucccuuguagaaaucaagaugaacugaucggacgcgcgcggauuagccagggcgccggguggucccucagagagacagcuugccugggcaagucuuacgcccagauguggagccuuauguauuuucaccgccgggaccugagacucgcugccaacgcgaucuguuccgccgugccgucucauugggugcccaccagccgcacaaccugguccauucacgcuaaacaugaauggaugacaaccgaggacaugcugacgguuuggaaucggguguggauccaggagaacccuuggauggaagauaagacacccgucgagagcugggaagagauuccuuaccugggaaagagagaagaccaauggugcggcucucucaucgggcugaccucccgcgccaccugggcuaaaaauauccaggccgcuauuaaccaggugcggagccuuaucggaaaugaggaguauacagauuacaugcccucuaugaagagauuccgccgggaagaggaagaggccggcguucugugguga

SEQ ID NO: 19890 - RNA, 9876 nt, Artificial Sequence
  derived and/or modified CDS sequence (opt5) from DENV-2__EU482544__SS-prME
accgccggcgugaucauuaugcugauccccacagucauggcuuuccaccucacgacccggaauggggagccucauaugauuguuggacggcaggaaaagggcaagagccugcuuuuuaagacagaggacggggugaauaugugcacccugauggccaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcgucgcgcucgugccucauguuggaaugggccuggagaccagaacggaaacauggauguccucugagggcgcuuggaagcacgugcagcggaucgagaccuggauucugcgccaucccggguucacaaucauggccgccauucucgcuuacaccaucggaaccacacacuuucagagagcccugauuuucauccuucugacggcugucgccccuagcaugaccaugcggugcauuggcaucuccaaccgcgauuuuguggaagggguuucuggaggcagcuggguggacaucguccucgagcacggguccugugugacaaccauggcgaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgucacaugcgcuauguuuacgugcaaaaagaauauggaagggaaaguugugcucccugagaaccuggaauacaccauugugaucacaccccacagcggggaggagcaugccgucggaaaugacaccggcaagcacggcaaagaaaucaagauuacaccucagucuuccaucaccgaggcggaacuuacgggguauggaaccgugacaauggaguguagcccccggaccggccuggauuucaacgaaaugguucuccugcagauggaggacaaagccuggcuugugcaccgccaaugguuucuggaucucccgcugccuuggcugcccggggcugacacacagggaucuaauuggauucagaaggagacccucgucacguucaagaacccucaugccaaaaagcaggacgugguugugcugggcucccaagaaggggcuaugcacacagcccuuaccggcgccacagagauccagaugagcuccggaaaucugcucuuuaccggccaucugaaaugcagacuucggauggauaagcugcagcucaaagggaugucuuacagcauguguaccggaaaguucaagauugucaaagaaaucgcugagacacaacacggcacgaucgugauuagaguccaguaugagggggacggaucccccugcaagauccccuucgaaauuauggaucuggagaaacgccaugugcugggccggcucaucaccguuaacccuauugugacagaaaaggacagcccggucaacaucgaggcggaacccccuuuuggggauucuuacauuaucaucggcguggagcccggacagcugaaacuuaauugguucaagaagggcuccagcauugggcagauguuugagaccacaaugagaggagccaaacgcauggcuauccugggcgacaccgccugggauuucgggucucucggaggcguuuuuacgagcauugggaaggcccugcaccaaguguucggcgcuaucuacggagccgcguuuuccggcgucucuuggacaaugaaaauucugaucggggugaucauuaccuggaucggaaugaacagccgguccaccagccuuucugugucccucguucuggucggcguggugacacuguaucucggggucauggugcaggcugacaccggauguguugugagcuggaagaauaaagaacugaagugcggcucugggauuuucaucacagauaacguccacacguggaccgagcaguacaaguuucagccugaaucccccagcaaacuugccuccgccauucaaaaggcucaugaggaaggcaucuguggaaucagaucugugacacgccuggagaaucucauguggaaacagauuaccccggagcugaaccacauccugagcgaaaaugagguuaaacuuacaauuaugaccggcgacaucaaagggauuaugcaggccggaaagcggucccucagaccucagcccacggaacugaaauauucuuggaagaccuggggcaaggcuaaaaugcugagcacagagucccauaaccaaaccuuccucaucgaugggccugaaacagccgagugccccaauaccaaccgcgcguggaauagccuggagguggaagacuacggauuuggcgucuucucuacaaacaucuggcuuaagcugcgggagaaacaggacguguuuugugauuccaagcucaugagcgccgcuauuaaagacaauagagccguucacgcugauaugggcuauuggaucgaaucugcccugaacgacaccuggaagauggagaaggcguccuucauugagaucaaaagcugccacuggccuaagucucauacgcuguggagcaauggggugcuugaauccgagaugauuauccccaaaaacuucgccggaccggucagccagcacaacuaccgcccuggcuaucauacacagaccgcugggcccuggcaccucggaaagcuggaaauggauuuugacuucugugagggcaccacagugguggucaccgaagauugcgggaaucggggacccucucugagaacgacaaccgccuccggcaaacucauuacagaguggugcugucggagcugcacccugccuccgcuucgcuacagaggcgaggacggguguugguacggaauggaaauccggccccugaaggagaaggaagagaaccucguuaauucccuggugacagcuggccaugggcaaaucgauaacuuuucucugggagugcuuggcauggcccucuuccuggaagagaugcugagaacccgcgucgggacgaaacacgccauucuccugguggcuguuagcuuugugacccuuaucacaggaaauauguccuuccgggaccugggcagagucauggugaugguuggcgcgaccaugacagaugacauugggaugggagugaccuaucucgcccugcuggcugccuuuaagguccgcccuacguucgccgcuggccuucugcucagaaaacugacaucuaaggagcucaugauggccaccaucgggauugcgcugcuuagccaguccacaauccccgaaaccauccuggagcucaccgaugcucuggcccugggaaugauggugcuuaaaauuguucggaacauggaaaaguaccagcuggccgugacaaucauggcuauuucuugcgucccuaaugccgugauccuccaaaacgcguggaaggugagcuguacgauucuggcugccgucuccguuagcccccuccugcuuaccucuucccagcagaaagccgacuggaucccucuggcucucacaaucaagggccugaaucccaccgccauuuuucugacaacccuuagccgcacgucuaaaaagagauccuggccgcugaacgaggcugugauggccguggggauggucagcauccucgcgucuucccugcucaaaaaugacauuccuaugacaggaccccugguggccggcggccuucugaccguuugcuaugugcugaccgggcggagcgcugaucucgaacuggagcgcgccgcugacgucaagugggaggaucaggccgaaaucuccggaagcucuccuauucuuagcaucacaauuuccgaggacggcucuaugagcaucaaaaacgaagaggaggaacacacccugacaauccucauuagaacggggcugcucgugaucuccggaguuuuccccgugucuauuccgaucaccgccgcugcgugguaccugugggaggucaagaagcaacgggccggcgugcuuugggaugucccuucucccccucccguggggaaagcugaacuggaggacggagccuaucgcauuaagcagagaggcaucuuuggcuacucccagaucggggccggaguuuauaaagaaggcacauuccauaccauguggcacgugacaagaggggcuguccugaugcaucgcggaaagagaauugagcccuccugggccgaugugaaaaaggaccucaucagcuacggcgggggauggaagcuggagggcgaauggaaagagggcgaagagguucaggugcuugcgcuggaaccugggaagaauccgcgggcuguccaaaccaaacccggacucuuuaagacgaacaccggcacaauuggggccgugucccuggauuucagcccuggaaccucuggcucccccaucguggacagaaaagggaagguugucggacucuacggcaauggcguggugacacgcagcggggccuaugucucugcuauugcccagaccgagaaguccaucgaggauaacccugaaaucgaggacgauauuuuccggaaaaagagacugacaaucauggaccuucaccccggagcgggcaaaacgaagcgcuaccugccugcuauugugcgggaagccaucaaaagagggcugcgcacccucauucuggccccgacacggguuguggcugccgagauggaagaggcucuuagaggacugcccauccgcuaucagaccccugccauucgggcggagcauaccggcagagaaaucgucgaccucaugugucacgccacauuuacgaugcggcugcucagccccgugcgcguuccuaacuacaaucugaucauuauggaugaggcucacuucaccgaccccgccuccaucgcugccagaggguauauuucuacacggguggaaaugggcgaggccgcuggaaucuuuaugaccgcgacaccgccuggcagccgcgaucccuucccccaguccaacgccccuauuauggacgaggaaagagagauccccgaacggagcuggaacucugggcaugagugggucaccgauuuuaagggaaagacggugugguucguuccuuccaucaaagcuggcaacgacauugccgccugccuuagaaagaaugggaaaaaggugauccaacugagccgcaaaacauuugauucugaauacgucaagacccgggcuaacgacugggauuucguggugaccacagacauuagcgagaugggagccaauuuuagagcggagcgcgucaucgauccgcggagauguaugaagcccguuauucugaccgacggcgaggaacgcgugauccucgcugggccuaugcccgugacacacuccucugccgcccagcggagaggccgcaucggaagaaacccuaaaaaugaaaacgaccaguauauuuacaugggcgagccccuggaaaaugaugaggacugcgcucauuggaaggaggccaaaaugcuucuggauaacaucaauaccccggaagggauuaucccuagcauguucgagcccgaacgggagaaggucgacgcgauugauggagaauaccgccucagaggcgaggcccggaaaacguuuguggaccugaugcgcagaggggaucugccuguuuggcucgcuuaucggguggccgcugagggaaucaacuacgccgacagacgcugguguuucgauggcauuaagaauaaccaaauccuugaagagaacgucgaaguggagaucuggacaaaagagggggaacggaagaagcugaaacccagauggcuggacgcucgcauuuauuccgauccucucgcccugaaggaguucaaagaauuugcggccggccggaagucucuuacccugaaucucaucacagagaugggaagacugcccaccuucaugacgcagaaagcucgggacgcccuggauaaccucgcuguucuucacaccgccgaagugggcgggcgcgccuacaaucacgcucugagcgagcugccggagacacucgaaacccugcuucugcucacacugcuggcgaccgucacaggaggcauuuuucucuuccuuauguccgggaagggaaucggcaagaugacccugggcaugugcugcauuaucacggccagcauccugcucugguaugcucagauucagccucauuggaucgccgccucuauuauccuggaguuuuuccuuauugugcugcucauccccgaacccgagaaacaaagaacaccucaggacaaccagcugaccuacgucgugaucgcuauucugaccguuguggccgcgacaauggccaaugaaaugggguuucucgagaagaccaaaaaggaccuuggacugggcuccaucacaacgcaggagagcgaauccaacauucuggauaucgaccuccggccggcuucugccuggacccuguaugcuguggccacaaccuucgucacacccaugcuucgccacagcauugaaaauagcucuguuaacgugagccugaccgcgaucgccaaucaagcuacggugcucauggggcugggaagaggcuggccucuguccaaaauggauauuggggucccccuccuugccaucggauguuacagccaggugaacccuaucacccugacagcugcccugcuccugcuuguugcucauuacgccauuaucggccccggccugcaggcgaaggccacccgggaagcucagaagcgcacagccgcugggauuaugaaaaauccuaccguggacggaaucacggucauugaucucgagccgauccccuaugacccuaaguuugaaaaacaacugggccaggugaugcugcucguccuuugcgugacacagguucugaugaugagaaccacaugggcccugugugaggcccucacccuggcgaccgggcccaucucuacacuuugggagggaaacccuggccgguucuggaauacgaccauugcuguguccauggccaacaucuuucgcgggagcuaccuggcuggagccggccuccuguucucuauuaugaagaauacaaccaacacaagacggggcaccgggaauaucggagaaacgcugggcgagaaauggaaguccagacucaacgcccuuggaaagagcgaauuucagauuuauaaaaagucuggaauccaagaggucgaucgcacacuggcuaaagagggcaucaagagaggggaaaccgaccaccaugccgugagcagaggauccgcgaaacugcgcugguucguugagcggaacauggugacccccgaaggcaaggucguggaucucggcugcgggagaggaggcuggucuuacuauugugggggacugaaaaaugugcgcgagguuaagggccuuacaaaagggggaccgggccacgaggagccuauucccaugagcaccuacggcuggaaccugguccggcuccaguccgggguggacguguucuuuacacccccugagaaaugcgauacgcugcugugugacaucggagaaagcucccccaauccuaccauugaggccggcagaacacuccgcguccuuaaccugguugaaaauuggcugaacaauaacacccaguucugcgugaaggugcucaauccguauaugcccucugucaucgagaaaauggaaacacugcaacggaaguacgggggagcucuugugagaaacccucugagccgcaauuccacccacgagauguacuggguuucuaacgccacgggcaauauugugagcuccgucaacaugaucucucggaugcucaucaauagauuuaccaugaaacauaagaaggcuacauaugagcccgauguggaccuggggagcggaacccgcaacauuggcaucgaaaacgagauuccuaaucuggacaucauuggcaaaagaaucgaaaagauuaaacaggagcacgaaacauccuggcauuacgaucaggaccaccccuauaagaccugggccuaccacgggagcuaugagacaaaacagaccggaucugcguccagcaugguuaacggcguggucaagcuccuuacgaagccgugggauguggugccuauggucacacaaauggccaugaccgacaccacacccuucgggcagcagcggguuuuuaaagagaagguggauacgcgcacccaggaaccuaaagagggaacaaagaaacugaugagaaucaccgcugaauggcuguggaaggagcucggcaagaaaaagacaccccggauguguaccagagaggaguucacacggaaagugcgcucuaaugccgcucugggggccaucuuuaccgacgagaacaaguggaaauccgcuagagaagccgucgaggauagccgguucugggaacuuguggaccgcgagagaaaucugcaucucgagggaaagugcgaaacguguguuuacaacaugaugggcaaacgggagaagaagcugggcgaauuugggaaagcgaagggaucucgcgccauuugguauauguggcugggcgcuagauuccucgaguuugaagcccugggguuccuuaaugaggaucacugguuuucccggggaaacagccuguccggcguggagggggaaggccuccauaaacugggauacauccuucgcgacgucagcaagaaagagggcggggcuauguacgccgaugacaccgccggaugggacacaagaauuacccuggaagaucucaagaaugaggaaauggugacaaaccacaugaagggcgagcauaaaaagcuggcggaggcuaucuucaaacugaccuaucaaaauaagguugugcggguccagcgcccuacgcccagagggacagugauggacauuaucucucggaaagaucagcgcggaagcggccagguugggaccuacggccucaacacauucaccaauauggaagcccaacugaucagacagauggagggagaaggcauuuuuaaguccauccagcggcuuacggugaccgaggagauugccguccaaaacuggcuggcuagaguggggcgcgaacggcucucuagaauggccaucagcggagacgauugcgucgugaagccgcuggacgaucgcuucgcuuccgcccuuacagcgcugaaugacaugggcaaaguucggaaggauauucagcagugggagccuucuagaggguggaacgacuggacccaggugcccuuuugcagccaccacuuccaugaacucgucaugaaagauggacgcgugcuggugguucccugucggaaccaagacgagcugaucggcagagcccgcaucucccagggggcuggcuggucucucaaggaaacagccugccugggaaaaagcuaugcucagauguggacccuuauguacuuucaccggagagaucugcgccucgccgcgaaugccauuuguuccgcugugccuagccauugggucccgacaucucggaccacgugguccauccacgccaagcacgaguggaugacaaccgaggacaugcuggcuguguggaacagaguuuggauucaggaaaaucccuggauggaggacaagaccccuguggaaagcugggaggaaguccccuaucuuggcaaacgggaggaucaauggugcgggucucugaucggacucacauccagagccaccugggcuaagaacauucagacagccaucaaucaggugcgcagccugauuggcaacgaggaauacacggacuauaugccuuccaugaaacgguucagaaaggaggaagaggaagcggggguccugugguga

SEQ ID NO: 19891 - RNA, 9876 nt, Artificial Sequence
  derived and/or modified CDS sequence (opt5) from DENV-2__EU482545__SS-prME
accgccggagugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauuaugaucacaccccacagcggggaggagcaugcggugggaaaugacaccggcaagcacggcaaagaaaucaagauuacaccucagucuuccaucaccgaggccgaacugacgggguauggaaccgugacaauggaguguagcccccggaccggccuugauuucaacgaaaugguccugcuccaaauggaggacaaggcuuggcuggugcaccgccagugguuucuugaucugccgcucccuuggcugcccggggccgacacacagggaucuaauuggauucagaaggagacccugguuacguucaagaacccucaugcuaaaaagcaagacguggucgugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauuguuaaagaaaucgcggagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcguggggaaggcucuccaccagguuuucggcgccauuuacggagcggcuuuuuccggcgugucuuggacaaugaaaauccugauuggggucaucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacaggcgacauuaaagggaucaugcaggccggaaagcggucucuuagaccucaacccaccgaacucaaauauagcuggaagacguggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacaaacaucuggcugaaacuucgggagaaacaggacguguuuugugauuccaagcugaugagcgccgcuaucaaagacaauagagccguccacgcggauaugggcuauuggauugaaucugcccucaacgacaccuggaagauggagaaggcuuccuucaucgaggugaaaagcugccacuggccuaagucucauacgcuguggagcaaugggguucuggaauccgagaugauuauccccaaaaacuucgccggaccggugagccagcacaacuaccgcccuggcuaucauacacaaaccgcugggcccuggcaccuuggaaagcucgaaauggauuuugacuucugugagggcaccacagucguggugaccgaagauugcgggaaucggggacccucucugagaacgacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacagccggccaugggcagauugauaacuuuucucugggagugcugggcauggcucuuuuccucgaagagaugcugagaacccgcguggggacgaaacacgcgauccugcucgucgccgugagcuuuguuacccugaucacaggaaauauguccuuccgggaccuuggcagagugauggucauggugggcgcuaccaugacagaugacauugggaugggaguuaccuaucuggcccuccuggccgcuuuuaaggugcgcccuacguucgccgcgggccugcuucugagaaaacucacaucuaaggagcugaugauggcuaccaucgggauugcccuccugagccaguccacaauccccgaaaccauucuugagcugaccgaugcccucgcucugggaaugauggcccugaaaaucgucaagaacauggaaaaguaccaacuugcggugacaaucauggcuauuucuugcguuccuaaugccgugauccugcagaacgccuggaaagucagcuguacgauucucgcugccguguccgugagcccccugcuccugaccucuucccagcagaaggcugacuggaucccucuugcccugacaauuaaaggccucaaucccaccgcgaucuuucugacaacccugagccggacgucuaagaaacgcuccuggccgcuuaacgaggccaucauggcugucgggaugguuagcauucuggccucuucccuccugaagaaugacaucccuaugacaggaccccucguggcuggcggccugcuuaccgugugcuauguccugaccgggagaagcgccgaucuggaacucgagcgggccgcugacgugaaaugggaggaucaagcggaaauuuccggaagcucuccuauccugagcauuacaaucuccgaggacggcucuaugagcauucgcaacgaagaggaggaacagacccuuacaauccugaucagaacggggcuccugguuauuuccggaguguuccccgucucuaucccggugaccgccgcugccugguaccucugggagguuaagaagcagcgggccggcgugcugugggaugucccuucucccccucccguggggaaagcugaacuugaggacggagccuaucgcauuaagcagagaggcauccugggcuacucccaaauuggggcgggagucuauaaagaaggcacauuucacaccauguggcaugugacaagaggggcuguucugaugcaccgcggaaagagaaucgagcccuccugggccgaugugaaaaaggaccucgucagcuacggcgggggauggaagcuggagggcgaauggaaagagggcgaagaggugcagguucuugcccuggaaccugggaagaauccgcgggcugugcagaccaaacccggaaucuucaagacgaacaccggcacaauuggggccgucucccucgauuuuagcccuggaaccucuggcucccccaucguggacagaaaagggaaggugguuggacuguacggcaauggcgucgugacacgcagcggggcguaugugucugcuauugcccagaccgagaaguccaucgaggauaacccugaaauugaggacgauaucuuccggaaaaagagacucacaaucauggaccugcaucccggagccggcaaaacgaagcgcuaccuuccugcuauuguccgggaagccaucaaaagagggcugcgcacccugauucucgcuccgacacgggugguugccgcggagauggaagaggcccugagaggacuucccauccgcuaucaaaccccugcuauucgggccgagcacaccggcagagaaaucguggaccugaugugucaugcuacauucacgaugcggcuccugagccccguccgcgugccuaacuacaaucucauuaucauggaugaggcccacuuuaccgaccccgccuccaucgcugcgagaggguauauuucuacacggguugaaaugggcgaggccgcuggaaucuucaugaccgccacaccgccuggcagccgcgaucccuuuccccaguccaacgccccuauuauggacgaggaaagagagauccccgaacggagcuggaacucugggcacgagugggugaccgauuucaagggaaagacggucugguuugugccuuccauuaaagcuggcaacgacaucgccgcgugccugagaaagaaugggaaaaagguuauccagcuuagccgcaaaacauucgauucugaauacgugaagacccgggcuaacgacugggauuuugucgugaccacagacauuagcgagaugggagccaauuucaaggccgagagagugaucgauccgcgccgguguaugaaacccgucauucugaccgacggcgaagagagaguuauccuggcugggccuaugcccgugacacauuccucugccgcgcaacgccggggcagaauuggacgcaacccuaagaaugaaaacgaccaguauaucuacaugggcgagccccucgaaaaugaugaggacugcgcccacuggaaagaggcuaagaugcugcuugauaacaucaauaccccggaagggauuaucccuagcauguuugagcccgaaagagagaaaguggacgccauugauggagaauaccggcugcgcggcgaggcuagaaagacguucgucgaccucaugcggcgcggggaucugccuguguggcuggccuauaaaguugcugccgagggaaucaacuacgcggacagacggugguguuuugauggcauuaagaauaaccagauccucgaagagaacguggaagucgagauuuggacaaaggagggggaacgcaagaaacuuaaaccccgcuggcuggacgcccggaucuauuccgauccucuggcucucaaggaguucaaagaguucgccgcuggcagaaagucucugacccuuaaucugaucacagagaugggacgccuccccaccuuuaugacgcagaaggcccggaacgcccuggacaaucuggcugugcuccauaccgcggaagccggcgggaaggcuuacaaccacgcccuuagcgagcugccggagacacuggaaacccuccugcuucugacacuccuggccaccguuacaggaggcauuuuccuguuucucauguccgggaagggaaucggcaaaaugacccuuggcaugugcugcauuaucacggcuagcauucugcugugguaugcccaaauccagccucacuggaucgcggccucuauuauccucgaguucuuucugauugugcuucugauccccgaacccgagaagcagagaacaccucaggauaaucaacucaccuacgucgugauugcuauccugaccgucguggccgcuacaauggccaacgaaaugggguuccuggagaaaaccaagaaggaccucggacuuggcuccaucacaacgcaggagagcgaauccaauauucuggacaucgaucugcggccggcgucugccuggacccucuaugcuguugccacaaccuuugugacacccaugcugcgccauagcauugagaacuccucugugaaugucagccuuaccgcuaucgccaaccaggcuacgguucugauggggcucggaaaaggcuggccucuguccaagauggacauuggggugccccugcucgccaucggauguuacagccaggugaauccuauuacccuuacagcggcccugcugcuccuggucgcucacuacgccaucaucggccccggccuucaagcuaaagccaccagagaagcccagaagcgggcggcugccgggauuaugaaaaacccuacaguggauggaaucaccguuauugaccuggagccgauccccuaugauccuaaguucgaaaagcagcucggccaggugaugcugcugauucucugcgucacgcaagugcuuaugaugcgcacaaccugggcucugugugaggcccugacacucgccaccgggcccaucucuacccugugggagggaaauccuggcagauuuuggaacacaacgaucgcugucuccauggccaauauuuuccgggggagcuaccuugcgggagccggccugcucuuuucuaucaugaaaaacaccacaaauacccgcagaggcacagggaacauuggagaaacccugggcgagaaguggaaaucccggcugaacgcucucggaaagagcgaguuccagaucuauaaaaagucuggcauucaggagguggaccgcacgcuugccaaagagggcaucaagagaggggaaacagaucaucacgcuguuagccggggauccgccaagcugagaugguuuguggagcgcaauauggucacccccgaaggcaaagugguugaccugggcugcgggcggggaggcuggucuuacuauugugggggacucaagaacgugagagaggucaaaggccugaccaaagggggaccgggccaugaagaaccuauccccaugagcacauacggcuggaaucuugugcgccugcaauccgggguggauguuuucuucacacccccugagaaaugcgacacccuccugugugauauuggagaaagcucccccaacccuacgaucgaggcgggccggacccugagaguccucaaucuuguggaaaacuggcugaauaacaauacacaguuuugcauuaaggugcugaacccguauaugcccucugucaucgagaagauggaaacccuccagcgcaaauacgggggagcccugguucggaauccucuuagcagaaacuccacacacgagauguacugggugucuaaugcuaccggcaacauugugagcuccgucaauaugaucucucgcaugcugaucaaccgguucacgaugaagcacaaaaaggccaccuaugagcccgacguggaucucgggagcggaacaagaaacauuggcaucgaauccgagauuccuaaucuggacaucauuggcaaacgcaucgaaaagauuaagcaggagcaugaaaccagcuggcacuacgaccaagaucaucccuauaaaacaugggcuuaccacgggucuuaugagaccaagcagacaggauccgccagcucuaugguuaacggcgugguccggcugcucaccaaaccgugggacgugguuccuauggugacgcagauggcuaugacagauaccacccccuuugggcagcaaagagucuucaaggagaaaguggacacacgcacgcaggaaccuaaggagggaaccaagaaacuuaugaagaucacagccgaauggcuguggaaagagcugggcaagaaaaagacccccagaauguguacacgggaggaauuuacccgcaaagugagauccaaugcggcccucggggcuaucuucacagaugagaacaaguggaaaagcgcccgggaagcugucgaggacggaagauuuugggaacugguugaucgggagcgcaaucuucaccuggagggcaaaugcgaaaccuguguguacaacaugaugggcaagagagagaaaaagcucggggaguucggaaaagccaagggcucucgggccauuugguauauguggcugggggcgcgcuuucuggaguucgaagcucucggauuucugaaugaggaccauugguucuccagaggcaacagccuuuccgggguggagggcgaaggacugcaccggcucggcuacauccugcgcgaugucagcaagaaagaagggggagccauguacgccgacgauacggcuggcugggacaccagaauuacacuugaagaccugaagaaugaggaaauggugaccaaccauaugaaaggggagcacaagaaacucgccgaggcuaucuuuaagcugacauaucagaauaagguugugcggguccagcgcccuacccccagaggaacggugauggauauuaucucucggcgcgaccaaagaggcagcgggcagguuggcacauacggacugaacaccuucacaaauauggaagcccagcucauccggcaaauggagggcgaagggauuuucaaauccauccagcaucugaccgugacggaggagauugcgguccagaacuggcuugcccgcgugggaagagaacggcugucuagaauggcuaucagcggcgaugacugcguugugaagccgauugaugaccgcuuugccuccgcucucaccgcccugaaugauauggggaaaguccggaaggacauccagcaaugggagccuucuagaggauggaacgauuggacacaggugcccuucugcagccaccacuuucaugaacuugucaugaaagacggccgcgugcugguugugcccugucggaaccaggaugagcucaucgggagagcgcgcauuucccagggcgccggauggucucugaaggaaaccgcuugccugggcaagagcuaugcccaaauguggacacucauguacuuccaccggagagaccugcgccuugcugccaaugcuaucuguuccgccgucccuagccauugggugccgaccucucggacaaccugguccauucacgcgaaacacgaguggaugacgacagaggauaugcuggccguguggaacagaguuuggauccaggaaaaucccuggauggaggacaagaccccuguggaaagcugggaggaaguccccuaucucgggaaacgcgaggaccaguggugcggaucucugauuggccuuaccucccgggcuacaugggccaagaacauccagaccgccauuaaucaagugagaagccugaucgggaacgaggaauacacagauuauaugccuuccaugaaacgguuuagacgcgaggaagaggaagcuggaguucucugguga

SEQ ID NO: 19892 - RNA, 9876 nt, Artificial Sequence
  derived and/or modified CDS sequence (opt5) from DENV-2__EU482546__SS-prME
acagccggcgugaucgugaugcugauucccacaguuauggcuuuccaccucacgacccggaauggggagccucauaugaucgugggacggcaggaaaagggcaaaagccugcuuuuuaagacagaggacgggauuaauaugugcacccugauggccaucgaucucggagaacugugugaggacacaauuaccuacaaaugcccgcuucugaagcaaaaugaacccgaggauaucgacuguuggugcaauuccacaucuaccugggugacguauggcaccuguacaaccacaggggagcacagaagagaaaaacggagcgucgcgcucgugccucauguuggaaugggccuggagacccgcacggaaacauggauguccucugagggcgcuuggaagcacgugcagagaaucgagaccuggauucugcggcaucccggguucacaaucauggccgccauucucgcuuacaccaucggaaccacacacuuucagcgcgcccugauuuucauccuucugacggcugucgccccuagcaugaccaugagaugcauuggcaucuccaaccgggauuuuguggaagggguuucuggaggcagcuggguggacaucguccucgagcacggguccugugugacaaccauggcgaagaauaaacccacacuggauuucgaacuuauuaagaccgaggccaaacagccugcuacgcugcgcaaguauugcaucgaagccaaacucacaaacaccaccacagagagcagauguccgacccaaggagagcccucucugaaugaagaacaggacaagcgguuuauuugcaagcauuccaugguggaucgcggcuggggcaacggguguggacuguucggcaaagggggaaucgucacaugcgcuauguuuacgugcaagaaaaauauggaaggcaagguugugcagccugagaaccucgaauacaccauugugaucacaccccacagcggggaggagcaugccgucggaaaugacaccggcaaacacggcaaggaaaucaaaauuacaccucagucuuccaucaccgaggcggaacugacgggguauggaaccgugacaauggaguguagccccagaaccggccuugauuucaacgaaaugguucugcuccaaauggaggacaaggccuggcuggugcaccggcagugguuucuugaucugccgcucccuuggcugcccggggcugacacacagggaucuaauuggauucagaaggagacccuggucacguucaaaaacccucaugccaagaaacaagacgugguugugcucggcucccaggaaggggcuaugcacacagcccugaccggcgccacagagauccagaugagcuccggaaaucuucuguuuaccggccaucucaagugccgccugagaauggauaaacuucaacugaaggggaugucuuacagcauguguaccggaaaguucaaaauugucaaggaaaucgcugagacacagcacggcacgaucgugauucggguccaguaugagggggacggaucccccugcaaaauccccuucgaaauuaccgaucucgagaagagacaugugcugggccgccugaucacaguuaacccuauugugaccgaaaaagacagcccggucaacaucgaggcggaacccccuuuuggggauucuuacauuaucaucggcguggagcccggacagcucaagcugaauugguucaagaaaggcuccagcauugggcaaauguuugagacaaccaugcggggagccaagagaauggcuauccuuggcgacacggccugggauuucgggucucugggaggcguuuuuacaagcauugggaaagcccuccaccagguguucggcgcuaucuacggagccgcguuuuccggcgucucuuggaccaugaagauucugaucggggugaucauuaccuggaucggaaugaacagccgcuccacaagccugucugugucccuuguucucgucggcguggugacccuguaucugggggcuaugguccaggccgacagcggaugugugguuucuuggaaaaauaaggaacucaagugcggcuccgggauuuucaucacagauaacgugcacacguggaccgagcaguacaaauuucaaccugaaagccccuccaagcuggccucugcuauucagaaagcccaugaggaaggcaucuguggaauccggagcgucacaagacuugagaaucugauguggaagcagauuaccccggagcucaaccacauccuguccgaaaaugaggugaaacugacaauuaugaccggcgacaucaaggggauuaugcaggcuggaaaacgcucucuucggccucaacccacggaacucaaguauagcuggaagaccuggggcaaagccaagaugcuguccacagagagccauaaccagaccuuccugaucgaugggccugaaacagcggagugccccaauaccaacagagccuggaacucucucgagguugaagacuacggauuuggcguguucacaaccaacaucuggcugaaacuucgcgagaagcaggacgcuuuuugugauuccaaacugaugagcgccgcuauuaaggacaaucgggccguccacgcggauaugggcuauuggaucgaaucugcccucaacgacacguggaagauggagaaggcuagcuucauugaggucaagagcugccacuggccuaaaucucauacacuguggagcaaugggguucuggaauccgagaugaucauucccaagaacuucgccggaccggugagccagcacaaccauagaccuggcuaccacacccaaaccgcugggcccuggcaucuuggaaaacucgaaauggauuuugacuucugugagggcacaaccgucguggugacggaagauugcgggaaucgcggacccucucugcggacaaccacagccuccggcaagcugaucaccgaguggugcuguagaagcugcacacucccuccgcugcgguaucgcggcgaggacggguguugguacggaauggaaauuagaccccuuaaggagaaagaagagaaccuggucaauucccucguuaccgccggccacgggcagaucgauaacuuuucucugggagugcugggcauggcucuuuuccucgaagagaugcugcggacgagaguggggaccaagcacgcgauccugcucgucgccgugagcuuuguuacacugauuaccggaaauauguccuuccgcgaccuuggccgggugauggucauggugggcgcuacaaugaccgaugacaucgggaugggaguuacguaccuggcccuccuggccgcuuuuaaagugagaccuacauucgccgcgggccugcuucugcgcaagcucaccucuaaagagcugaugauggcuacaauugggaucgcccuccugagccaguccaccauucccgaaaccauccuugagcugacagaugcccucgcucugggaaugaugguccugaagaucgugagaaacauggaaaaguaucaacuugccguuacgauuauggcgaucucuugcgugccuaaugcugucauucugcagaacgccuggaaagugagcuguaccauccucgccgcuguguccgucagcccccugcuccugacaucuucccagcagaaggccgacuggauuccucuugcucugaccaucaaaggccucaaucccacagccaucuuucugaccacgcugagccggacaucuaagaaacgcuccuggccgcuuaacgaggcgauuauggccguugggauggugagcauccuggcuucuucccuccugaagaaugacauuccuaugaccggaccccucguggccggcggccugcuuaccgucugcuacgugcugacagggagaagcgcugaucuggaacucgagcgggccgccgacguuaaaugggaggaucaagcugaaaucuccggaagcucuccuauucugagcaucaccauuuccgaggacggcucuaugagcaucaagaacgaagaggaggaacagacacuuacgauccugauucgcaccgggcuccuggugaucuccggagucuuccccgugucuauuccgaucacagcggccgcuugguaucucugggagguuaagaaacagagagccggcgugcugugggaugucccuucucccccucccguggggaaggccgaacuugaggacggagcuuaccggauuaaacagcgcggcuuucugggcuauucccaaaucggggccggagucuacaaggaaggcaccuuccauacaauguggcacgugaccagaggggcgguucugaugcaucggggaaaacgcaucgagcccuccugggcugaugugaagaaggaccucauuagcuauggcgggggauggaaacuggagggcgaauggaaggagggcgaagagguccaggugcuugcccuggaaccugggaaaaauccgagagccguucagacgaagcccggaaucuuuaaaaccaacacaggcaccauuggggcugugucccucgauuucagcccuggaacaucuggcucccccaucgucgaccggaaggggaagguggugggacuguacggcaauggcguugucaccagaagcggggccuacgugucugcgauugcucagacagagaaauccaucgaggauaacccugaaaucgaggacgauauuuuccgcaagaaacggcucacgaucauggaccugcaccccggagccggcaagaccaaaagauaucuuccugccauugugcgcgaagcuaucaagcgggggcugagaacacugauucucgccccgacccgcgucguggcugccgagauggaagaggcgcugcggggacuucccaucagauaccaaaccccugccauucgcgcugagcauacaggccgggaaaucguugaccugaugugucacgccacguuuaccaugagacuccugagccccgugcgggucccuaacuauaaucucaucauuauggaugaggcucacuucacagaccccgccuccaucgccgcucgcggguacauuucuaccagaguggaaaugggcgaggcggccggaaucuuuaugacagcuaccccgccuggcagccgggaucccuucccccaguccaacgccccuauuauggacgaggaacgcgagauccccgaaagaagcuggaacucugggcaugaguggguuacggauuuuaagggaaaaacagugugguucgucccuuccaucaaggccggcaacgacauugcugccugccugcggaaaaaugggaagaaagugauccagcuuagcagaaagaccuuugauucugaauauguuaagacccgcgcgaacgacugggauuucguggucacaaccgacauuagcgagaugggagcuaauuuuaaagccgagcgggugaucgauccgagacgcuguaugaagcccgugauucugacagacggcgaggaacgggucauccuggccgggccuaugcccguuacccacuccucugcugcccaaagacgcggccggaucggaagaaacccuaaaaaugaaaacgaccaguacauuuauaugggcgagccccucgaaaaugaugaggacugcgcgcauuggaaggaggccaaaaugcugcuugauaacaucaauacgccggaagggauuaucccuagcauguucgagcccgaacgcgagaagguggacgcuauugauggagaauacagacugcggggcgaggcccgcaaaacauuuguggaccucaugagaagaggggaucugccugucuggcuggcuuacaagguggccgcugagggaaucaacuaugccgaccgcaagugguguuucgauggcauuaaaaauaaccagauccucgaagagaacguugaaguggagaucuggaccaaggagggggaacgcaagaaacuuaaaccccgguggcuggacgcgagaauuuacuccgauccucuggcccucaaggaguucaaggaauuugcugccggccgcaaaucucugacacuuaaucugaucaccgagaugggacggcuccccacguucaugacccagaaggcuagaaacgcccuggacaaucuggccguccuccacacagcugaagcgggcgggcgcgccuauaaccacgcucuuagcgagcugccggagacccuggaaacacuccugcuucugacccuccuggccacagugaccggaggcauuuuucuguuccucauguccgggaaaggaaucggcaagaugacgcuuggcaugugcugcauuaucacagccagcauccugcugugguacgcucaaauucagccucauuggaucgccgcgucuauuauccucgaguuuuuccugauuguucuucugauccccgaacccgagaaacagcggaccccucaggauaaucaacucaccuauguggucaucgccauucugacaguggucgcugccaccauggcuaacgaaaugggguuucuggagaagacaaagaaagaccucggacuuggcuccaucacgacccaggagagcgaauccaauauucuggacaucgaucugagaccggccucugcguggacacucuacgccguggcuaccacauucguuacccccaugcugcggcacagcauugagaacuccucugugaaugugagccuuacggccaucgcuaaccaggccaccguccugauggggcucggaaagggcuggccucuguccaaaauggacauugggguuccccugcucgcuaucggauguuauagccaggugaauccuaucacacuuaccgccgcgcugcugcuccugguggcccauuacgcuauuaucggccccggccuucaagccaaggcuacacgcgaagcccagaaaagagccgcggcugggauuaugaagaacccuaccgucgauggaaucacggugauugaccuggagccgauccccuacgauccuaaguuugaaaaacagcucggccagguuaugcugcugauccucugcgugacacaaguccuuaugaugcggaccacaugggcccugugugaggcucugacccucgccaccgggcccauuucuacacugugggagggaaauccuggccgcuucuggaacacgaccaucgccguguccauggcuaauauuuuuagagggagcuaucuugccggagcgggccuccuguucucuaucaugaagaacacaaccaauacacggcgcggcaccgggaacauuggagaaacgcugggcgagaaauggaaguccagacugaacgcccucgggaaaagcgaauuucagaucuacaagaaaucuggaauccaggaggucgaccggacacuugcuaaggagggcauuaagcgcggggaaaccgaucaccaugccgugagcagaggauccgcuaaacugcggugguucguugagagaaauauggugacccccgaaggcaaggucguggaccugggcugcgggcgcggaggcuggucuuauuacugugggggacucaaaaacguucgggaggugaagggccugacaaaagggggaccgggccacgaggaaccuauccccaugagcaccuauggcuggaaucuugucagacugcaauccgggguggauguguucuuuacacccccugagaagugcgacacgcuccugugugauauuggagaaagcucccccaacccuaccaucgaggccggccgcacacugcggguucucaaucuugucgaaaacuggcugaauaacaauacccaguucugcauuaaggugcugaacccguacaugcccucugugaucgagaaaauggaaacacuccagagaaaguaugggggagcgcugguccgcaauccucuuagccggaacuccacccacgagauguacuggguuucuaaugccacgggcaacaucgugagcuccgugaauaugauuucuagaaugcugaucaaccgcuuuaccaugaaacauaagaaagcuacauacgagcccgacgucgaucucgggagcggaacccggaacauuggcaucgaauccgagauuccuaaucuggacaucauuggcaagagaaucgaaaagaucaaacaggagcacgaaacaagcuggcauuaugaccaagaucaccccuacaagaccugggccuaucacgggucuuacgagacaaaacagaccggauccgcuagcucuauggugaacggcguugugcgccugcucacgaagccgugggacgucgugccuaugguuacacagauggccaugaccgauaccacacccuucgggcagcaacggguguuuaaagagaaggucgacacgagaacccaggaaccuaaggagggaaccaagaaacuuaugaaaauuaccgcugaauggcuguggaaagagcugggcaaaaagaaaacaccccgcguguguaccagagaggaguucacacggaaggugcgcuccaaugccgcgcucggggccaucuuuaccgaugagaacaaguggaaaagcgcuagagaagccgucgaggacggacgguucugggaacugguugauagagagcggaaucuucaucuggagggcaagugcgaaacguguguguauaacaugaugggcaaacgcgagaagaaacucggggaauuuggaaaggcuaagggcucuagagccauuugguacauguggcugggggcccgguuccuggaguuugaagcgcucggauuccugaaugaggaccacugguuuucccgcggcaacagccuuuccgggguggagggcgaaggacugcauagacucggcuauauccugcgggaugucgggaaaaaggagggaggcgcuauguacgccgacgauaccgccgggugggacacacgcauuacccuugaagaccugaaaaaugaggaaauggugacaaaccacaugaagggagagcauaaaaagcucgcugaggccaucuucaagcugaccuaccagaauaaaguugugagaguccagcggccuacgccccgcggcacagugauggauaucauuagcagacgggaccaacgcgggucuggccagguuggaaccuauggccugaacacauucaccaauauggaagcucagcucaucagacaaauggagggggaaggaauuuuuaagagcauccagcaccugacggccaccgaggagauugcggugcagaacuggcuugcccgggucggccgcgaaagacugucccggauggcuaucucuggggaugacugcgugguuaaaccgaucgaugacagauucgccagcgcucucacagcccugaaugauaugggaaaggugcgcaaagacauucagcaaugggagccuucccggggcuggaacgauuggacccagguccccuuuugcucucaccauuuccacgaacuugugaugaaggacgggagaguccuggugguucccugucgcaaccaggaugagcucaucggccgggcgagaauuagccagggagccggcuggucccugaaggaaacagcuugccuggggaaaucuuacgcccaaauguggacccucauguauuuucaucgccgggaccugagacuugcugccaaugcuaucuguagcgccgugccuucccacugggucccgacaagccgcaccacguggucuauucacgcgaagcaugaguggaugacaaccgaggauaugcuggccguguggaaccggguguggauccaggaaaaucccuggauggaggacaaaaccccuguugaauccugggaggaagugcccuaccucggaaagagagaggaccaguggugcggcagccugauugggcuuacaucucgcgcuaccugggccaaaaacauccagacagccaucucccaaguccggagccugauuggaaaugaggaauauacggauuacaugccuuccaugaagagauuccggagagaggaagaggaagcuggcgugcucugguga

SEQ ID NO: 19893 - RNA, 9876 nt, Artificial Sequence
  derived and/or modified CDS sequence (opt5) from DENV-2__EU482550__SS-prME
accgccggcgugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgcuacguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaucaaguuuucggcgccaucuauggagcggcuuuuuccggcgugucuuggacaaugaaaauucugaucggggucaucauuaccuggaucggaaugaacagccgguccaccagccuuucugugucccucgugcugguuggcgucgugacacuguaccucggggugaugguccaggccgacagcggaugugugguuucuuggaagaauaaagaacugaagugcggcuccgggauuuucaucaccgauaacgugcacacauggacggagcaguauaaguuucagccugaaagccccuccaaacuugccucugcuauucaaaaggcccacgaggaaggcaucuguggaaucagaagcgucacccgccuggagaaucucauguggaaacagauuacaccggagcugaaccauauccuguccgaaaaugaggugaaacuuaccauuaugacaggcgacaucaaagggauuaugcaggcuggaaagcggucucucagaccucagcccaccgaacugaaauacagcuggaagacguggggcaaggccaaaaugcuguccaccgagagccacaaccaaacauuccucaucgaugggccugaaaccgcggagugccccaauacaaaccgcgccuggaacucucuggagguugaagacuauggauuuggcguguucuccaccaacaucuggcuuaagcugcgggagaaacaggacgucuuuugugauagcaagcucaugucugcugccauuaaagacaauagagcugugcaugccgauaugggcuacuggaucgaauccgcgcugaacgacacauggaagauggagaaggccagcuucauugagguuaaaucuugccacuggccuaagagccacacccugugguccaauggggugcuugaaagcgagaugaucauucccaaaaacuucgcuggaccggucucucagcauaacuaucgcccuggcuaccacacgcagacagccgggcccuggcaucucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguauggaauggaaauucggccccugaaggagaaggaagagaaccucguuaauucucuggugaccgccggccacgggcaaaucgauaacuuuagccugggagugcuuggcauggcccucuuccuggaagagaugcugagaacacgcgucgggaccaaacaugcuauccuccugguggcgguuuccuuugugacgcuuauuaccggaaauaugucuuuccgggaccugggcagagucauggugaugguuggcgccacaaugaccgaugacaucgggaugggagugacauaccucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaucagcuggcugugaccauuauggccauccucugcgucccuaaugcggugauucugcaaaacgcuuggaaggugagcuguacaauccucgccgccgucuccguuagcccccugcuucugacgucuucccagcagaaagcugacuggauuccucucgcccugaccaucaagggccugaaucccacagcuaucuuucuuaccacacugagccgcaccucuaaaaagagauccuggccgcucaacgaggccgugauggcgguggggauggucagcauucuggccucuucccuccugaaaaaugacaucccuaugacgggaccccuuguggcuggcggccugcugacaguuugcuacgugcucaccgggcggagcgccgaucuggaacuugagcgcgcugccgacgucaagugggaggaucaggccgaaauuuccggaagcucuccuauccugagcauuaccaucuccgaggacggcucuaugagcauuaaaaacgaagaggaggaacaaacacucaccauccugaucagaacagggcuccuggugauuuccggaguuuuccccgugucuaucccgauuacggcugcggccugguaucuuugggaggucaagaagcagcgggcuggcgugcugugggaugucccuucucccccucccguggggaaagccgaacuggaggacggagccuaccgcaucaagcagagaggcauuuuuggcuauucccagaucggggcuggaguuuacaaagaaggcaccuuccacacaauguggcacgugaccagaggggccguccucaugcaucgcggaaagagaaucgagcccuccugggcggaugugaaaaaggaccugauuagcuacggcgggggauggaaacuugagggcgaauggaaagagggcgaagagguucaagugcuggcucucgaaccugggaagaauccgcgggccguccagacaaaacccggacuguuuaagaccaacacgggcaccaucggggccgugucccucgauuucagcccuggaacaucuggcucccccauuguggacagaaaagggaagguugucggacuguauggcaauggcguggugacccgcagcggggcuuacgucucugccaucgcgcagacagagaaguccauugaggauaacccugaaaucgaggacgauaucuuccggaaaaagagacuuaccauuauggaccugcaccccggagcuggcaaaacaaagcgcuaucugccugccaucgugcgggaagccauuaaaagagggcuccgcacgcugauccuugcuccgacccggguuguggccgcugagauggaagaggcccugagaggacuccccauucgcuaccagaccccugcgauccgggccgagcauaccggcagagaaauugucgaccugaugugucacgcuaccuuuacaaugcggcuccugagccccgugcgcguuccuaacuauaaucuuaucaucauggaugaggcccauuucacggaccccgcuuccauugccgccagaggguacaucucuacccggguggaaaugggcgaggcugcgggaauuuuuaugacagccaccccgccuggcagccgcgaucccuucccccaauccaacgcuccuaucauggacgaggaaagagagauucccgaacggagcuggaacucugggcacgagugggucacagauuuuaagggaaagaccgugugguucguuccuuccaucaaagccggcaacgacaucgccgcuugccugagaaagaaugggaaaaaggugauucagcugagccgcaaaacguuugauucugaauaugucaagacacgggccaacgacugggauuucguggugaccaccgacaucagcgagaugggagcgaauuuuagagcugagcgcgucauugauccgcggagauguaugaagcccguuauccucacagacggcgaggaacgcgugauucuggccgggccuaugcccgugacccacuccucugccgcucagcggagaggccgcaucggaagaaacccuaaaaaugaaaacgaccaauacaucuacaugggcgagccccuugaaaaugaugaggacugcgcccauuggaaggaggcgaaaaugcugcucgauaacauuaauacaccggaagggaucauuccuagcauguucgagcccgaacgggagaaggucgacgccaucgauggagaauaucgccugagaggcgaggcucggaaaaccuuuguggaccugaugcgcagaggggaucucccuguuuggcuugccuaccggguggcugccgagggaauuaacuaugcugacagacgcugguguuucgauggcaucaagaauaaccagauucuggaagagaacgucgaaguggagaucuggacgaaagagggggaacggaagaagcugaaacccagauggcucgacgcccgcaucuacuccgauccucuggcgcuuaaggaguucaaagaauuugccgcuggccggaagucucugacacucaaucugauuaccgagaugggaagacugcccacauucaugacccagaaagcccgggacgcucucgauaaccuugccguucugcacacggccgaagugggcgggcgcgcuuauaaucaugcgcugagcgagcucccggagacccuggaaacacuucugcuccugacccugcucgccacagucaccggaggcaucuuucuuuuccugauguccgggaagggaauuggcaagaugacacugggcaugugcugcaucauuaccgcuagcauccuccugugguacgcccagauccaaccucacuggauugccgcuucuaucauucuugaguuuuuccugaucgugcuccugauucccgaacccgagaaacagagaacgccucaggacaaccagcugacauaugucgugaucgccauccucaccguuguggcggccaccauggcuaaugaaaugggguuucuugagaagaccaagaaggaccugggacugggcuccauuaucacccaagagagcgaauccaacauucucgauaucgaccugcggccggccucugcuuggacacuuuacgccguggcgacgaccuucgucacacccaugcugcgccacagcauugaaaauagcucuguuaacgugagccucaccgccaucgcuaaucaggccacagugcugauggggcugggaagaggcuggccucucuccaaaauggauauuggggucccccuucuggcuaucggauguuacagccaggugaacccuaucacccugacggccgcucuccugcuucugguugcccauuaugcgauuaucggccccggccuccaggccaaggcuacccgggaagcccaaaagcgcgcugccgccgggauuaugaaaaauccuacaguggacggaaucaccgucauugaucuggagccgauccccuacgacccuaaguuugaaaaacagcugggccaggugaugcuccuuguccugugcgugacacagguucugaugaugagaaccacgugggcgcucugugaggcucugacacuugccaccgggcccaucucuacacugugggagggaaacccuggccgguucuggaauaccaccauugcuguguccauggccaacaucuuucgcgggagcuaucucgccggagcuggccugcuguucucuauuaugaagaauacaacgaacaccagacggggcacagggaauaucggagaaacccucggcgagaaauggaaguccagacuuaacgcccugggaaagagcgaauuucaaauuuacaaaaagucuggaauccaggaggucgaucgcacacuggcgaaagagggcaucaagagaggggaaaccgaccaccaugccgugagcagaggauccgcuaaacuccgcugguucguugagcggaacauggugacgcccgaaggcaaggucguggaucugggcugcgggagaggaggcuggucuuauuacugugggggacuuaaaaaugugcgcgagguuaagggccugacaaaagggggaccgggccacgaggagccuauucccaugagcaccuauggcuggaaccucguccggcugcaguccgggguggacguguucuuuacacccccugagaaaugcgauacacugcucugugacaucggagaaagcucccccaauccuaccauugaggccggcagaacacuucgcguccugaaccugguugaaaauuggcucaacaauaacacgcaauucugcaucaaggugcugaauccguacaugcccucugugauugagaaaauggaaacccuucagcggaaguacgggggagcucuggucagaaacccucucagccgcaauuccacacaugagauguauugggugucuaacgccaccggcaauaucguuagcuccgugaacaugaucucucggaugcugauuaauagauuuacaaugaaacacaagaaggcgaccuacgagcccgaugucgaccuggggagcggaacgcgcaacaucggcauugaaaacgagaucccuaaucucgacauuaucggcaaaagaauugaaaagaucaaacaggagcacgaaaccuccuggcauuaugaucaggaccaccccuacaagacaugggccuaucaugggagcuacgagaccaaacaaacaggaucugcuuccagcauggugaacggcguugugaaacuucugaccaagccgugggaugucgugccuauggugacacagauggccaugaccgacacgacacccuucgggcagcagcgggucuuuaaagagaagguugauacccgcacccaagaaccuaaagagggaacaaagaaacugaugagaaucacggcugaauggcucuggaaggagcugggcaagaaaaagacaccccggauguguacaagagaggaguucacccggaaagugcgcucuaaugccgcucuuggggccauuuuuacagacgagaacaaguggaaauccgcgagagaagccguggaggauagccgguucugggaacuggucgaccgcgagagaaaucuccaccuggagggaaagugcgaaaccuguguguauaacaugaugggcaaacgggagaagaagcugggcgaauuugggaaagcuaagggaucucgcgccaucugguacauguggcucggcgcuagauuccuggaguuugaagcccuuggguuccugaaugaggaucacugguuuucccggggaaacagccucuccggcguugagggggaaggccugcauaaacuuggauacauucugcgcgacgugagcaagaaagagggcggggccauguaugcggaugacacagcuggaugggacaccagaaucacgcucgaagaucugaagaaugaggaaauggucaccaaccacaugaagggcgagcauaaaaagcuggccgaggccauuuucaaacucacauaccagaauaaggugguucgggugcagcgcccuacccccagagggacagucauggacaucaucucucggaaagaucagcgcggaagcggccaaguggggaccuauggccugaacacguucacaaauauggaagcucagcuuauuagacagauggagggagaaggcaucuuuaaguccauucaacaccugaccguuacagaggagaucgccgugcagaacuggcucgcucgggucgggagagaacgccugucucggauggccauuagcggagacgauugcguggucaagccgcuugacgauagauucgcguccgcccugaccgcucucaaugacaugggcaaagugcgcaaggauauccagcagugggagccuucucggggguggaacgacuggacgcaaguucccuuuugcagccaucacuuccacgaacuggugaugaaagauggaagaguccugguggugcccugucgcucccaggacgagcucaucggccgggccagaauuucucagggggcuggcuggagccugaaggaaaccgccugccuuggaaaauccuacgcgcagauguggacacugauguauuuucaucgccgggaucucagacuggccgcuaacgccaucuguagcgcuguuccuucucacugggugccgaccucccgcacaaccuggagcauucaugccaagcacgaguggaugacaaccgaggacaugcuugcugucuggaaucggguguggauccaagaaaaccccuggauggaggacaagacgcugguugaaucuugggaggaagugccuuaccucggcaaaagagaggaucaguggugcgggucccugauuggacugacaagccgggccaccugggcgaagaauauccagaccgccauuaaccaggucagaucccucaucggcaaugaggaauauacagacuacaugcccucuaugaaacgcuuccggaaggaggaagaggaagcuggggugcugugguga

SEQ ID NO: 19894 - RNA, 9876 nt, Artificial Sequence
  derived and/or modified CDS sequence (opt5) from DENV-2__EU482551__SS-prME
accgcuggcgugaucauuaugcugauccccaccgcuauggccuuccaccucacgaccagaaauggggagccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaccauggccgcuauccucgccuacaccauuggaacaacgcacuuucagagagugcugaucuucauucuucugaccgcugucgccccuagcaugacaaugcggugcaucggcauuuccaaccgcgauuuuguggaagggguuucuggaggcagcuggguggacaucguccucgagcacggguccugugugaccacaauggcgaagaauaagcccacccuggauuucgaacuuaucaaaacggaggccaagcagccugcuacacugagaaaauauugcauugaagccaagcucaccaacaccacaaccgagagccgguguccgacacaaggagagcccucucugaaugaagaacaggacaaacgcuuuaucugcaagcauuccaugguggauagaggcuggggcaacggguguggacuguucggcaaagggggaauugucacgugcgcuauguuuaccugcaaaaagaauauggaaggcaaaguugugcucccugagaaccuggaauacacaaucgugauuacaccccacagcggggaggagcaugccgucggaaaugacacaggcaagcacggcaaagaaaucaagaucaccccucagucuuccauuacggaggcggaacuuaccggguauggaacagugaccauggaguguagcccccggacaggccuggauuucaacgaaaugguucuccugcagauggaggacaaagccuggcuugugcaccgccaaugguuucuggaucucccgcugccuuggcugcccggggcugacacccagggaucuaauuggauccagaaggagacgcucgucacauucaagaacccucaugccaaaaagcaggacgugguugugcugggcucccaagaaggggcuaugcacaccgcccuuacaggcgccaccgagauucagaugagcuccggaaaucugcucuuuaccggccaucugaaaugcagacuucggauggauaagcugcagcucaaagggaugucuuacagcauguguacaggaaaguucaagaucgucaaagaaauugcugagacgcaacacggcaccaucgugaucagaguccaguaugagggggacggaucccccugcaagauucccuucgaaaucauggaucuggagaaacgccaugugcugggccggcucauuacaguuaacccuaucgugaccgaaaaggacagcccggucaacauugaggcggaacccccuuuuggggauucuuacaucauuaucggcguggagcccggacagcugaaacuuaauugguucaagaagggcuccagcaucgggcagauguuugagacaaccaugagaggagccaaacgcauggcuauucugggcgacacggccugggauuucgggucucucggaggcguuuuuacaagcaucgggaaggcccugcaccaaguguucggcgcuauuuacggagccgcguuuuccggcgucucuuggaccaugaaaauccugauuggggugaucaucaccuggauuggaaugaacagccgguccacaagccuuucugugucccucguucuggucggcaucgugacccuguaucucggggugaugguccaggcugacacaggaugugugguuagcuggaagaauaaagaacugaagugcggcucugggauuuucaucacggauaacgugcacaccuggacagagcaguacaaguuucagccugaaucccccagcaaacuugccuccgccauucaaaaggcucaugaggaaggcaucuguggaaucagaucugucacccgccuggagaaucucauguggaaacagauuacaccggagcugaaccacauccugagcgaaaaugaggugaaacuuaccauuaugacgggcgacaucaaagggauuaugcaggccggaaagcggucccucagaccucagcccaccgaacugaaauauucuuggaagacauggggcaaggcuaaaaugcugagcaccgagucccauaaccaaacauuccucaucgaugggccugaaaccgccgagugccccaauacaaaccgcgcguggaauagccuggagguugaagacuacggauuuggcguguucucuaccaacaucuggcuuaagcugcgggagaaacaggacgucuuuugugauuccaagcucaugagcgccgcuauuaaagacaauagagccgugcacgcugauaugggcuauuggaucgaaucugcccugaacgacacguggaagauggagaaggcguccuucauugagaucaaaagcugccacuggccuaagucucauacacuguggagcaaugggguucuugaauccgagaugauuauccccaaaaacuucgccggaccggugagccagcacaacuaccgcccuggcuaucauacccagaccgcugggcccuggcaccucggaaagcuggaaauggauuuugacuucugugagggcacaaccgucguggugacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucgucaauucccugguuaccgcuggccaugggcaaaucgauaacuuuucucugggagugcuuggcauggcccucuuccuggaagagaugcugagaacgcgcguggggaccaaacacgccauucuccuggucgcugugagcuuuguuacacuuaucaccggaaauauguccuuccgggaccugggcagagugauggucauggugggcgcgacaaugaccgaugacauugggaugggaguuacguaucucgcccugcuggcugccuuuaaggugcgcccuacauucgccgcuggccuucugcucagaaaacugaccucuaaggagcucaugauggccacaaucgggauugcgcugcuuagccaguccaccauccccgaaaccauccuggagcucacagaugcucuggcccugggaaugaugguccuuaaaauugugcggaacauggaaaaguaccagcuggccguuacgaucauggcuauuucuugcgugccuaaugccgucauccuccaaaacgcguggaaggugagcuguaccauucuggcugccguguccgucagcccccuccugcuuacaucuucccagcagaaagccgacuggaucccucuggcucucaccaucaagggccugaaucccacagccauuuuucugaccacgcuuagccgcacaucuaaaaagagauccuggccgcugaacgaggcuguuauggccguggggauggugagcauccucgcgucuucccugcucaaaaaugacauuccuaugaccggaccccuggucgccggcggccuucugaccgugugcuauguucugacagggcggagcgcugaucucgaacuggagaaggccgcugacgugaaaugggaggaucaggccgaaaucuccggaagcucuccuauucuuagcaucaccauuuccgaggacggcucuaugagcaucaagaacgaagaggaggaacacacacugacgauccucauucgcaccgggcugcucgucaucuccggaguguuccccguuucuauuccgaucacagccgcugcgugguaccugugggaggugaagaaacaaagagccggcguccuuugggaugugccuucucccccucccgucgggaaggcugaacuggaggacggagccuaucggauuaaacagcgcggcaucuuuggcuacucccagaucggggccggaguguauaaggaaggcaccuuccauacaauguggcacguuaccagaggggcugugcugaugcaucggggaaaacgcauugagcccuccugggccgaugucaagaaggaccucaucagcuacggcgggggauggaaacuggagggcgaauggaaggagggcgaagaggugcagguucuugcgcuggaaccugggaaaaauccgagagcugugcaaacgaagcccggacucuuuaaaaccaacacaggcaccauuggggccgucucccuggauuucagcccuggaacaucuggcucccccaucguggaccggaaggggaaggugguuggacucuacggcaauggcgucgugaccagaagcggggccuaugugucugcuauugcccagacagagaaauccaucgaggauaacccugaaaucgaggacgauauuuuccgcaagaaacggcugacgaucauggaccuucaccccggagcgggcaagaccaaaagauaccugccugcuauuguccgcgaagccaucaagcgggggcugagaacacucauucuggccccgacccgcgugguugcugccgagauggaagaggcccuucggggacugcccaucagauaucagaccccugccauucgcgcggagcauacaggccgggaaaucguggaccucaugugucacgccacguuuaccaugagacugcucagccccguccgggugccuaacuacaaucugaucauuauggaugaggcucacuucacagaccccgccuccaucgcugcccgcggguauauuucuaccagaguugaaaugggcgaggccgcuggaaucuuuaugacagcgaccccgccuggcagccgggaucccuucccccaguccaacgccccuauuauggacgaggaacgcgagauccccgaaagaagcuggaacucugggcaugagugggugacggauuuuaagggaaaaacagucugguucgugccuuccaucaaggcuggcaacgacauugccgccugccuucggaaaaaugggaagaaaguuauccaacugagcagaaagaccuuugauucugaauacgugaagacccgcgcuaacgacugggauuucgucgugacaaccgacauuagcgagaugggagccaauuuucgggcggagagagugaucgauccgcgccgguguaugaaacccgucauucugacagacggcgaagagagaguuauccucgcugggccuaugcccgugacccacuccucugccgcccagcgccggggcagaaucggacgcaacccuaagaaugaaaacgaccaguauauuuacaugggcgagccccuggaaaaugaugaggacugcgcucauuggaaagaggccaagaugcuucuggauaacaucaauacgccggaagggauuaucccuagcauguucgagcccgaaagagagaaaguggacgcgauugauggagaauaccggcuccgcggcgaggccagaaagacauuugucgaccugaugcggcgcggggaucugccuguguggcucgcuuauagaguugccgcugagggaaucaacuacgccgaccggagaugguguuucgauggcauuaaaaauaaccaaauccuugaagagaacguggaagucgagaucuggaccaaggagggggaacgcaagaaacugaagccccgguggcuggacgcuagaauuuauuccgauccucucgcccugaaagaguucaaggaauuugcggccggccgcaaaucucuuacacugaaucucaucaccgagaugggacggcugcccacguucaugacccagaaggcuagagacgcccuggauaaccucgcugugcuucacacagccgaaguuggcgggcgggccuacaaucacgcucugagcgagcugccggagacccucgaaacacugcuucugcucacccugcuggcgacagugaccggaggcauuuuucucuuccuuauguccgggaagggaaucggcaaaaugacgcugggcaugugcugcauuaucacagccagcauccugcucugguaugcucagauucagccucauuggaucgccgccucuauuauccuggaguuuuuccuuauuguccugcucauccccgaacccgagaagcaacgcaccccucaggacaaccagcugaccuacguggucaucgcuauucugacagugguugccgcgaccauggccaaugaaaugggguuucucgagaaaacaaagaaagaccuuggacugggcuccaucacgacccaggagagcgaauccaacauucuggauaucgaccucagaccggcuucugccuggacacuguaugcuguggccaccacauucgugacccccaugcuucggcacagcauugaaaauagcucugucaacguuagccugacggcgaucgccaaucaagcuaccgugcucauggggcugggacgcggcuggccucuguccaagauggauauuggggugccccuccuugccaucggauguuacagccaggucaacccuaucacacugaccgcugcccugcuccugcuuguggcucauuacgccauuaucggccccggccugcaggcgaaggccacaagagaagcucagaaacggaccgccgcugggauuaugaagaauccuacgguugacggaaucacagugauugaucucgagccgauccccuaugacccuaaauuugaaaagcaacugggccaggucaugcugcucgugcuuugcgucacccaggugcugaugaugcgcacaaccugggcccugugugaggcccucacccuggcgacagggcccaucucuacgcuuugggagggaaacccuggcagauucuggaauaccacaauugcuguuuccauggccaacaucuuucgggggagcuaccuggcuggagccggccuccuguucucuauuaugaaaaauaccacaaacacccgcagaggcacggggaauaucggagaaacacugggcgagaaguggaagucccggcucaacgcccuugggaaaagcgaauuucagauuuauaagaaaucuggaauccaagagguggauagaacccuggcuaaggagggcaucaaacgcggggaaaccgaccaccaugccgucagccggggauccgcgaagcugagaugguucguggagcgcaacaugguuacacccgaaggcaaaguggucgaucucggcugcgggcggggaggcuggucuuacuauugugggggacugaagaaugugagagaggugaagggccuuaccaaagggggaccgggccacgaggaaccuauucccaugagcacauacggcuggaaccugguucgccuccaguccggggucgacguguucuuuacgcccccugagaagugcgauacccugcugugugacaucggagaaagcucccccaauccuacaauugaggccggccggacccucagagugcuuaaccuggucgaaaauuggcugaacaauaacacacaguucugcguuaaagugcucaauccguauaugcccucugugaucgagaagauggaaacccugcaacgcaaauacgggggagcucuuguccggaacccucugagcagaaauuccacgcacgagauguacugggugucuaacgccaccggcaauauuguuagcuccgugaacaugaucucucgcaugcucaucaaucgguuuacaaugaagcauaagaaagcuaccuaugagcccgaugucgaccuggggagcggaacaagaaacauuggcaucgaaaacgagauuccuaaucuggacaucauuggcaagcgcaucgagaagauuaagcaggagcacgaaaccuccuggcauuacgaucaggaccaccccuauaaaacaugggccuaccacgggagcuaugagaccaagcagacgggaucugcguccagcauggugaacggcguugugaagcuccuuacaaaaccgugggaugucgugccuauggugacccaaauggccaugaccgacacaacgcccuucgggcagcagagagucuuuaaggagaaaguugauacccggacacaggaaccuaaggagggaaccaaaaagcugaugcgcaucacagcugaauggcuguggaaggagcucggcaaaaagaaaacccccagaauguguacacgggaggaguucaccagaaaggugcggucuaaugccgcucugggggccaucuuuacggacgagaacaaauggaaguccgcucgcgaagccguggaggauagcagauucugggaacuugucgaccgggagcgcaaucugcaucucgagggaaaaugcgaaaccuguguguacaacaugaugggcaagagagagaagaaacugggcgaauuugggaaggcgaaaggaucucgggccauuugguauauguggcugggcgcucgcuuccucgaguuugaagcccugggguuccuuaaugaggaucacugguuuuccagaggaaacagccuguccggcguugagggggaaggccuccauaagcugggauacauccuucgggacgugagcaaaaaggagggcggggcuauguacgccgaugacacagccggaugggacacccgcauuacacuggaagaucucaagaaugaggaaauggucaccaaccacaugaaaggcgagcauaagaaacuggcggaggcuaucuucaagcugacguaucaaaauaaagugguuagagugcagcggccuacaccccgcgggaccgucauggacauuaucucuagaaaggaucagcggggaagcggccagguggggacauacggccucaacaccuucacgaauauggaagcccaacugauccgccagauggagggagaaggcauuuuuaaguccauccagagacuuaccguuacagaggagauugccgugcaaaacuggcuggcucgggucgggagagaacgccucucucggauggccaucagcggagacgauugcguggucaaaccgcuggacgauagauucgcuuccgcccuuaccgcgcugaaugacaugggcaaggugcgcaaagauauucagcagugggagccuucucggggguggaacgacuggacacagguucccuuuugcagccaccacuuccaugaacucgugaugaaggauggaagaaugcuggucgugcccugucgcaaccaagacgagcugaucggccgggccagaaucucccagggggcuggcuggucucucaaagaaaccgccugccugggaaagagcuaugcucagauguggacacuuauguacuuucaccgccgggaucugagacucgccgcgaaugccauuuguuccgcugugccuagccauuggguuccgaccucucgcacgacaugguccauccacgccaagcacgaguggaugaccaccgaggacaugcuggcuguguggaaccgggucuggauucaggaaaaucccuggauggaggacaaaacaccuguggaaagcugggaggaaguucccuaucuuggcaagagagaggaucaauggugcgggucucugaucggacucaccucccgggccacaugggcuaaaaacauucagacggccaucaaucaggugagaagccugauuggcaacgaggaauacaccgacuauaugccuuccaugaagcgcuuccggaaagaggaagaggaagcggggguccugugguga

SEQ ID NO: 19895 - RNA, 9876 nt, Artificial Sequence
  derived and/or modified CDS sequence (opt5) from DENV-2__EU482552__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcacagggaaggcucugcaccaaguuuucggcgccauuuacggagcggcuuuuuccggcgugucuuggaccaugaaaauccugauuggggucaucaucaccuggauuggaaugaacagccgguccacaagccuuucugugucccucgugcugguuggcgucgugacccuguaucucggggugaugguccaggccgacacaggaugugugguuagcuggaagaauaaagaacugaagugcggcucugggaucuucauuacggauaacgugcacaccuggacagagcaguacaaguuucagccugaaucccccagcaaacuugccuccgcuauccaaaaggcccaugaggaaggcauuuguggaaucagaucugucacccgccuggagaaucucauguggaaacagaucacaccggagcugaaccacauucugagcgaaaaugaggugaaacuuaccaucaugacgggcgacauuaaagggaucaugcaggcuggaaagcggucccucagaccucagcccaccgaacugaaauauucuuggaagacauggggcaaggccaaaaugcugagcaccgagucccauaaccaaacauuccucauugaugggccugaaaccgcggagugccccaauacaaaccgcgccuggaauagccuggagguugaagacuacggauuuggcguguucucuaccaacaucuggcuuaagcugcgggagaaacaggacgucuuuugugauuccaagcucaugagcgcugccaucaaagacaauagagcugugcacgccgauaugggcuauuggauugaaucugcgcugaacgacacguggaagauggagaaggccuccuucaucgagauuaaaagcugccacuggccuaagucucauacacuguggagcaaugggguucuugaauccgagaugaucauucccaaaaacuucgcuggaccggugagccagcacaacuaccgcccuggcuaucauacccagaccgccgggcccuggcaccucggaaagcuggaaauggauuuugacuucugugagggcacaaccgucguggugacggaagauugcgggaaucggggacccucucugagaacaaccacagcuuccggcaaacucaucaccgaguggugcugucggagcugcacacugccuccgcuucgcuacagaggcgaggacggguguugguacggaauggaaauucggccccugaaggagaaggaagagaaccucgucaauucccugguuaccgccggcuaugggcaaaucgauaacuuuucucugggagugcuuggcauggcccucuuccuggaagagaugcugagaacgcgcguggggaccaaacaugcuauccuccuggucgcggugagcuuuguuacacuuauuaccggaaauauguccuuccgggaccugggcagagugauggucauggugggcgccacaaugaccgaugacaucgggaugggaguuacguaccucgcucugcuggccgccuuuaaggugcgcccuacauucgcugccggccuucugcucagaaaacugaccucuaaggagcucaugauggcgacaauugggaucgcucugcuuagccaguccaccauucccgaaaccauccuggagcucacagaugcccuggcccugggaaugaugguccuuaaaaucgugcggaacauggaaaaguaucagcuggcuguuacgauuauggccaucucuugcgugccuaaugcggucauucuccaaaacgcuuggaaggugagcuguaccauccuggccgccguguccgucagcccccuccugcuuacaucuucccagcagaaagcugacuggauuccucuggcccucaccaucaagggccugaaucccacagcuaucuuucugaccacgcuuagccgcacaucuaaaaagagauccuggccgcugaacgaggccauuauggcgguugggauggugagcauccucgccucuucccugcucaaaaaugacauuccuaugaccggaccccugguggcuggcggccuucugaccgucugcuacgugcugacagggcggagcgccgaucucgaacuggagcgcgcugccgacguuaagugggaggaucaggccgaaaucuccggaagcucuccuauucuuagcaucaccauuuccgaggacggcucuaugagcaucaaaaacgaagaggaggaacacacacugacgauccucauuagaaccgggcugcucgugaucuccggagucuuccccgugucuauuccgaucacagcugcggccugguaucugugggagguuaagaagcaacgggcuggcgugcuuugggaugucccuucucccccucccguggggaaagccgaacuggaggacggagccuaccgcauuaagcagagaggcaucuuuggcuauucccagaucggggcuggagucuacaaagaaggcaccuuccacacaauguggcaugugaccagaggggccguucugaugcaccgcggaaagagaauugagcccuccugggcggaugugaaaaaggaccucaucagcuacggcgggggauggaagcuggagggcgaauggaaagagggcgaagagguccaggugcuugcucuggaaccugggaagaauccgcgggccguucaaacgaaacccggacucuuuaagaccaacacaggcaccauuggggccgugucccuggauuucagcccuggaacaucuggcucccccaucgucgacagaaaagggaagguggugggacucuauggcaauggcguugucacccgcagcggggcuuacgugucugccauugcgcagacagagaaguccaucgaggauaacccugaaaucgaggacgauauuuuccggaaaaagagacugacgaucauggaccuucaucccggagcuggcaaaaccaagcgcuaucugccugccauugugcgggaagccaucaaaagagggcugcgcacacucauucuggcuccgacccgggucguggccgcugagauggaagaggcccuuagaggacugcccauccgcuaccagaccccugcgauucgggccgagcacacaggcagagaaaucguugaccucaugugucaugcuacguuuaccaugcggcugcucagccccgugcgcgucccuaacuauaaucugaucauuauggaugaggcccacuucacagaccccgcuuccaucgccgccagaggguacauuucuacccggguggaaaugggcgaggcugcgggaaucuuuaugacagccaccccgccuggcagccgcgaucccuucccccaguccaacgcuccuauuauggacgaggaaagagagauccccgaacggagcuggaacucugggcacgaguggguuacggauuuuaagggaaagacagugugguucgucccuuccaucaaagccggcaacgacauugccgcuugccuuagaaagaaugggaaaaaggugauccaacugagccgcaaaaccuuugauucugaauauguuaagacccgggccaacgacugggauuucguggucacaaccgacauuagcgagaugggagcgaauuuuagagcugagcgcgugaucgauccgcggagauguaugaagcccgugauucugacagacggcgaggaacgcgucauccucgccgggccuaugcccguuacccauuccucugccgcucagcggagaggccgcaucggaagaaacccuaaaaaugaaaacgaccaguacauuuacaugggcgagccccuggaaaaugaugaggacugcgcccacuggaaggaggcgaaaaugcuucuggauaacaucaauacgccggaagggauuaucccuagcauguucgagcccgaacgggagaagguggacgccauugauggagaauaucgccucagaggcgaggcucggaaaacauuuguggaccugaugcgcagaggggaucugccugucuggcucgccuaccggguggcugccgagggaaucaacuaugcugacagacgcugguguuucgauggcauuaagaauaaccaaauccuugaagagaacguugaaguggagaucuggaccaaagagggggaacggaagaagcugaaacccagauggcuggacgcccgcauuuacuccgauccucucgcgcugaaggaguucaaagaauuugccgcuggccggaagucucuuacacugaaucucaucaccgagaugggaagacugcccacguucaugacccagaaagcccgggacgcucuggauaaccucgccguccuucauacagccgaagugggcgggcgcgcuuauaaucacgcgcugagcgagcugccggagacccucgaaacacugcuucugcucacccugcuggccacaguuaccggaggcauuuuucucuuccuuauguccgggaagggaaucggcaagaugacgcugggcaugugcugcauuaucacagcuagcauccugcucugguacgcccagauucagccucacuggaucgccgcuucuauuauccuggaguuuuuccuuauugugcugcucauccccgaacccgagaaacaaagaaccccucaggacaaccagcugaccuaugucgugaucgccauucugacagucguggcggccaccauggcuaaugaaaugggguuucucgagaagaccaagaaggaccuuggacugggcuccaucacgacccaggagagcgaauccaacauucuggauaucgaccuccggccggccucugcuuggacacuguacgccguugcgaccacauucgugacccccaugcuucgccauagcauugaaaauagcucugugaacgucagccugacggccaucgcuaaucaagccaccguucucauggggcugggaagaggcuggccucuguccaaaauggauauuggggugccccuccuugcuaucggauguuacagccaggugaacccuaucacacugaccgccgcucugcuccugcuugucgcccacuaugcgauuaucggccccggccugcaggccaaggcuacacgggaagcccagaagcgcaccgcugccgggauuaugaaaaauccuacgguggacggaaucacaguuauugaucucgagccgauccccuacgacccuaaguuugaaaaacaacugggccaggugaugcugcucguccuuugcgugacccagguccugaugaugagaacaaccugggcccugugugaggcgcucacccuggcuacagggcccaucucuacgcuuugggagggaaacccuggccgguucuggaauaccacaauugccguguccauggcuaacaucuuucgcgggagcuaucuggccggagccggccuccuguucucuauuaugaagaauaccacaaacaccagacggggcacggggaauaucggagaaacacugggcgagaaauggaaguccagacucaacgcucuuggaaagagcgaauuucagauuuacaaaaagucuggaauccaagagguugaucgcacccuggccaaagagggcaucaagagaggggaaaccgaccaucacgcggugagcagaggauccgccaaacugcgcugguucgucgagcggaacauggugacacccgaaggcaagguuguggaucucggcugcgggagaggaggcuggucuuauuacugugggggacugaaaaauguccgcgaggugaagggccuuaccaaagggggaccgggccaugaggagccuauucccaugagcacauauggcuggaaccuggugcggcuccaguccgggguugacgucuucuuuacgcccccugagaaaugcgauacccugcugugugacaucggagaaagcucccccaauccuacaauugaggcuggcagaacccuccgcgugcuuaaccugguggaaaauuggcugaacaauaacacacaguucugcgucaagguucucaauccguacaugcccucugugaucgagaaaauggaaacccugcaacggaaguacgggggagcccuugugagaaacccucugagccgcaauuccacgcacgagauguauugggucucuaacgcuaccggcaauauugugagcuccguuaacaugaucucucggaugcucaucaauagauuuacaaugaaacacaagaaggccaccuacgagcccgauguggaccuggggagcggaacacgcaacauuggcaucgaaaacgagauuccuaaucuggacaucauuggcaaaagaaucgaaaagauuaaacaggagcaugaaaccuccuggcacuaugaucaggaccaucccuacaagacaugggcguaucacgggagcuacgagaccaaacagacgggaucugccuccagcauggucaacggcgugguuaagcuccuuacaaagccgugggauguggucccuauggugacccaaauggcuaugaccgacacaacgcccuucgggcagcagcggguguuuaaagagaaggucgauacccgcacacaggaaccuaaagagggaaccaagaaacugaugagaaucacagccgaauggcuguggaaggagcucggcaagaaaaagacaccccggauguguacaagagaggaguucacccggaaaguucgcucuaaugcugcccugggggcuaucuuuacggacgagaacaaguggaaauccgccagagaagcgguggaggauagccgguucugggaacuuguggaccgcgagagaaaucugcaccucgagggaaagugcgaaaccugugucuauaacaugaugggcaaacgggagaagaagcugggcgaauuugggaaagccaagggaucucgcgcuauuugguacauguggcugggcgccagauuccucgaguuugaagcucugggguuccuuaaugaggaucauugguuuucccggggaaacagccuguccggcguggagggggaaggccuccacaaacugggauacauccuucgcgacguuagcaagaaagagggcggggccauguaugccgaugacacagcgggaugggacaccagaauuacacuggaagaucucaagaaugaggaaauggugaccaaccauaugaagggcgagcacaaaaagcuggcugaggccaucuucaaacugacguaccaaaauaaggucgugcggguucagcgcccuacacccagagggaccgugauggacauuaucucucggaaagaucagcgcggaagcggccaggucgggacauauggccucaacaccuucacgaauauggaagcccaacugaucagacagauggagggagaaggcauuuuuaaguccauccagcggcuuaccgugacagaggagauugcuguucaaaacuggcuggccagaguggggcgcgaacggcucucuagaauggcuaucagcggagacgauugcgucgugaagccgcuggacgaucgcuucgccuccgcgcuuaccgcccugaaugacaugggcaaaguccggaaggauauucagcagugggagccuucuagaggguggaacgacuggacacaggugcccuuuugcagccaucacuuccacgaacucguuaugaaagauggacgcgugcuggucgugcccugucggaaccaagacgagcugaucggcagagcucgcaucucccagggggccggcuggucucucaaggaaaccgcuugccugggaaaaagcuacgcccagauguggacacuuauguauuuucaucggagagaucugcgccucgcggccaaugcuauuuguuccgccgugccuagccacuggguuccgaccucucggacgacaugguccauccaugcuaagcacgaguggaugaccaccgaggacaugcuggccguguggaacagagucuggauucaggaaaaucccuggauggaggacaagacaccuguggaaagcugggaggaaguucccuaccuuggcaaacgggaggaucaauggugcgggucucugaucggacucaccuccagagcuacaugggccaagaacauucagacggcgaucaaucaggugcgcagccugauuggcaacgaggaauauaccgacuacaugccuuccaugaaacgguucagaaaggaggaagaggaagccgggguccugugguga

SEQ ID NO: 19896 - RNA, 9876 nt, Artificial Sequence
  derived and/or modified CDS sequence (opt5) from DENV-2__EU482554__SS-prME
accgccggcgugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaccgucguucucccugagaaccuggaauacacaauugugaucacaccccacagcggggaggagcaugcggugggaaaugacacaggcaaacacggcaaggaaaucaaaauuaccccucagucuuccaucacggaggccgaacuuaccggguauggaacagucaccauggaguguagcccccggacaggccuggauuucaacgaaauggugcuccugcagauggaggacaaggcuuggcuuguucaccgccaaugguuucuggaucucccgcugccuuggcugcccggggccgacacccagggaucuaauuggauucagaaagagacgcucgugacauucaagaacccucaugcuaagaaacaggacgucgugguucugggcucccaagaaggggccaugcacaccgcccuuacaggcgcuaccgagauccagaugagcuccggaaaucugcucuuuaccggccaucugaagugcagacuucggauggauaaacugcagcucaaggggaugucuuacagcauguguacaggaaaauucaagauugugaaggaaaucgcggagacgcaacacggcaccaucgucauuagagugcaguaugagggggacggaucccccugcaaaauccccuucgaaauuauggaucuggagaagcgcuacguccugggccggcucaucacagugaacccuauuguuaccgaaaaagacagcccggugaacaucgaggccgaacccccuuuuggggauucuuacauuaucaucggcgucgagcccggacagcugaaacuuaauugguucaaaaagggcuccagcauugggcagauguuugagacaaccaugagaggagcuaagcgcauggccauccugggcgacacggccugggauuucgggucucucggaggcguguuuacaagcauugggaaagcucugcaucaaguuuucggcgccaucuauggagcggcuuuuuccggcgugucuuggaccaugaagauucugaucggggucaucauuaccuggaucggaaugaacagccgguccacaagccuuucugugucccucgugcugguuggcgucgugacccuguaccucggggugaugguccaggccgacagcggaugugugguuucuuggaaaaauaaggaacugaaaugcggcuccgggauuuucaucacagauaacgugcacacguggaccgagcaguauaaguuucagccugaaagccccuccaaacuugccucugcuauucaaaaagcccacgaggaaggcaucuguggaaucagaagcgucacacgccuggagaaucucauguggaagcagauuaccccggagcugaaccauauccuguccgaaaaugaggugaaacuuacaauuaugaccggcgacaucaaggggauuaugcaggcuggaaaacggucucucagaccucagcccacggaacugaaguacagcuggaaaaccuggggcaaggccaagaugcuguccacagagagccacaaccaaaccuuccucaucgaugggccugaaacagcggagugccccaauaccaaccgcgccuggaacucucuggagguugaagacuauggauuuggcguguucuccacaaacaucuggcuuaaacugcgggagaagcaggacgucuuuugugauagcaaacucaugucugcugccauuaaggacaauagagcugugcaugccgauaugggcuacuggaucgaauccgcgcugaacgacaccuggaaaauggagaaggccagcuucauugagguuaagucuugccacuggccuaaaagccacacgcugugguccaauggggugcuugaaagcgagaugaucauucccaagaacuucgcuggaccggucucucagcauaacuaucgcccuggcuaccacacacagaccgccgggcccuggcaucucggaaaacuggaaauggauuuugacuucugugagggcaccacagugguggucaccgaagauugcgggaaucggggacccucccugagaacgacaaccgcuagcggcaagcucaucacagaguggugcugucgguccugcacccugccuccgcuucgcuacagaggcgaggacggguguugguauggaauggaaauucggccccugaaagagaaggaagagaaccucguuaauucucuggugacagccggccacgggcaaaucgauaacuuuagccugggagugcuuggcauggcccucuuccuggaagagaugcugagaacccgcgucgggacgaagcaugcuauccuccugguggcgguuuccuuugugacccuuauuacaggaaauaugucuuuccgggaccugggcagagucauggugaugguuggcgccaccaugacagaugacaucgggaugggagugaccuaccucgcucugcuggccgccuuuaaaguccgcccuacguucgcugccggccuucugcucagaaagcugacaagcaaagagcucaugauggcgaccauugggaucgcucugcuuucccagucuacaauucccgaaaccauccuggagcucaccgaugcccuggcccugggaaugauggugcuuaagaucguucggaacauggaaaaauaucagcuggcugugacaauuauggccauccucugcgucccuaaugcggugauucugcaaaacgcuuggaaggugagcuguacgauccucgccgccgucuccguuagcccccugcuucugaccucuucccagcagaaggcugacuggauuccucucgcccugacaaucaaaggccugaaucccaccgcuaucuuucuuacaacccugagccgcacgucuaagaaaagauccuggccgcucaacgaggccgugauggcgguggggauggucagcauucuggccucuucccuccugaagaaugacaucccuaugacaggaccccuuguggcuggcggccugcugaccguuugcuacgugcucaccgggcggagcgccgaucuggaacuugagcgcgcugccgacgucaaaugggaggaucaggccgaaauuuccggaagcucuccuauccugagcauuacaaucuccgaggacggcucuaugagcauuaagaacgaagaggaggaacaaacccucacaauccugaucagaacggggcuccuggugauuuccggaguuuuccccgugucuaucccgauuaccgcugcggccugguaucuuugggaggucaaaaagcagcgggcuggcgugcugugggaugucccuucucccccucccguggggaaggccgaacuggaggacggagccuaccgcaucaaacagagaggcauuuuuggcuauucccagaucggggcuggaguuuacaaggaaggcacauuccacaccauguggcacgugacaagaggggccguccucaugcaucgcggaaaaagaaucgagcccuccugggcggaugugaagaaagaccugauuagcuacggcgggggauggaaacuugagggcgaauggaaggagggcgaagagguucaagugcuggcucucgaaccugggaaaaauccgcgggccguccagaccaagcccggacuguuuaaaacgaacaccggcacaaucggggccgugucccucgauuucagcccuggaaccucuggcucccccauuguggacagaaaggggaaaguugucggacuguauggcaauggcguggugacacgcagcggggcuuacgucucugccaucgcgcagaccgagaaguccauugaggauaacccugaaaucgaggacgauaucuuccggaagaaaagacuuacaauuauggaccugcaccccggagcuggcaagacgaaacgcuaucugccugccaucgugcgggaagccauuaagagagggcuccgcacccugauccuugcuccgacacggguuguggccgcugagauggaagaggcccugagaggacuccccauucgcuaccagaccccugcgauccgggccgagcauaccggcagagaaauugucgaccugaugugucacgcuacauuuacgaugcggcuccugagccccgugcgcguuccuaacuauaaucuuaucaucauggaugaggcccauuucaccgaccccgcuuccauugccgccagaggguacaucucuacacggguggaaaugggcgaggcugcgggaauuuuuaugaccgccacaccgccuggcagccgcgaucccuucccccaauccaacgcuccuaucauggacgaggaaagagagauucccgaacggagcuggaacucugggcacgagugggucaccgauuuuaaaggaaagacggugugguucguuccuuccaucaaggccggcaacgacaucgccgcuugccugcgcaagaaugggaagaaagugauucagcugagccgcaagacauuugauucugaauaugucaaaacccgggccaacgacugggauuucguggugaccacagacaucagcgagaugggagcgaauuuuagagcugagcgcgucauugauccgcggagauguaugaagcccguuauccucaccgacggcgaagaaagagugauucuggccgggccuaugcccgugacacacuccucugccgcucagcggagaggccgcaucggaagaaacccuaagaaugaaaacgaccaauacaucuacaugggcgagccccuugaaaaugaugaggacugcgcccauuggaaagaggcgaagaugcugcucgauaacauuaauaccccggaagggaucauuccuagcauguucgagcccgaacgggagaaagucgacgccaucgauggagaauaucgccugagaggcgaggcucggaagacguuuguggaccugaugcgcagaggggaucucccuguuuggcuugccuaccggguggcugccgagggaauuaacuaugcugacagacgcugguguuucgauggcaucaaaaauaaccagauucuggaagagaacgucgaaguggagaucuggacaaaggagggggaacggaaaaagcugaagcccagauggcucgacgcccgcaucuacuccgauccucuggcgcuuaaagaguucaaggaauuugccgcuggccggaaaucucugacccucaaucugauuacagagaugggaagacugcccaccuucaugacgcagaaggcccgggacgcucucgauaaccuugccguucugcacaccgccgaagugggcgggcgcgcuuauaaucaugcgcugagcgagcucccggagacacuggaaacccuucugcuccugacacugcucgccaccgucacaggaggcaucuuucuuuuccugauguccgggaaaggaauuggcaagaugacccugggcaugugcugcaucauuacggcuagcauccuccugugguacgcccagauccaaccucacuggauugccgcuucuaucauucuugaguuuuuccugaucgugcuccugauucccgaacccgagaagcagagaacaccucaggacaaccagcugaccuaugucgugaucgccauccucaccguuguggcggccacaauggcuaaugaaaugggguuucuugagaaaaccaagaaagaccugggacugggcuccauuaucacacaagagagcgaauccaacauucucgauaucgaccugcggccggccucugcuuggacgcuuuacgccguggcgaccacauucgucacccccaugcugcgccacagcauugaaaauagcucuguuaacgugagccucacagccaucgcuaaucaggccaccgugcugauggggcugggaagaggcuggccucucuccaagauggauauuggggucccccuucuggcuaucggauguuacagccaggugaacccuaucacgcugaccgccgcucuccugcuucugguugcccauuaugcgauuaucggccccggccuccaggccaaagcuacacgggaagcccaaaagcgcgcugccgccgggauuaugaagaauccuaccguggacggaaucacagucauugaucuggagccgauccccuacgacccuaaauuugaaaagcagcugggccaggugaugcuccuuguccugugcgugacccagguucugaugaugagaacgacaugggcgcucugugaggcucugacccuugccacagggcccaucucuacccugugggagggaaacccuggccgguucuggaauaccacaauugcuguguccauggccaacaucuuucgcgggagcuaucucgccggagcuggccugcuguucucuauuaugaaaaauacgaccaacacaagacggggcaccgggaauaucggagaaacacucggcgagaaguggaaauccagacuuaacgcccugggaaagagcgaauuucaaauuuacaagaaaucuggaauccaggaggucgaucgcacccuggcgaaggagggcaucaaaagaggggaaacggaccaccaugccgugagcagaggauccgcuaagcuccgcugguucguugagcggaacauggugacacccgaaggcaaagucguggaucugggcugcgggagaggaggcuggucuuauuacugugggggacuuaagaaugugcgcgagguuaaaggccugaccaaagggggaccgggccacgaggagccuauucccaugagcaccuauggcuggaaccucguccggcugcaguccgggguggacguguucuuuacacccccugagaagugcgauacccugcucugugacaucggagaaagcucccccaauccuacaauugaggccggcagaacgcuucgcguccugaaccugguugaaaauuggcucaacaauaacacccaauucugcaucaaagugcugaauccguacaugcccucugugauugagaagauggaaacacuucagcggaaauacgggggagcucuggucagaaacccucucagccgcaauuccacccaugagauguauugggugucuaacgccacaggcaauaucguuagcuccgugaacaugaucucucggaugcugauuaauagauuuaccaugaagcacaaaaaggcgacguacgagcccgaugucgaccuggggagcggaacccgcaacaucggcauugaaaacgagaucccuaaucucgacauuaucggcaagagaauugagaagaucaagcaggagcacgaaacauccuggcauuaugaucaggaccaccccuacaaaaccugggccuaucaugggagcuacgagacaaagcaaaccggaucugcuuccagcauggugaacggcguugugcggcuucugacaaaaccgugggaugucgugccuauggugacccagauggccaugacggacacaacccccuucgggcagcagcgcgucuuuaaggagaagguugauaccagaacacaagaaccuaaagagggaacgaagaaacugaugcggaucaccgcugaauggcucuggaaggagcugggcaaaaagaagacacccagaauguguacccgggaggaguucacacgcaaagugagaucuaaugccgcucuuggggccauuuuuaccgacgagaacaaguggaaauccgcgcgggaagccguggaggauagccgcuucugggaacuggucgacagagagcggaaucuccaccuggagggaaagugcgaaacauguguguauaacaugaugggcaaacgcgagaagaaacugggcgaauuugggaaggcuaagggaucuagagccaucugguacauguggcucggcgcucgguuccuggaguuugaagcccuuggguuccugaaugaggaucacugguuuucccgcggaaacagccucuccggcguugagggggaaggccugcauaaacuuggauacauucugagagacgugagcaagaaagagggcggggccauguaugcggaugacaccgcuggaugggacacgcggaucacccucgaagaucugaagaaugaggaaauggucacaaaccacaugaaaggcgagcauaagaagcuggccgaggccauuuucaaacucaccuaccagaauaaggugguucgcgugcagagaccuacaccccgggggaccgucauggacaucaucucucgcaaagaucagagaggaagcggccaaguggggacguauggccugaacacauucaccaauauggaagcucagcuuauucggcagauggagggagaaggcaucuuuaaguccauucaacaccugacaguuaccgaggagaucgccgugcagaacuggcucgcuagagucgggcgcgaacggcugucuagaauggccauuagcggagacgauugcguggucaaaccgcuugacgaucgcuucgcguccgcccugacggcucucaaugacaugggcaaggugcggaaggauauccagcagugggagccuucuagaggguggaacgacuggacccaaguucccuuuugcagccaucacuuccacgaacuggugaugaaagauggacgcguccugguggugcccugucggucccaggacgagcucaucggcagagcccgcauuucucagggggcuggcuggagccugaaggaaacagccugccuuggaaaauccuacgcgcagauguggacccugauguauuuucaucggagagaucuccgccuggccgcuaacgccaucuguagcgcuguuccuucucacugggugccgacaucccggaccacauggagcauucaugccaagcacgaguggaugaccacggaggacaugcuugcugucuggaauagaguguggauccaagaaaaccccuggauggaggacaaaacacugguugaaucuugggaggaagugccuuaccucggcaagcgggaggaucaguggugcgggucccugauuggacugaccagcagagccaccugggcgaagaauauccagacagccauuaaccagguccgcucccucaucggcaaugaggaauauaccgacuacaugcccucuaugaaacgguucagaaaggaggaagaggaagcuggggugcugugguga

SEQ ID NO: 19897 - RNA, 9876 nt, Artificial Sequence
  derived and/or modified CDS sequence (opt5) from DENV-2__EU482556__SS-prME
accgccggagugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggugucucacgaaaugguucuccugcagauggaggauaaggcuuggcuugugcaucgccaaugguuccuggaccucccgcugccuuggcugcccggggccgauacacagggauccaacuggauucagaaggagacccucgucacguuuaagaauccucacgcuaaaaagcaggacgugguugugcugggcagccaagaaggggccaugcauacagcccuuaccggcgcuacagagauccagauguccucuggaaaccuccuguucaccggccaccugaaaugcagacuucggauggacaagcugcagcucaaagggaugagcuacuccauguguaccggaaaguuuaagauugucaaagaaaucgcggagacacaacauggcacgaucgugauuagaguccaguaugagggggauggaagccccugcaagauccccuucgaaauuauggaccuggagaaacgccacgugcugggccggcucaucaccguuaauccuauugugacagaaaaggauucuccggucaacaucgaggccgaacccccuuucggggacuccuacauuaucaucggcguggagcccggacagcugaaacuuaacugguuuaagaagggcagcucuauugggcagauguucgagaccacaaugagaggagcuaaacgcauggccguucugggcgauaccgccugggacuuugggagccucggaggcguguucacguccaucgggaaggcucugcaccaagucuuuggcgccauuuacggagcggcuuucucuggcgugagcuggacaaugaaaauccugauuggggugaucaucaccuggauuggaaugaacucccggagcaccucucuuuccguuagccucguccuggugggcguggucacacuguaucucggggugaugguucaggccgauaccggauguguggucucuuggaagaacaaagaacugaagugcggcuccgggaucuuuauuacagacaaugugcauacguggaccgagcaguacaaguuccagccugaaagccccuccaaacuugccucugcuauccaaaaggcccacgaggaaggcauuuguggaaucagaagcguuacacgccuggagaaccucauguggaaacagaucaccccggagcugaaucauauucuguccgaaaacgaggugaaacuuacaaucaugaccggcgauauuaaagggaucaugcaggcuggaaagcggucucucagaccucagcccacggaacugaaauauagcuggaagaccuggggcaaggccaaaaugcuguccacagagagccacaaucaaaccuuucucauugacgggccugaaacagcggagugccccaacaccaaucgcgccuggaacucucuggaggucgaagauuacggauucggcguguuuuccacaaauaucuggcuuaagcugcgggagaaacaggacguuuucugugacagcaagcucaugucugcugccaucaaagauaacagagcugugcacgccgacaugggcuauuggauugaauccgcgcugaaugauaccuggaagauggagaaggccagcuuuaucgagauuaaaucuugccauuggccuaagagccacacgcugugguccaacgggguccuugaaagcgagaugaucauucccaaaaauuucgcuggaccggugucucagcauaacuaccgcccuggcuaucacacacagaccgccgggcccuggcaucucggaaagcuggaaauggacuucgauuuuugugagggcaccacaguggucguuaccgaagacugcgggaaccggggacccucccugagaacgacaaccgcuagcggcaaacucaucacagaguggugcugucgguccugcacccugccuccgcuucgcuacagaggcgaggauggguguugguacggaauggaaauucggccccugaaggagaaggaagagaaucucgugaacucucuggugacagccggccacgggcaaaucgacaauuucagccugggaguccuuggcauggcccucuuucuggaagagaugcugagaacccgcguggggacgaaacacgcuauccuccugguugcgguguccuucgucacccuuauuacaggaaacaugucuuuucgggaucugggcagagugaugguuauggugggcgccaccaugacagacgauaucgggaugggagucaccuaucucgcucugcuggccgccuucaaggugcgcccuacguuugcugccggccuucugcucagaaaacugacaagcaaggagcucaugauggcgaccauugggaucgcucugcuuucccagucuacaauucccgaaaccauccuggagcucaccgacgcccuggcccugggaaugaugguucuuaaaaucgugcggaauauggaaaaguaccagcuggcugucacaauuauggccaucagcugcgugccuaacgcggugauucuccaaaaugcuuggaaggucuccuguacgauccuggccgccguuagcgugucuccccuccugcuuaccuccagccagcagaaagcugauuggauuccucuggcccucacaaucaagggccugaaccccaccgcuaucuuccugacaacccuuucucgcacguccaaaaagagaagcuggccgcugaaugaggccgugauggcggucgggauggugucuauucucgccuccagccugcucaaaaacgacaucccuaugacaggaccccugguugcuggcggccuucugaccgugugcuauguccugaccgggcgguccgccgaccucgaacuggagcgcgcugccgaugugaagugggaggaccaggccgaaauuagcggaucuagcccuauccuuuccauuacaaucucugaggauggcagcauguccauuaaaaaugaagaggaggaacauacccugacaauccucaucagaacggggcugcucguuauuucuggaguguuucccgucagcaucccgauuaccgcugcggccugguaccugugggaggugaagaagcaacgggcuggcguccuuugggacgugccuucucccccucccguugggaaagccgaacuggaggauggagccuaucgcaucaagcagagaggcauuuucggcuacagccagaucggggcuggaguguauaaagaaggcacauuucacaccauguggcaugucacaagaggggccgugcugaugcaccgcggaaagagaaucgagcccagcugggcggacguuaaaaaggaucucauuuccuacggcgggggauggaagcuggagggcgaauggaaagagggcgaagaggugcagguccuugcucuggaaccugggaagaacccgcgggccgugcaaaccaaacccggacucuucaagacgaauaccggcacaaucggggccgugagccuggacuuuucuccuggaaccuccggcagccccauuguugauagaaaagggaaggucgugggacucuacggcaacggcguggucacacgcucuggggcuuauguguccgccaucgcgcagaccgaaaagagcauugaggacaauccugaaaucgaggaugacaucuuccggaaaaagagacugacaauuauggaucuucaucccggagcuggcaaaacgaagcgcuaccugccugccaucguucgggaagccauuaaaagagggcugcgcacccucauccuggcuccgacacggguggucgccgcugagauggaagaggcccuuagaggacugcccauucgcuaucagaccccugcgauccgggccgagcacaccggcagagaaauuguggaccucaugugucacgcuacauucacgaugcggcugcucucccccguucgcgugccuaacuacaaccugaucaucauggacgaggcccauuuuaccgaucccgcuucuauugccgccagaggguauaucagcacacgggucgaaaugggcgaggcugcgggaauuuucaugaccgccacaccgccuggcucccgcgaccccuuuccccagagcaaugcuccuaucauggaugaggaaagagagauucccgaacggucuuggaacuccgggcacgagugggugaccgacuucaagggaaagacgguuugguuugugccuagcaucaaagccggcaaugauaucgccgcuugccuuagaaagaacgggaaaaaggucauucaacugucucgcaaaacauucgacagcgaauacgugaagacccgggccaaugauugggacuuuguggucaccacagauaucuccgagaugggagcgaacuucagagcugagcgcguuauugacccgcggagauguaugaagcccgugauccugaccgauggcgaggaacgcgugauucucgccgggccuaugcccgucacacauucuagcgccgcucagcggagaggccgcaucggaagaaauccuaaaaacgaaaaugaccaguauaucuacaugggcgagccccuggaaaacgacgaggauugcgcccacuggaaggaggcgaaaaugcuucuggacaauauuaacaccccggaagggaucauuccuuccauguuugagcccgaacgggagaagguggaugccaucgacggagaauaccgccucagaggcgaggcucggaaaacguucguugaucugaugcgcagaggggaccugccuguguggcucgccuaucgggucgcugccgagggaauuaauuacgcugauagacgcugguguuuugacggcaucaagaacaaucaaauucuugaagagaacguggaaguugagaucuggacaaaagagggggaacggaagaagcugaaacccagauggcuggaugcccgcaucuauucugacccucucgcgcugaaggaguucaaagaguucgccgcuggccggaagucccuuacccugaaccucauuacagagaugggaagacugcccacccugaugacgcagaaagcccgggaugcucucgacaaucuugccgugcugcacaccgccgaagucggcgggcgcgcuuacaaccaugcgcuguccgagcucccggagacacuggaaacccuucugcuccugacacugcucgccaccgugacaggaggcaucuuucuuuuccugaugagcgggaagggaauuggcaagaugacccugggcaugugcugcaucauuacggcuucuauccuccugugguaugcccagauccagccucacuggauugccgcuuccaucauucuugaguuuuuccugaucguccuccugauucccgaacccgagaaacaaagaacaccucaggauaaucagcugaccuacgugguuaucgccauccucaccgugguggcggccacaauggcuaacgaaaugggguuucuugagaagaccaaaaaggaccugggacugggcagcauuacaacgcaggaguccgaaucuaauauccucgacauugaucugcggccggccagcgcuuggacccuuuaugccgucgcgacaaccuucguuacacccaugcugcgccauuccaucgagaacucuagcgugaaugugucccucaccgccauugcuaaccaagccacgguccugauggggcugggaagaggcuggccucucagcaaaauggacaucggggugccccuucuggcuauuggauguuacucucagguuaauccuaucacccugacagccgcucuccugcuucugguggcccacuacgcgaucauuggccccggccuccaggccaaggcuacccgggaagcccagaagcgcacagcugccgggaucaugaaaaacccuaccgucgauggaauuacggugaucgaccuggagccgauucccuaugauccuaaguuugaaaaacaacugggccaggucaugcuccuugugcugugcguuacacaggugcugaugaugagaaccacaugggcccucugugaggcgcugacccuugcuaccgggcccaucuccacacugugggagggaaauccuggccgguucuggaacacgaccaucgccgucagcauggcuaauauuuuucgcgggucuuaccucgccggagccggccugcuguucuccaucaugaagaacacaaccaauacaagacggggcaccgggaacauuggagaaacgcucggcgagaaauggaaaagcagacuuaaugcucuggggaagucugaauuucagaucuauaaaaagagcggcauucaagagguggaccgcacacuggccaaagagggcaucaagagaggggaaaccgaucaucacgcgguuuccagaggaucugccaaacuccgcugguucguggagcggaacauggucacccccgaaggcaaggugguggaccugggcugcgggagaggaggcuggagcuacuauugugggggacuuaaaaacguucgcgaggucaagggccugacaaaagggggaccgggccacgaggaaccuauccccauguccaccuacggcuggaaucucgugcggcugcagagcgggguggaugucuuuuucacacccccugagaaaugcgacacgcugcucugugauauuggagaauccucucccaacccuaccaucgaggcuggcagaacacuucgcguucugaaucugguggaaaacuggcucaauaacaauacccaguucugcgugaagguccugaacccguauaugcccagcgugauugagaaaauggaaacacuucaacggaaguacgggggagcccugguuagaaauccucucucccgcaacucuacccaugagauguacugggugagcaaugcuacgggcaacaucgucuccucugugaauaugauuagccggaugcugaucaacagauuuaccaugaaacacaagaaggccacauaugagcccgacguugaucugggguccggaacccgcaauaucggcauugaaaacgagaucccuaaccucgacauuaucggcaaaagaauugaaaagaucaaacaggagcaugaaacaagcuggcacuacgaccaggaucaccccuauaagaccugggcguaccaugggucuuaugagacaaaacagaccggauccgccagcucuauggugaauggcgucgugaaacuucugacgaagccgugggacguggucccuaugguuacacaaauggcuaugaccgauaccacacccuucgggcagcagcggguguuuaaagagaagguggacacgcgcacccaggaaccuaaagagggaacaaagaaacugaugagaauuaccgccgaauggcucuggaaggagcugggcaagaaaaagacaccccggauguguaccagagaggaguucacacggaaaguccgcuccaacgcugcccuuggggcuaucuuuaccgaugagaauaaguggaaaagcgccagagaagcgguggaggacucucgguucugggaacugguugaucgcgagagaaaccuccaccuggagggaaagugcgaaacguguguguacaauaugaugggcaaacgggagaagaagcugggcgaauuugggaaagccaagggaucccgcgcuaucugguauauguggcucggcgccagauuccuggaguuugaagcucuuggguuccugaacgaggaccauugguuuagccggggaaauucccucagcggcgucgagggggaaggccugcacaaacuuggauacauucugcgcgaugugucuaagaaagagggcggggccauguacgccgacgauaccgcgggaugggacacaagaaucacccucgaagaccugaagaacgaggaaaugguuacaaaucauaugaagggcgagcacaaaaagcuggcugaggccauuuucaaacucaccuaucaaaacaaggugguccgggugcagcgcccuacgcccagagggacaguuauggauaucauuagccggaaagaccagcgcggauccggccagguggggaccuacggccugaauacauuuaccaacauggaagcccaacuuaucagacagauggagggagaaggcaucuucaagucuauucagcggcugacggucaccgaggagaucgcugugcaaaauuggcucgucagaguggggcgcgaacggcugagcagaauggccguuuccggagaugacugcguggucaagccgcuugaugaccgcuucgcuucugcccugacagcgcucaacgauaugggcaaagugcggaaggacauucagcagugggagccuagcagaggguggaaugauuggacccaggugcccuuuugcucccaccauuuccacgaacugguuaugaaagacggacgcgugcuggucgugcccugucggaaccaagaugagcucaucggcagagcccgcauuucucagggggcuggcuggagccugaaggaaacagccugccuuggaaaauccuaugcucagauguggacccugauguacuuucaucggagagaccuccgccuggccgcgaacgccaucuguagcgcuguuccuucucacugggugccgacaucccggaccacguggagcauccacgccaagcaugaguggaugacaaccgaggauaugcuugcugucuggaauagaguguggauucaggaaaaccccuggauggaggacaagaccccugucgaaucuugggaggaagugcccuaucugggcaaacgggaggaccaauggugcgggucccucaucggacugacaagcagagccaccugggcuaagaauauucagacagccaucaaccagguucgcucccugauuggcaaugaggaauacacggauuauaugccuucuaugaaacgguucagaaaggaggaagaggaagcgggggugcucugguga

SEQ ID NO: 19898 - RNA, 9876 nt, Artificial Sequence
  derived and/or modified CDS sequence (opt5) from DENV-2__EU529693__SS-prME
accgccggcgugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaccauggccgcuauccucgccuacaccauuggaacaacgcacuuucagagagcucugaucuucauucuucugaccgccguggcgccuagcaugacaaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacggaggcuaagcagccugccacacugagaaaauauugcauugaagcuaagcucaccaacaccacaaccgagagccgguguccgacacaaggagagcccucucugaaugaggaacaggacaaacgcuuuaucugcaagcauuccaugguggauagaggcuggggcaacggguguggacuguucggcaaaggcgggauugugacgugcgccauguuuaccugcaaaaagaauauggaagggaaagucguucucccugagaaccuggaauacacaaucgugauuacaccccacagcggggaggagcaugcggugggaaaugacacaggcaagcacggcaaagaaaucaagaucaccccucagucuuccauuacggaggccgaacuuaccggguauggaacagucaccauggaguguagcccccggacaggccuggauuucaacgaaauggugcuccugcagauggaggacaaggcuuggcuuguucaccgccaaugguuucuggaucucccgcugccuuggcugcccggggccgacacccagggaucuaauuggauccagaaggagacgcucgugacauucaagaacccucaugcuaaaaagcaggacgucgugguucugggcucccaagaaggggccaugcacaccgcccuuacaggcgcuaccgagauucagaugagcuccggaaaucugcucuuuaccggccaucugaaaugcagacuucggauggauaagcugcagcucaaagggaugucuuacagcauguguacaggaaaguucaagaucgugaaagaaauugcggagacgcaacacggcaccaucgucaucagagugcaguaugagggggacggaucccccugcaagauucccuucgaaaucauggaucuggagaaacgccauguccugggccggcucauuacagugaacccuaucguuaccgaaaaggacagcccggugaacauugaggccgaacccccuuuuggggauucuuacaucauuaucggcgucgagcccggacagcugaaacuuaauugguucaagaagggcuccagcaucgggcagauguuugagacaaccaugagaggagcuaaacgcauggccauucugggcgacacggccugggauuucgggucucucggaggcguguuuacaagcaucgggaaggcucugcaccaaguuuucggcgccauuuacggagcggcuuuuuccggcgugucuuggaccaugaaaauccugauuggggucaucaucaccuggauuggaaugaacagccgguccacaagccuuucugugucccucgugcugguuggcaucgucacccuguaucucggggugauggugcaggccgacacaggaugugucgugagcuggaagaauaaagaacugaagugcggcucugggauuuucaucacggauaacguucacaccuggacagagcaguacaaguuucagccugaaucccccagcaaacuugccuccgcuauucaaaaggcccaugaggaaggcaucuguggaaucagaucugugacccgccuggagaaucucauguggaaacagauuacaccggagcugaaccacauccugagcgaaaaugaggucaaacuuaccauuaugacgggcgacaucaaagggauuaugcaggcuggaaagcggucccucagaccucagcccaccgaacugaaauauucuuggaagacauggggcaaggccaaaaugcugagcaccgagucccauaaccaaacauuccucaucgaugggccugaaaccgcggagugccccaauacaaaccgcgccuggaauagccuggagguggaagacuacggauuuggcguuuucucuaccaacaucuggcuuaagcugcgggagaaacaggacguguuuugugauuccaagcucaugagcgcugccauuaaagacaauagagcuguccacgccgauaugggcuauuggaucgaaucugcgcugaacgacacguggaagauggagaaggccuccuucauugagaucaaaagcugccacuggccuaagucucauacacuguggagcaauggggugcuugaauccgagaugauuauccccaaaaacuucgcuggaccgguuagccagcacaacuaccgcccuggcuaucauacccagaccgccgggcccuggcaccucggaaagcuggaaauggauuuugacuucugugagggcacaaccguggucgugacggaagauugcgggaaucggggacccucucugagaacaaccacagcuuccggcaaacucauuaccgaguggugcugucggagcugcacacugccuccgcuucgcuacagaggcgaggacggguguugguacggaauggaaauccggccccugaaggagaaggaagagaaccucgugaauagccuggucaccgccggccaugggcaaaucgauaacuuuucucugggaguucuuggcauggcccucuuccuggaagagaugcugagaacgcgcguggggaccaaacacgcuauucuccugguggcggucagcuuugugacacuuaucaccggaaauauguccuuccgggaccugggcagaguuauggugauggucggcgccacaaugaccgaugacauugggaugggagugacguaucucgcucugcuggccgccuuuaagguucgcccuacauucgcugccggccuucugcucagaaaacugaccucuaaggagcucaugauggcgacaaucgggauugcucugcuuagccaguccaccauccccgaaaccauccuggagcucacagaugcccuggcccugggaaugauggugcuuaaaauuguccggaacauggaaaaguaccagcuggcugugacgaucauggccauuucuugcguuccuaaugcggugauccuccaaaacgcuuggaaggucagcuguaccauucuggccgccguguccgugagcccccuccugcuuacaucuucccagcagaaagcugacuggaucccucuggcccucaccaucaagggccugaaucccacagcuauuuuucugaccacgcuuagccgcacaucuaaaaagagauccuggccgcugaacgaggccgucauggcgguugggauggugagcauccucgccucuucccugcucaaaaaugacauuccuaugaccggaccccugguggcuggcggccuucugaccgucugcuaugugcugacagggcggagcgccgaucucgaacuggagcgcgcugccgacguuaagugggaggaucaggccgaaaucuccggaagcucuccuauucuuagcaucaccauuuccgaggacggcucuaugagcaucaaaaacgaagaggaggaacacacacugacgauccucauuagaaccgggcugcucgugaucuccggagucuuccccgugucuauuccgaucacagcugcggccugguaccugugggagguuaagaagcaacgggcuggcgugcuuugggaugucccuucucccccucccguggggaaagccgaacuggaggacggagccuaucgcauuaagcagagaggcaucuuuggcuacucccagaucggggcuggagucuauaaagaaggcaccuuccauacaauguggcacgugaccagaggggccguucugaugcaucgcggaaagagaauugagcccuccugggcggaugugaaaaaggaccucaucagcuacggcgggggauggaagcuggagggcgaauggaaagagggcgaagagguccaggugcuugcucuggaaccugggaagaauccgcgggccguucaaacgaaacccggacucuuuaagaccaacacaggcaccauuggggccgugucccuggauuucagcccuggaacaucuggcucccccaucgucgacagaaaagggaagguggugggacucuacggcaauggcguugucacccgcagcggggcuuaugugucugccauugcgcagacagagaaguccaucgaggauaacccugaaaucgaggacgauauuuuccggaaaaagagacugacgaucauggaccuucaccccggagcuggcaaaaccaagcgcuaccugccugccauugugcgggaagccaucaaaagagggcugcgcacacucauucuggcuccgacccgggucguggccgcugagauggaagaggcccuuagaggacugcccauccgcuaucagaccccugcgauucgggccgagcauacaggcagagaaaucguugaccucaugugucacgcuacguuuaccaugcggcugcucagccccgugcgcgucccuaacuacaaucugaucauuauggaugaggcccacuucacagaccccgcuuccaucgccgccagaggguauauuucuacccggguggaaaugggcgaggcugcgggaaucuuuaugacagccaccccgccuggcagccgcgaucccuucccccaguccaacgcuccuauuauggacgaggaaagagagauccccgaacggagcuggaacucugggcaugaguggguuacggauuuuaagggaaagacagugugguucgucccuuccaucaaagccggcaacgacauugccgcuugccuuagaaagaaugggaaaaaggugauccaacugagccgcaaaaccuuugauucugaauacguuaagacccgggccaacgacugggauuucguggucacaaccgacauuagcgagaugggagcgaauuuuagagcugagcgcgugaucgauccgcggagauguaugaagcccgugauucugacagacggcgaggaacgcgucauccucgccgggccuaugcccguuacccacuccucugccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauacgccggaagggauuaucccuagcauguucgagcccgaacgggagaagguggacgccauugauggagaauaccgccucagaggcgaggcucggaaaacauuuguggaccugaugcgcagaggggaucugccugucuggcucgccuaucggguggcugccgagggaaucaacuacgcugacagacgcugguguuucgauggcauuaagaauaaccaaauccuugaagagaacguugaaguggagaucuggaccaaagagggggaacggaagaagcugaaacccagauggcuggacgcccgcauuuauuccgauccucucgcgcugaaggaguucaaagaauuugccgcuggccggaagucucuuacacugaaucucaucaccgagaugggaagacugcccacguucaugacccagaaagcccgggacgcucuggauaaccucgccguccuucacacagccgaagugggcgggcgcgcuuacaaucacgcgcugagcgagcugccggagacccucgaaacacugcuucugcucacccugcuggccacaguuaccggaggcauuuuucucuuccuuauguccgggaagggaaucggcaagaugacgcugggcaugugcugcauuaucacagcuagcauccugcucugguaugcccagauucagccucauuggaucgccgcuucuauuauccuggaguuuuuccuuauugugcugcucauccccgaacccgagaaacaaagaaccccucaggacaaccagcugaccuacgucgugaucgccauucugacagucguggcggccaccauggcuaaugaaaugggguuucucgagaagaccaagaaggaccuuggacugggcuccaucacgacccaggagagcgaauccaacauucuggauaucgaccuccggccggccucugcuuggacacuguaugccguugcgaccacauucgugacccccaugcuucgccacagcauugaaaauuccucugugaacgucagccugacggccaucgcuaaucaagccaccguucucauggggcugggaagaggcuggccucuguccaaaauggauauuggggugccccuccuugcuaucggauguuacagccaggugaacccuaucacacugaccgccgcucugcuccugcuugucgcccauuacgcgauuaucggccccggccugcaggccaaggcuacacgggaagcccagaagcgcaccgcugccgggauuaugaaaaauccuacgguggacggaaucacaguuauugaucucgagccgauccccuaugacccuaaguuugaaaaacaacugggccaggugaugcugcucguccuuugcgugacccagguccugaugaugagaacaaccugggcccugugugaggcgcucacccuggcuacagggcccaucucuacgcuuugggagggaaacccuggccgguucuggaauaccacaauugccguguccauggcuaacaucuuucgcgggagcuaccuggccggagccggccuccuguucucuauuaugaagaauaccacaaacaccagacggggcacggggaauaucggagaaacacugggcgagaaauggaaguccagacucaacgcucuuggaaagagcgaauuucagauuuauaaaaagucuggaauccaagagguugaucgcacccuggccaaagagggcaucaagagaggggaaaccgaccaccaugcggugagcagaggauccgccaaacugcgcugguucgucgagcggaacauggugacacccgaaggcaagguuguggaucucggcugcgggagaggaggcuggucuuacuauugugggggacugaaaaauguccgcgaggugaagggccuuaccaaagggggaccgggccacgaggaaccuauucccaugagcacauacggcuggaaccuggugcggcuccaguccgggguugacgucuucuuuacgcccccugagaaaugcgauacccugcugugugacaucggagaaagcucccccaauccuacaauugaggcuggcagaacccuccgcgugcuuaaccugguggaaaauuggcugaacaauaacacacaguucugcgucaagguucucaauccguauaugcccucugugaucgagaaaauggaaacccugcaacggaaguacgggggagcccuugugagaaacccucugagccgcaauuccacgcacgagauguacugggucucuaacgcuaccggcaauauugugagcuccguuaacaugaucucucggaugcucaucaauagauuuacaaugaaacauaagaaggccaccuaugagcccgauguggaccuggggagcggaacacgcaacauuggcaucgaaaacgagauuccuaaucuggacaucauuggcaaaagaaucgaaaagauuaaacaggagcacgaaaccuccuggcauuacgaucaggaccaccccuauaagacaugggcguaccacgggagcuaugagaccaaacagacgggaucugccuccagcauggucaacggcgugguuaagcuccuuacaaagccgugggauguggucccuauggugacccaaauggcuaugaccgacacaacgcccuucgggcagcagcggguguuuaaagagaaggucgauacccgcacacaggaaccuaaagagggaaccaagaaacugaugagaaucacagccgaauggcuguggaaggagcucggcaagaaaaagacaccccggauguguacaagagaggaguucacccggaaaguucgcucuaaugcugcccugggggcuaucuuuacggacgagaacaaguggaaauccgccagagaagcgguggaggauagccgguucugggaacuuguggaccgcgagagaaaucugcaucucgagggaaagugcgaaaccugugucuacaacaugaugggcaaacgggagaagaagcugggcgaauuugggaaagccaagggaucucgcgcuauuugguauauguggcugggcgccagauuccucgaguuugaagcucugggguuccuuaaugaggaucacugguuuucccggggaaacagccuguccggcguggagggggaaggccuccauaaacugggauacauccuucgcgacguuagcaagaaagagggcggggccauguacgccgaugacacagcgggaugggacaccagaauuacacuggaagaucucaagaaugaggaaauggugaccaaccacaugaagggcgagcauaaaaagcuggcugaggccaucuucaaacugacguaucaaaauaaggucgugcggguucagcgcccuacacccagagggaccgugauggacauuaucucucggaaagaucagcgcggaagcggccaggucgggacauacggccucaacaccuucacgaauauggaagcccaacugaucagacagauggagggagaaggcauuuuuaaguccauccagcggcuuaccgugacagaggagauugcuguucaaaacuggcuggccagaguggggcgcgaacggcucucuagaauggcuaucagcggagacgauugcgucgugaagccgcuggacgaucgcuucgccuccgcgcuuaccgcccugaaugacaugggcaaaguccggaaggauauucagcagugggagccuucuagaggguggaacgacuggacacaggugcccuuuugcagccaccacuuccaugaacucguuaugaaagauggacgcaugcuggugguccccugucggaaccaagacgagcugaucggcagagcucgcaucucccagggggccggcuggucucucaaggaaaccgcuugccugggaaaaagcuaugcccagauguggacacuuauguacuuucaccggagagaucugcgccucgcggccaaugcuauuuguuccgccgugccuagccauugggugccgaccucucggacgacaugguccauccacgcuaagcacgaguggaugaccaccgaggacaugcuggccguuuggaacagaguguggauucaggaaaaucccuggauggaggacaagacaccugucgaaagcugggaggaagugcccuaucuuggcaaacgggaggaucaauggugcgggucucugaucggacucaccuccagagcuacaugggccaagaacauucagacggcgaucaaucagguucgcagccugauuggcaacgaggaauacaccgacuauaugccuuccaugaaacgguucagaaaggaggaagaggaagccggggugcugugguga

SEQ ID NO: 19899 - RNA, 9876 nt, Artificial Sequence
  derived and/or modified CDS sequence (opt5) from DENV-2__EU482557__SS-prME
accgccggagugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacacacacugaccauccucaucagaacagggcugcucgugauuucuggaguuuuccccgugagcaucccgauuacggcugcggccugguaccugugggaggucaagaagcaacgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccauacaauguggcacgugaccagaggggccguccugaugcaucgcggaaagagaaucgagcccagcugggcggaugugaaaaaggaccucauuuccuacggcgggggauggaagcuggagggcgaauggaaagagggcgaagagguucaggugcuugcucuggaaccugggaagaauccgcgggccguccaaacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaccccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcauaccggcagagaaauugucgaccucaugugucacgcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccagagcaacgcuccuaucauggacgaggaaagagagauucccgaacggucuuggaacuccgggcaugagugggucacagauuuuaagggaaagaccgugugguucguuccuagcaucaaagccggcaacgacaucgccgcuugccuuagaaagaaugggaaaaaggugauucaacugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccacucuagcgccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccaaauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucacacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccagccucauuggauugccgcuuccaucauucuggaguuuuuccuuaucgugcugcucauucccgaacccgagaaacaaagaacgccucaggacaaccagcugacauacgucgugaucgccauccugaccguuguggcggccaccauggcuaaugaaaugggguuucucgagaagaccaagaaggaccuuggacugggcagcauuaccacacaggaguccgaaucuaacauccuggauauugaccuccggccggccagcgcuuggacgcuguaugccguggcgaccacauucgucacccccaugcuucgccacuccaucgaaaauucuagcguuaacgugucccugacagccauugcuaaucaagccaccgugcucauggggcugggaagaggcuggccucugagcaaaauggauaucggggucccccuccuugcuauuggauguuacucucaggugaacccuaucacgcugaccgccgcucugcuccugcuuguugcccauuacgcgaucauuggccccggccugcaggccaaggcuacacgggaagcccagaagcgcaccgcugccgggaucaugaaaaauccuacaguggacggaauuaccgucaucgaucucgagccgauucccuaugacccuaaguuugaaaaacaacugggccaggugaugcugcucguccuuugcgugacgcagguucugaugaugagaacaaccugggcccugugugaggcgcucacacuggcuaccgggcccaucuccacccuuugggagggaaacccuggccgguucuggaauacaacgaucgccgugagcauggcuaacauuuuucgcgggucuuaccuggccggagccggccuccuguucuccaucaugaagaauaccacaaacaccagacggggcacagggaauauuggagaaacccugggcgagaaauggaaaagcagacucaacgcucuugggaagucugaauuucagaucuauaaaaagagcggcauucaagaggucgaucgcacgcuggccaaagagggcaucaagagaggggaaacagaccaccaugcgguguccagaggaucugccaaacugcgcugguucguugagcggaacauggugacccccgaaggcaaggucguggaucucggcugcgggagaggaggcuggagcuacuauugugggggacugaaaaaugugcgcgagguuaagggccuuaccaaagggggaccgggccacgaggagccuauccccauguccacauacggcuggaaccugguccggcuccagagcgggguggacguguucuuuacacccccugagaaaugcgauacacugcugugugacauuggagaauccucucccaauccuacgaucgaggcuggcagaacccuccgcguccuuaaccugguugaaaauuggcugaacaauaacacacaguucugcauuaaggugcucaauccguauaugcccagcgugaucgagaaaauggaaacccugcaacggaaguacgggggagcccuugucagaaacccucugucccgcaauucuacacacgagauguacugggugagcaacgcuaccggcaauauuguuuccucugugaacaugaucagccggaugcucaucaauagauuuacgaugaaacauaagaaggccaccuaugagcccgaugucgaccugggguccggaacacgcaacauuggcaucgaaaacgagauuccuaaucuggacaucauuggcaaaagaaucgaaaagauuaaacaggagcacgaaaccagcuggcauuacgaucaggaccaccccuauaagacaugggcguaccacgggucuuaugagaccaaacagacaggauccgccagcucuauggugaacggcguugugaagcuccuuaccaagccgugggaugucgugccuauggugacgcaaauggcuaugacagacaccacccccuucgggcagcagcgggucuuuaaagagaagguugauacacgcacgcaggaaccuaaagagggaaccaagaaacugaugagaaucacagccgaauggcuguggaaggagcucggcaagaaaaagacaccccggauguguacaagagaggaguucacccggaaagugcgcuccaaugcugcccugggggcuaucuuuacagacgagaacaaguggaaaagcgccagagaagcgguggaggauucucgguucugggaacuugucgaccgcgagagaaaucugcaucucgagggaaagugcgaaaccuguguguacaacaugaugggcaaacgggagaagaagcugggcgaauuugggaaagccaagggaucccgcgcuauuugguauauguggcugggcgccagauuccucgaguuugaagcucugggguuccuuaaugaggaucacugguuuagccggggaaacucccugagcggcguugagggggaaggccuccauaaacugggauacauccuucgcgacgugucuaagaaagagggcggggccauguacgccgaugacacggcgggaugggacaccagaauuacacuggaagaucucaagaaugaggaaauggucaccaaccacaugaagggcgagcauaaaaagcuggcugaggccaucuucaaacugacauaucaaaauaaggugguucgggugcagcgcccuacccccagagggacggucauggacauuaucagccggaaagaucagcgcggauccggccagguggggacauacggccucaacaccuucacaaauauggaagcccaacugaucagacagauggagggagaaggcauuuuuaagucuauccagcggcuuaccguuacggaggagauugcugugcaaaacuggcuggccagagucgggcgcgaacggcucagcagaauggcuaucuccggagacgauugcguggucaagccgcuggacgaucgcuucgccucugcgcuuaccgcccugaaugacaugggcaaagugcggaaggauauucagcagugggagccuagcagaggguggaacgacuggacacagguucccuuuugcucccaccacuuccaugaacucgugaugaaagauggacgcguccugguggugcccugucggaaccaagacgagcugaucggcagagcucgcaucucucagggggccggcuggagccucaaggaaaccgcuugccugggaaaauccuaugcccagauguggacacuuauguacuuucaccggagagaucugcgccucgcggccaaugcuauuuguagcgccguuccuucucauugggugccgaccucccggacaaccuggagcauccacgcuaagcacgaguggaugacgacagaggacaugcuggccgucuggaacagaguguggauucaggaaaaucccuggauggaggacaagaccccuguugaaucuugggaggaagugcccuaucuuggcaaacgggaggaucaauggugcgggucccugaucggacucaccagcagagcuacaugggccaagaacauucagaccgcgaucaaucagguccgcucccugauuggcaacgaggaauacacagacuauaugccuucuaugaaacgguucagaaaggaggaagaggaagccggggugcugugguga

SEQ ID NO: 19900 - RNA, 9876 nt, Artificial Sequence
  derived and/or modified CDS sequence (opt5) from DENV-2__EU482560__SS-prME
acagccggagugaucgugaugcugauucccacaguuauggcuuuccaccucacgacccggaauggggaaccucauaugaucgugggacggcaggaaaagggcaaaagccugcuuuuuaagacagaagacgggauuaauaugugcacccugauggccaucgaucucggagaacugugugaggacacaauuaccuacaaaugcccgcuucugaagcaaaacgaacccgaggauaucgacuguuggugcaauuccacaucuaccugggugacguauggcaccuguacaaccacaggggagcaccgcagagaaaaacggagcgucgcgcucgugccucauguuggaaugggccuggagacccgcacggaaacauggauguccucugagggcgcuuggaagcacgugcagagaaucgagaccuggauucugcggcaucccggguucacaaucauggccgccauucucgcuuacaccaucggaaccacacacuuucagcgcgcccugauuuucauccuucugacggcugucgccccuagcaugaccaugagaugcauuggcaucuccaaccgggauuuuguggaagggguuucuggaggcagcuggguggacaucguccucgagcacggguccugugugacaaccauggcgaagaauaaacccacacuggauuucgaacuuauuaagaccgaggccaaacagccugcuacgcugcgcaaguauugcaucgaagccaaacucacaaacaccaccacagagagcagauguccgacccaaggagagcccucucugaaugaagaacaggacaagcgguuuauuugcaagcauuccaugguggaucgcggcuggggcaacggguguggacuguucggcaaagggggaaucgucacaugcgcuauguuuacgugcaagaaaaauauggaaggcaagguugugcagccugagaaccucgaauacaccauugugaucacaccccacagcggggaggagcaugccgucggaaaugacaccggcaaacacggcaaggaaaucaaaauuacaccucagucuuccaucaccgaggcggaacugacgggguauggaaccgugacaauggaguguagccccagaaccggccuugauuucaacgaaaugguucugcuccaaauggaggacaaggccuggcuggugcaccggcagugguuucuugaucugccgcucccuuggcugcccggggcugacacacagggaucuaauuggauucagaaggagacccuggucacguucaaaaacccucaugccaagaaacaagacgugguugugcucggcucccaggaaggggcuaugcacacagcccugaccggcgccacagagauccagaugagcuccggaaaucuucuguuuaccggccaucucaagugccgccugagaauggauaaacuucaacugaaggggaugucuuacagcauguguaccggaaaguucaaaauugucaaggaaaucgcugagacacagcacggcacgaucgugauucggguccaguaugagggggacggaucccccugcaaaauccccuucgaaauuaccgaucucgagaagagacaugugcugggccgccugaucacaguuaacccuauugugaccgaaaaagacagcccggucaacaucgaggcggaacccccuuuuggggauucuuacauuaucaucggcguggagcccggacagcucaagcugaauugguucaagaaaggcuccagcauugggcaaauguuugagacaaccaugcggggagccaagagaauggcuauccuuggcgacacggccugggauuucgggucucugggaggcguuuuuacaagcauugggaaagcccuccaccagguguucggcgcuaucuacggagccgcguuuuccggcgucucuuggaccaugaagauucugaucggggugaucauuaccuggaucggaaugaacagccgcuccacaagccugucugugucccuuguucucgucggcguggugacccuguaucugggggcuaugguccaggccgacagcggaugugugguuucuuggaaaaauaaggaacucaagugcggcuccgggauuuucaucacagauaacgugcacacguggaccgagcaguacaaauuucaaccugaaagccccuccaagcuggccucugcuauucagaaagcccaugaggaaggcaucuguggaauccggagcgucacaagacuugagaaucugauguggaagcagauuaccccggagcucaaccacauccuguccgaaaaugaggugaaacugacaauuaugaccggcgacaucaaggggauuaugcaggcuggaaaacgcucucuucggccucaacccacggaacucaaguauagcuggaagaccuggggcaaagccaagaugcuguccacagagagccauaaccagaccuuccugaucgaugggccugaaacagcggagugccccaauaccaacagagccuggaacucucucgagguugaagacuacggauuuggcguguucacaaccaacaucuggcugaaacuucgcgagaagcaggacgcuuuuugugauuccaaacugaugagcgccgcuauuaaggacaaucgggccguccacgcggauaugggcuauuggaucgaaucugcccucaacgacacguggaagauggagaaagcuagcuucauugaggucaagagcugccacuggccuaaaucucauacacuguggagcaaugggguucuggaauccgagaugaucauucccaagaacuucgccggaccggugagccagcacaaccauagaccuggcuaccacacccaaaccgcugggcccuggcaucuuggaaaacucgaaauggauuuugacuucugugagggcacaaccgucguggugacggaagauugcgggaaucgcggacccucucugcggacaaccacagccuccggcaagcugaucaccgaguggugcuguagaagcugcacacucccuccgcugcgguaucgcggcgaggacggguguugguacggaauggaaauuagaccccuuaaggagaaagaagagaaccuggucaauucccucguuaccgccggccacgggcagaucgauaacuuuucucugggagugcugggcauggcucuuuuccucgaagagaugcugcggacgagaguggggaccaagcacgcgauccugcucgucgccgugagccugguuacacuuauuaccggaaauauguccuuucgcgaccugggccgggugauggucauggugggcgcuacaaugaccgaugacaucgggaugggaguuacguaccucgcccugcuggccgcuuucaaagugagaccuacauuugccgcgggccuucugcuccgcaagcugaccucuaaagagcucaugauggcuacaauugggaucgcccugcuuagccaguccaccauucccgaaaccauccuggagcucacagaugcccuggcucugggaaugaugguccuuaagaucgugagaaacauggaaaaguaucaacuggccguuacgauuauggcgaucucuugcgugccuaaugcugucauucuccagaacgccuggaaagugagcuguaccauccuggccgcuguguccgucagcccccuccugcuuacaucuucccagcagaaggccgacuggauuccucuggcucucaccaucaaaggccugaaucccacagccaucuuccugaccacgcuuagccggacaucuaagaaacgcuccuggccgcugaacgaggcgauuauggccguugggauggugagcauccucgcuucuucccugcucaagaaugacauuccuaugaccggaccccugguggccggcggccuucugaccgucugcuacgugcugacagggagaagcgcugaucucgaacuggagcgggccgccgacguuaaaugggaggaucaagcugaaaucuccggaagcucuccuauucuuagcaucaccauuuccgaggacggcucuaugagcaucaagaacgaagaggaggaacagacacugacgauccucauucgcaccgggcugcucgugaucuccggagucuuucccgugucuauuccgaucacagcggccgcuugguaucugugggagguuaagaaacagagagccggcgugcuuugggaugucccuucucccccucccguggaaaaggccgagcuggaagacggggcuuaccggauuaaacagcgcggauuccugggcuauucccaaaucggcgccggggucuacaaggagggaaccuuucauacaauguggcacgugaccagaggcgcgguucucaugcaucgggggaaacgcaucgagcccuccugggcugaugugaagaaggaccugauuagcuauggaggcggguggaaacuugaaggagaguggaaggaaggcgaggaaguccaggugcuggcccucgagccuggcaaaaauccgagagccguucagacgaagcccgggaucuucaaaaccaacacaggaaccauuggcgcugugucccuggauuuuagcccugggacaucuggaucccccaucgucgaccggaagggcaaggugguggggcucuacggaaauggcguugucaccagaagcggcgccuacgugucugcgauugcucagacagagaaauccaucgaaaacaacccugagaucgaagaugacauuuuccgcaagaaacggcugacgaucauggaucuucaccccggggccggaaagaccaaaagauaucugccugccauugugcgcgaggcuaucaagcggggccugagaacacucauucuggccccgacccgcgucguggcugccgaaauggaggaggcgcuucgggggcugcccaucagauaccaaaccccugccauucgcgcugaacauacaggacgggagaucguugaccucaugugucacgccacguucaccaugagacugcucagccccgugcgggucccuaauuauaaccugaucauuauggacgaagcucacuuuacagaucccgccuccaucgccgcucgcggcuacauuucuaccagaguggagaugggggaggcggccggcaucuucaugacagcuaccccgccuggaagccgggaccccuuuccccaguccaaugccccuauuauggaugaagaaagagaaauccccgagagaagcuggaacucuggccaugaauggguuacggacuucaaggggaaaacagugugguuugucccuuccaucaaggccggaaaugauauugcugccugccuucggaaaaacggcaagaaagugauccagcugagcagaaagaccuucgacucugaguauguuaagacccgcgcgaaugauugggacuuuguggucacaaccgauauuagcgagaugggggcuaacuucaaagccgaacgggugaucgacccgagacgcuguaugaagcccgugauucugacagauggagaggaacgggucauccucgccggcccuaugcccguuacccacuccucugcugcccaaagacgcgggcggaucggcagaaauccuaaaaacgagaaugaccaguacauuuauaugggagaaccccuggagaacgacgaggauugcgcgcauuggaaggaagccaaaaugcuucuggacaauaucaacacgccggagggcauuaucccuagcauguuugaacccgagcgcgaaaagguggaugcuauugacggggaguacagacuccggggagaggcccgcaaaacauucguggaucugaugagacggggcgaccugccugucuggcucgcuuacaagguggccgcugaagggaucaauuaugccgaucgcaagugguguuuugacggaauuaaaaacaaccagauccuugaggaaaauguugagguggagaucuggaccaaggaaggcgagcgcaaaaagcugaaaccccgguggcuggaugcgagaauuuacuccgacccucucgcccugaaggaguucaaggaguucgcugccgggcgcaaaucucuuacacugaaccucaucaccgaaaugggccggcugcccacguuuaugacccagaaggcuagaaaugcccuggauaaccucgccguccuucacacagcugaggcgggaggccgcgccuauaaucacgcucugagcgagcugccggaaacccucgagacacugcuucugcucacccugcuggccacagugaccgggggaauuuuccucuuucuuauguccggcaaagggaucggaaagaugacgcugggcaugugcugcauuaucacagccagcauccugcucugguacgcucaaauucagccucauuggaucgccgcgucuauuauccuggaguucuuucuuauuguucugcucauccccgagcccgaaaaacagcggaccccucaggacaaccaacugaccuauguggucaucgccauucugacaguggucgcugccaccauggcuaaugagaugggcuuccucgagaagacaaagaaagaucuugggcugggauccaucacgacccaggaaagcgaguccaacauucuggacaucgaccucagaccggccucugcguggacacuguacgccguggcuaccacauuuguuacccccaugcuucggcacagcauugaaaauuccucugugaacgugagccugacggccaucgcuaaucaggccaccguccucaugggccuggggaagggauggccucuguccaaaauggauauuggcguuccccuccuugcuaucggguguuauagccaggugaacccuaucacacugaccgccgcgcugcuccugcuuguggcccauuacgcuauuaucggacccggccugcaagccaaggcuacacgcgaggcccagaaaagagccgcggcuggcauuaugaagaauccuaccgucgacgggaucacggugauugaucucgaaccgauccccuacgacccuaaguucgagaaacagcugggacagguuaugcugcucauccuuugcgugacacaaguccugaugaugcggaccacaugggcccugugugaggcucucacccuggccaccggccccauuucuacacuuugggaagggaacccuggacgcuuuuggaauacgaccaucgccguguccauggcuaacauuuucagaggcagcuaucuggccggggcgggacuccuguuuucuaucaugaagaauacaaccaacacacggcgcggcaccggcaacauuggggagacgcugggagaaaaauggaaguccagacucaaugcccuuggcaaaagcgaguuccagaucuacaagaaaucugggauccaggaggucgaucggacacuggcuaaggaaggaauuaagcgcggcgagaccgaccaccaugccgugagcagaggguccgcuaaacugcggugguuuguugaaagaaacauggugacccccgagggaaaggucguggaucucggcugcggccgcgggggauggucuuauuacuguggcgggcugaaaaauguucgggaagugaagggacuuacaaaaggcgggccgggacacgaggagccuauccccaugagcaccuauggcuggaaccuggucagacuccaauccggcguggacguguucuucacacccccugaaaagugcgauacgcugcugugugacauuggggagagcucccccaauccuaccaucgaagccggacgcacacuccggguucuuaaccuggucgagaauuggcugaacaauaacacccaguuuugcauuaaggugcucaauccguacaugcccucugugaucgagaaaauggagacacugcagagaaaguauggcggggcgcuuguccgcaacccucugagcagaaauuccacccacgagauguacuggguuucuaacgccacgggaaauaucgugagcuccgugaacaugauuucuagaaugcucaucaaccgcuucaccaugaaacauaagaaagcuacauacgaacccgaugucgaccugggcagcgggacccggaauauuggaaucgaguccgaaauuccuaaccuggauaucauuggcaagagaaucgagaagaucaaacaggaacacgagacaagcuggcauuaugaccaagaccaccccuacaagaccugggccuaucacggcucuuacgagacaaaacagaccggguccgcuagcucuauggugaauggaguugugcgccuccuuacgaagccgugggaugucgugccuaugguuacacagauggccaugaccgacaccacacccuuuggccagcaacggguguucaaagaaaaggucgauacgagaacccaggagccuaaggaagggaccaaaaagcugaugaaaauuaccgcugaguggcuguggaaggagcucggcaaaaagaaaacaccccgcguguguaccagagaagaguuuacacggaaggugcgcuccaacgccgcgcugggcgccaucuucaccgacgaaaauaaguggaaaagcgcuagagaggccgucgaagaugggcgguuuugggagcuuguugacagagagcggaaccugcaucucgaaggaaagugcgagacguguguguauaauaugaugggcaaacgcgaaaagaaacugggcgaguucgggaaggcuaagggaucuagagccauuugguacauguggcugggcgcccgguuucucgaguucgaggcgcugggguuucuuaacgaggaucacugguucucccgcggaaauagccuguccggcguggaaggggagggccuccauagacugggauauauccuucgggacgucggcaaaaaggaagggggagcuauguacgccgaugacaccgccggcugggauacacgcauuacccuggaggaccucaaaaacgaagagauggugacaaaucacaugaagggggagcauaaaaagcuggcugaagccaucuuuaagcugaccuaccagaacaaaguugugagaguccagcggccuacgccccgcggaacagugauggacaucauuagcagacgggaucaacgcggcucugggcagguuggcaccuauggacucaauacauucaccaacauggaggcucagcugaucagacaaauggaaggcgaggggauuuucaagagcauccagcaccuuacggccaccgaggaaauugcggugcagaauuggcuggcccgggucggacgcgagagacucucccggauggcuaucucuggcgacgauugcgugguuaaaccgaucgacgauagauuugccagcgcucugacagcccuuaacgacauggggaaggugcgcaaagauauucagcaaugggaaccuucccggggauggaacgacuggacccagguccccuucugcucucaccauuuucacgagcuggugaugaaggauggcagaguccucgugguucccugucgcaaucaggacgaacugaucgggcgggcgagaauuagccagggcgccggauggucccugaaggagacagcuugccucggcaaaucuuacgcccaaauguggacccugauguauuuccaucgccgggaucuuagacuggcugccaacgcuaucuguagcgccgugccuucccacugggucccgacaagccgcaccacguggucuauucacgcgaagcaugaguggaugacaaccgaagacaugcucgccguguggaaucggguguggauccaggagaaccccuggauggaagauaaaaccccuguugaguccugggaagaggugcccuaccuggggaagagagaggaccaguggugcggaagccuuauuggccugacaucucgcgcuaccugggccaaaaauauccagacagccaucucccaaguccggagccucauugggaacgaagaguauacggacuacaugccuuccaugaagagauuucggagagaagaggaagaggcuggagugcugugguga

SEQ ID NO: 19901 - RNA, 9876 nt, Artificial Sequence
  derived and/or modified CDS sequence (opt5) from DENV-2__EU482561__SS-prME
accgccggcgugaucauuaugcugauccccaccgcuauggccuuccaccucacgacccggaacggggagccucauaugauugucggacggcaggaaaagggcaagucccugcuuuuuaagaccgaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggagugcuuggcauggcccucuuccuggaagagaugcugagaacacgcgucgggaccaaacacgccaugcuccuggugguuguguccuuugucacgcuuaucaccggaaacaugucuuuccgggaccugggcagagugaugguuauggugggcgcuacaaugaccgaugacaucgggaugggaauuacauaucucgcccugcuggccgcuuuuaagguccgcccuaccuucgccgcgggccuucugcucagaaaacugacgagcaaggagcucaugauggcuacaaucgggauugcccugcuuucccagucuaccauccccgaaacaauucuggagcucaccgaugcccuggcucugggaaugauggugcuuaaaaucguucggaauauggaaaaguaccagcuggccgugaccaucauggcgauuagcugcgucccuaacgcugugauccuccaaaaugccuggaagguguccuguacaauucuggccgcugucagcguuucuccccuccugcuuacguccagccagcagaaagccgacuggaucccucuggcucucaccauuaagggccugaaccccacagccaucuuucugaccacacuuucucgcaccuccaaaaagagaagcuggccgcugaaugaggcgaucauggccguggggauggugucuauucucgcuuccagccugcucaaaaacgacaucccuaugacgggaccccuggucgccggcggccuucugacagugugcuauguucugaccgggcgguccgcugaucucgaacuggagcgcgccgccgacgugaagugggaggaucaggcugaaauuagcggaucuagcccuauccuuuccauuaccaucucugaggacggcagcauguccauuaaaaaugaagaggaggaacaaacacugaccauccucaucagaacagggcugcucgucauuucuggaguguuccccguuagcaucccgauuacggcggccgcuugguaccugugggaggugaagaagcagcgggccggcguccuuugggaugugccuucucccccucccgucgggaaagccgaacuggaggacggagcuuaucgcaucaagcagagaggcauucugggcuacagccagaucggggccggaguguauaaagaaggcaccuuucacacaauguggcauguuaccagaggggcggugcucaugcaccgcggaaagagaaucgagcccagcugggcugaugucaaaaaggaccugauuuccuacggcgggggauggaaacuugagggcgaauggaaagagggcgaagaggugcaaguucuggcccucgaaccugggaagaacccgcgggccgugcagacaaaacccggacuguucaagaccaauacgggcaccaucggggcugucagccucgauuuuucuccuggaacauccggcagccccauuguggacagaaaagggaaggugguuggacuguacggcaacggcgucgugacccgcucuggggccuauguguccgcgaucgcucagacagaaaagagcauugaggauaauccugaaaucgaggacgauaucuuccggaaaaagagacuuaccauuauggaccugcaucccggagccggcaaaacaaagcgcuaccugccugccaucguccgggaagcuauuaaaagagggcuccgcacgcugauccuugccccgacccgggugguugcugccgagauggaagaggcgcugagaggacuccccauucgcuaucagaccccugcgauccgggcugagcacaccggcagagaaauuguggaccugaugugucaugccaccuucacaaugcggcuccugucccccguccgcgugccuaacuacaaccuuaucaucauggaugaggcucacuuuacggaccccgccucuauugccgcuagaggguauaucagcacccggguugaaaugggcgaggcggccggaauuuucaugacagcuaccccgccuggcucccgcgaucccuuuccccaaagcaaugccccuaucauggacgaggaaagagagauucccgaacggucuuggaacuccgggcacgagugggugacagauuucaagggaaagaccgucugguuugugccuagcaucaaagccggcaaugacaucgcugccugccugagaaagaacgggaaaaagguuauucagcugucucgcaaaacguucgauagcgaauacgugaagacacgggcgaaugacugggauuuugucgugaccaccgacaucuccgagaugggagcuaacuucaaggccgagagagugauugauccgcgccgguguaugaaacccgucauccucacagacggcgaagagagaguuauucuggccgggccuaugcccgugacccauucuagcgcugcccagcgccggggcagaaucggacgcaauccuaagaacgaaaaugaccaauauaucuacaugggcgagccccuugaaaacgaugaggacugcgcgcacuggaaagaggccaagaugcugcucgauaauauuaacacaccggaagggaucauuccuuccauguuugagcccgaaagagagaaaguggacgcuaucgauggagaauaccggcugcgcggcgaggccagaaagaccuucgucgaccugaugcggcgcggggaucucccuguguggcuugcuuauagaguugccgcugagggaauuaauuacgccgaccggagaugguguuuugauggcaucaaaaacaaucagauucuggaagagaacguggaagucgagaucuggacgaaggagggggaacgcaagaaacugaagccccgguggcucgacgcgagaaucuauucugauccucuggcccuuaaagaguucaaggaguucgcugccggccgcaaaagccugacacucaaccugauuaccgagaugggacggcugcccacauuuaugacccagaaggcuagagacgcccucgauaaucuugccgugcugcauacggcugaagcgggcgggcgggccuacaaccacgcucuguccgagcucccggagacccuggaaacacuucugcuccugacccugcucgccacaguuaccggaggcaucuuccuuuuucugaugagcgggaagggaauuggcaaaaugacacugggcaugugcugcaucauuaccgccucuauccuccugugguaugcucagauccaaccucacuggauugccgcguccaucauucuugaguucuuucugaucgugcuccugauucccgaacccgagaagcagcgcacgccucaggacaaucagcugacauacgucgugaucgccauccucaccgucguggcugccaccauggcuaacgaaaugggguuccuugagaaaacaaagaaagaccugggacugggcagcauugccacccaagaguccgaaucuaauauccucgauauugaccugagaccggcgagcgccuggacacuuuaugcuguugccacgaccuuugugacacccaugcugcggcauuccaucgagaacucuagcgugaaugucucccucaccgcuauugccaaccaggcuacaguucugauggggcugggaaagggcuggccucucagcaagauggauaucggggugccccuucuggccauuggauguuacucucaggugaauccuaucacccugacggcggcccuccugcuucuggucgcucacuacgccaucauuggccccggccuccaggcuaaagccacccgcgaagcccaaaagagagcggcugccgggaucaugaaaaacccuacaguggacggaauuaccguuaucgaucuggagccgauucccuaugacccuaaguucgaaaaacagcugggccaggugaugcuccuuauccugugcgucacacaggugcugaugaugcggaccacgugggcucucugugaggcccugacacuugccaccgggcccaucuccacacugugggagggaaauccuggccgcuuuuggaacaccaccauugcugucagcauggccaauaucuucagagggucuuaccucgcgggagccggccugcuguuuuccauuaugaagaacacaacgaauacccggcgcggcacagggaacaucggagaaacccucggcgagaaguggaaaagcagacuuaaugcucuggggaagucugaguuccaaauuuauaaaaagagcggaauccaggagguggaucggacacuggccaaagagggcaucaagagaggggaaaccgaccaucacgcuguuucccgcggaucugccaaacuccggugguuuguggagagaaacauggucacgcccgaaggcaaggugguugaucugggcugcgggcgcggaggcuggagcuacuauugugggggacuuaagaacgugcgggaggucaaaggccugacaaaagggggaccgggccaugaagaaccuauucccauguccaccuacggcuggaaucucgugagacugcagagcgggguggacguuuucuucacacccccugagaaaugcgauacacugcucugugacaucggagaauccucucccaacccuaccauugaggcgggccgcacacuucggguccugaaucugguggaaaacuggcucaauaacaauacgcaauuuugcaucaaggugcugaacccguauaugcccagcgucauugagaaaauggaaacccuucagagaaaguacgggggagcccugguucgcaauccucucucccggaacucuacacacgagauguacugggugagcaaugcuaccggcaacaucguguccucugucaauaugaucagcagaaugcugauuaaccgcuucacaaugaagcacaaaaaggccaccuaugagcccgauguggaccugggguccggaacgcggaauaucggcauugaaagcgagaucccuaaccucgacauuaucggcaaaagaauugaaaagaucaaacaggagcaugaaaccucuuggcacuacgaucaggaccaucccuauaagacaugggcuuaccacggguccuaugagaccaagcaaacaggaagcgccucuuccaugguuaacggcgugguccgccuucugaccaaaccgugggaugugguuccuauggugacacagauggcuaugaccgacacgacacccuuugggcagcagagagucuucaaggagaaaguggauacccggacccaagaaccuaaggagggaaccaagaagcugaugaagaucacggccgaauggcucuggaaagagcugggcaagaaaaagacaccccgcauguguacaagagaggaauuuacccggaaagugagaagcaaugcggcccuuggggcuauuuucacagacgagaacaaguggaaaucugcccgggaagcugucgaggauucccgcuuuugggaacugaucgacagagagcggaaucuccaccuggagggaaagugcgaaaccuguguuuacaacaugaugggcaagcgcgagaaaaagcugggcgaguucgggaaagccaagggaagcagagccauuugguauauguggcucggcgcgcgguuucuggaguucgaagcucuuggguuucugaaugaggaucauugguucucccgcggaaacagccucucuggcguggagggggaaggccugcacagacuuggauacauccugcgggacgugagcaaaaaggagggcggggccauguacgccgaugacacagcuggaugggacacccgcauuacgcucgaagaucugaagaaugaggaaauggucaccaaccauaugaaaggcgagcacaagaaacuggccgaggcuaucuuuaagcucacauaucagaauaaagugguuagagugcagcggccuacaccccgcgggacagucauggacaucauuuccagacgggaucagcgcggaucuggccaaguggggaccuacggccugaacacguucacaaauauggaagcccagcuuaucagacagauggagggagaaggcauuuucaagagcauccaacaucugaccguuacagaggagauugcggugcagaacuggcucgcccgggucgggagagaacgccugucccggauggcuaucucuggagacgauugcgugguuaagccgcuugacgauagauuugccagcgcucugaccgcccucaaugacaugggcaaagugcgcaaggauauccagcagugggagccuucccggggguggaacgacuggacgcaaguccccuucugcucucaccacuuucaugaacugauuaugaaagauggaagagugcuggucgugcccugucgcaaucaggacgagcucaucggccgggcgagaauuagccagggggccggcuggucccugaaggaaaccgcuugccuuggaaaaagcuaugcccagauguggacacugauguacuuccaccgccgggaucucagacuggcugccaacgcuaucuguucugccguuccuucccauugggugccgaccagccgcacaaccuggucuauucacgcgaagcacgaguggaugacaaccgaggacaugcuugccgucuggaaccggguguggauccaagaaaaucccuggauggaggacaagacgccuguggaauccugggaggaaguucccuaucugggcaaaagagaggaucaguggugcgggagccucauuggacugacaucccgggcuaccugggccaagaacauccagaccgccaucaaucaggugagaucucugauuggcaacgaggaauacacagacuauaugccuagcaugaaacgcuuucggagagaggaagaggaagcugggguccucugguga

SEQ ID NO: 19902 - RNA, 9876 nt, Artificial Sequence
  derived and/or modified CDS sequence (opt5) from DENV-2__EU569703__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacacacacugaccauccucaucagaacagggcugcucgugauuucuggaguuuuccccgugagcaucccgauuacggcugcggccugguaccugugggaggucaagaagcaacgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccauacaauguggcacgugaccagaggggccguccugaugcaucgcggaaagagaaucgagcccagcugggcggaugugaaaaaggaccucauuuccuacggcgggggauggaagcuggagggcgaauggaaagagggcgaagagguucaggugcuugcucuggaaccugggaagaauccgcgggccguccaaacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaccccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcauaccggcagagaaauugucgaccucaugugucacgcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccagagcaacgcuccuaucauggacgaggaaagagagauucccgaacggucuuggaacuccgggcaugagugggucacagauuuuaagggaaagaccgugugguucguuccuagcaucaaagccggcaacgacaucgccgcuugccuuagaaagaaugggaaaaaggugauucaacugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccacucuagcgccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccaaauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucacacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccagccucauuggauugccgcuuccaucauucuggaguuuuuccuuaucgugcugcucauucccgaacccgagaaacaaagaacgccucaggacaaccagcugacauacgucgugaucgccauccugaccguuguggcggccaccauggcuaaugaaaugggguuucucgagaagaccaagaaggaccuuggacugggcagcauuaccacacaggaguccgaaucuaacauccuggauauugaccuccggccggccagcgcuuggacgcuguaugccguggcgaccacauucgucacccccaugcuucgccacuccaucgaaaauucuagcguuaacgugucccugacagccauugcuaaucaagccaccgugcucauggggcugggaagaggcuggccucugagcaaaauggauaucggggucccccuccuugcuauuggauguuacucucaggugaacccuaucacgcugaccgccgcucugcuccugcuuguugcccauuacgcgaucauuggccccggccugcaggccaaggcuacacgggaagcccagaagcgcgcugccgccgggaucaugaaaaauccuaccguggacggaauuacagucaucgaucucgagccgauucccuaugacccuaaguuugaaaaacaacugggccaggugaugcugcucguccuuugcgugacccagguucugaugaugagaacgacaugggcgcugugugaggcucucacccuggccacagggcccaucuccacccuuugggagggaaacccuggccgguucuggaauaccacaaucgcugugagcauggccaacauuuuucgcgggucuuaccuggccggagcuggccuccuguucuccaucaugaagaauacgaccaacacaagacggggcaccgggaauauuggagaaacacugggcgagaaauggaaaagcagacucaacgcccuugggaagucugaauuucagaucuauaaaaagagcggcauucaagaggucgaucgcacccuggcgaaagagggcaucaagagaggggaaacggaccaccaugccguguccagaggaucugcuaaacugcgcugguucguugagcggaacauggugacacccgaaggcaaggucguggaucucggcugcgggagaggaggcuggagcuacuauugugggggacugaaaaaugugcgcgagguuaagggccuuaccaaagggggaccgggccacgaggagccuauccccauguccaccuacggcuggaaccugguccggcuccagagcgggguggacguguucuuuacacccccugagaaaugcgauacccugcugugugacauuggagaauccucucccaauccuacaaucgaggccggcagaacgcuccgcguccuuaaccugguugaaaauuggcugaacaauaacacccaguucugcauuaaggugcucaauccguauaugcccagcgugaucgagaaaauggaaacacugcaacggaaguacgggggagcucuugucagaaacccucugucccgcaauucuacccacgagauguacugggugagcaacgccacaggcaauauuguuuccucugugaacaugaucagccggaugcucaucaauagauuuaccaugaaacauaagaaggcgacguaugagcccgaugucgaccugggguccggaacccgcaacauuggcaucgaaaacgagauuccuaaucuggacaucauuggcaaaagaaucgaaaagauuaaacaggagcacgaaacaagcuggcauuacgaucaggaccaccccuauaagaccugggccuaccacgggucuuaugagacaaaacagaccggauccgcuagcucuauggugaacggcguugugcggcuccuuacaaagccgugggaugucgugccuauggugacccaaauggccaugacggacacaacccccuucgggcagcagcgcgucuuuaaggagaaaguugauaccagaacacaggaaccuaaggagggaacgaaaaagcugaugcggaucaccgcugaauggcuguggaaagagcucggcaagaagaaaacacccagaauguguacccgggaggaguucacacgcaaggugagauccaaugccgcucugggggccaucuuuaccgacgagaacaaauggaaaagcgcgcgggaagccguggaggauucucgcuucugggaacuugucgacagagagcggaaucugcaucucgagggaaaaugcgaaacauguguguacaacaugaugggcaagcgcgagaaaaagcugggcgaauuugggaaggcuaaaggauccagagccauuugguauauguggcugggcgcucgguuccucgaguuugaagcccugggguuccuuaaugaggaucacugguuuagccgcggaaacucccugagcggcguugagggggaaggccuccauaagcugggauacauccuuagagacgugucuaaaaaggagggcggggccauguacgcggaugacaccgcuggaugggacacgcggauuacccuggaagaucucaaaaaugaggaaauggucacaaaccacaugaagggcgagcauaagaaacuggccgaggccaucuucaagcugaccuaucaaaauaaagugguucgcgugcagagaccuacaccccgggggaccgucauggacauuaucagccgcaaggaucagagaggauccggccagguggggacguacggccucaacacauucaccaauauggaagcucaacugauccggcagauggagggagaaggcauuuuuaaaucuauccagagacuuacaguuaccgaggagauugccgugcaaaacuggcuggcucgcgucgggcgggaaagacucagccgcauggccaucuccggagacgauugcguggucaagccgcuggacgaucgguucgcgucugcccuuacggcucugaaugacaugggcaaggugagaaaagauauucagcagugggagccuagccgcggguggaacgacuggacccagguucccuuuugcucccaccacuuccaugaacucgugaugaaggauggacggguccugguggugcccuguagaaaccaagacgagcugaucggccgcgcccggaucucucagggggcuggcuggagccucaaagaaacagccugccugggaaaguccuaugcgcagauguggacccuuauguacuuucacagacgcgaucugcggcucgccgcuaaugccauuuguagcgcuguuccuucucauugggugccgacauccagaaccacauggagcauccacgccaaacacgaguggaugaccacggaggacaugcuggcugucuggaaccggguguggauucaggaaaaucccuggauggaggacaagacaccuguugaaucuugggaggaagugcccuaucuuggcaagagagaggaucaauggugcgggucccugaucggacucaccagccgcgccaccugggcgaaaaacauucagacagccaucaaucagguccggucccugauuggcaacgaggaauacaccgacuauaugccuucuaugaagagauuccgcaaagaggaagaggaagcuggggugcugugguga

SEQ ID NO: 19903 - RNA, 9876 nt, Artificial Sequence
  derived and/or modified CDS sequence (opt5) from DENV-2__EU529694__SS-prME
accgccggcguguucaucaugcugauucccaccgcuauggccuuucaccucacgacccggaacggggagccucauaugaucgucggacggcaggaaaagggcaagucccugcuuuucaagaccgaggacgggguuaauaugugcacccugauggcgauggaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggauugagaccuggauccugcgccaucccggguuuacaaucauggccgcuauucucgccuacaccaucggaaccacacacuuccagagagcucugauuuuuauccuucugacggccguggcgccuagcaugaccaugcggugcauuggcaucuccaaccgcgauuucgucgaaggggugucuggaggcagcuggguugacauugugcucgagcacggguccugugucacaaccauggccaagaauaagcccacacuggauuuugaacuuaucaaaaccgaggcuaagcagccugccacgcugagaaaauauugcaucgaagcuaagcucacaaacaccaccacagagagccgguguccgacccaaggagagcccucucugaaugaagaacaggacaaacgcuucgugugcaagcauuccaugguggauagaggcuggggcaacggguguggacuguuuggcaaagggggaauugucacaugcgccauguucacgugcaaaaagaauauggaaggcaaaguugugcucccugagaaccuggaauacaccaucgugauuacaccccacagcggggaggagcaugcggucggaaaugacaccggcaagcacggcaaagaaaucaagauuacaccucagucuuccaucaccgaggccgaacuuacgggguauggaaccgugacaauggaguguagcccccggaccggccuggauuuuaacgaaaugguucuccugcagauggaggacaaggcuuggcuugugcaccgccaaugguuccuggaucucccgcugccuuggcugcccggggccgacacacagggaucuaauuggauccagaaggagacccucgucacguuuaagaacccucaugcuaaaaagcaggacgugguugugcugggcucccaagaaggggccaugcacacagcccuuaccggcgcuacagagauucagaugagcuccggaaaucuccuguucaccggccaucugaaaugcagacuucggauggauaagcugcagcucaaagggaugucuuacagcauguguaccggaaaguucaagaucgucaaagaaauugcggagacacaacacggcacgaucgugauuagaguccaguaugagggggacggaucccccugcaagauccccuuugaaaucauggaucuggagaaacgccaugugcugggccggcucauuaccguuaacccuaucguggccgaaaaggacagcccggucaacauugaggcugaacccccuuucggggauucuuacaucauuaucggcguggagcccggacagcugaaacuuaauugguuuaagaagggcuccagcauugggcagauguucgagacaaccaugagaggagccaaacgcauggccauccugggcgacacagcuugggauuuugggucucucggaggcguuuucaccagcaucgggaaggcccugcaccaaguguuuggcgcgauuuacggagcugccuucuccggcgucucuuggacgaugaaaauccugauuggggugaucauuacauggaucggaaugaacagccgguccaccagccuuucugugucccucguucuggucggcguggugacccuguaucucggggccaugguccaggcugacagcggaugugugguuucuuggaaguccaaagaacugaagugcggcagcgggaucuuuauuacagauaaugugcacaccuggacagagcaguacaaguuccagccugaaucccccucuaaacuugccagcgcuauccaaaaggcccaugaggaaggcauuuguggaaucagauccgucacgcgccuggagaaccucauguggaaacagauuaccccggagcugaaucacauccugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuucucauugaugggccugaaacagcugagugccccaacaccaaucgcgccuggaacucccuggagguugaagacuacggauucggcguguuuacaaccaauaucuggcuuaagcugcgggagaaacaggacgucuucugugauagcaagcucaugucugcugccauuaaagacaacagagcggugcacgccgauaugggcuauuggaucgaauccgcucugaaugacacauggaagauggagaaggccagcuucaucgagguuaaaucuugccacuggccuaagagccauacccugugguccaacggggugcuugaaagcgagaugauuauccccaaaaauuuugcuggaccggucucucagcacaacuaccgcccuggcuaucauacgcagacagccgggcccuggcaccucggaaagcuggaaauggauuucgacuuuugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuucagccugggagugcuuggcauggcgcucuuucuggaagagaugcugagaacacgcgucgggaccaaacacgccaugcuccugguggcuguuuccuucgugacgcuuaucaccggaaacaugucuuuucgggaccugggcagagucauggugaugguuggcgccacaaugaccgaugacauugggaugggaaucacauaucucgcccugcuggcugccuucaaggugcgcccuaccuuugcggcuggccuucugcucagaaaacugacgagcaaggagcucaugauggccacaaucgggauugcccugcuuucccagucuaccauccccgaaacaauucuggagcucaccgaugcucuggcccugggaaugaugguccuuaaaaucgugcggaauauggaaaaguaccagcuggcgguuaccauuauggcuaucagcugcgugccuaacgccgucauccuccaaaaugccuggaagguguccuguacaauucuggcugccgugagcgucucuccccuccugcuuacguccagccagcagaaagcugacuggaucccucuggcccucaccauuaagggccugaaccccacagcgaucuuccugaccacacuuucucgcaccuccaaaaagagaagcuggccgcugaaugaggccauuauggcuguugggauggugucuauccucgccuccagccugcucaaaaacgacaucccuaugacgggaccccugguggcuggcggccuucugacagucugcuaugugcugaccgggcgguccgccgaucucgaacuggagcgcgccgcugacguuaagugggaggaucaggcggaaauuagcggaucuagcccuauccuuuccauuaccaucucugaggacggcagcauguccauuaaaaaugaagaggaggaacaaacacugaccauccucauuagaacagggcugcucgugaucucuggagucuuucccgugagcaucccgauuacggccgcugccugguaccugugggagguuaagaagcagcgggccggcgugcuuugggaugucccuucucccccucccguggggaaagcugaacuggaggacggagccuaucgcaucaagcagagaggcauucugggcuacagccagaucggggcgggagucuauaaagaaggcaccuuccacacaauguggcaugugaccagaggggcuguucucaugcaccgcggaaagagaauugagcccagcugggccgaugugaaaaaggaccugaucuccuacggcgggggauggaaacuugagggcgaauggaaagagggcgaagagguccaagugcuggcccucgaaccugggaagaacccgcgggcuguucagacaaaacccggacuguuuaagaccaauacgggcaccaucggggccgugagccucgauuucucuccuggaacauccggcagccccauugucgacagaaaagggaagguggugggacuguacggcaacggcguugucacccgcucuggggcguauguguccgcuaucgcccagacagaaaagagcauugaggauaauccugaaaucgaggacgauauuuuccggaaaaagagacuuaccaucauggaccugcaucccggagccggcaaaacaaagcgcuaccugccugcuaucgugcgggaagccauuaaaagagggcuccgcacgcugauccuugcuccgacccgggucguggccgcggagauggaagaggcccugagaggacuccccauucgcuaucagaccccugcuauccgggccgagcacaccggcagagaaauuguugaccugaugugucaugcuaccuuuacaaugcggcuccugucccccgugcgcgucccuaacuacaaccuuaucauuauggaugaggcccacuucacggaccccgccucuaucgcugcgagaggguauaucagcacccggguggaaaugggcgaggccgcuggaauuuuuaugacagccaccccgccuggcucccgcgaucccuucccccaaagcaaugccccuaucauggacgaggaaagagagauucccgaacggucuuggaacuccgggcacgaguggguuacagauuuuaagggaaagaccgugugguucgucccuagcaucaaagcuggcaaugacauugccgcgugccugagaaagaacgggaaaaaggugauccagcugucucgcaaaacguuugauagcgaauacguuaagacacgggcuaaugacugggauuucguggucaccaccgacaucuccgagaugggagccaacuuuaaggccgagagagugauugauccgcgccgguguaugaaacccgugauccucacagacggcgaagagagagucauucuggcugggccuaugcccguuacccauucuagcgccgcgcagcgccggggcagaaucggacgcaauccuaagaacgaaaaugaccaauauauuuacaugggcgagccccuugaaaacgaugaggacugcgcccacuggaaagaggcuaagaugcugcucgauaauaucaacacaccggaagggaucauuccuuccauguucgagcccgaaagagagaaaguggacgccaucgauggagaauaccggcugcgcggcgaggcuagaaagaccuuuguggaccugaugcggcgcggggaucucccugucuggcuugccuauagaguggcugccgagggaauuaauuacgcggaccggagaugguguuucgauggcaucaaaaacaaucagauucuggaagagaacguugaaguggagaucuggacgaaggagggggaacgcaagaaacugaagccccgguggcucgacgccagaauuuauucugauccucuggcucuuaaagaguucaaggaauuugccgcuggccgcaaaagccugacacucaaccugaucaccgagaugggacggcugcccacauucaugacccagaaggccagagacgcccucgauaaucuugcuguccugcauacggcggaagccggcgggcgggcuuacaaccacgcccuguccgagcucccggagacccuggaaacacuucugcuccugacccugcucgccacagugaccggaggcaucuuucuuuuccugaugagcgggaagggaauuggcaaaaugacacugggcaugugcugcaucauuaccgcuucuauccuccugugguaugcccagauucaaccucacuggaucgcggccuccaucauucuugaguuuuuccugaucguucuccugauucccgaacccgagaagcagcgcacgccucaggacaaucagcugacauacguggucaucgcuauucucaccguggucgccgcuaccauggccaacgaaaugggguuucuugagaaaacaaagaaagaccugggacugggcagcaucgcgacccaagaguccgaaucuaauauccucgauauugaccugagaccggccagcgcuuggacacuuuaugccguggcuacgaccuucguuacacccaugcugcggcauuccaucgagaacucuagcgugaaugugucccucaccgccauugcuaaccaggccacaguccugauggggcugggaaagggcuggccucucagcaagauggauaucgggguuccccuucuggcgauuggauguuacucucaggugaauccuaucacccugacggccgcucuccugcuucugguggcccacuacgcuauuaucggccccggccuccaggccaaagccacccgcgaagcgcaaaagagagcugccgcugggaucaugaaaaacccuacagucgacggaauuaccgugaucgaucuggagccgauucccuaugacccuaaguuugaaaaacagcugggccagguuaugcuccuuauccugugcgugacacagguccugaugaugcggaccacgugggcccucugugaggcccugacacuugcuaccgggcccauuuccacacugugggagggaaauccuggccgcuucuggaacaccaccaucgccgugagcauggcgaauaucuuuagagggucuuaccucgccggagcuggccugcuguucuccauuaugaagaacacaacgaauacccggcgcggcacagggaacaucggagaaacccucggcgagaaguggaaaagcagacuuaaugcccuggggaagucugaauuucaaauuuauaaaaagagcggaauccaggaggucgaucggacacuggcuaaagagggcauuaagagaggggaaaccgaccaucacgccgugucccgcggaucugcgaaacuccggugguucguugagagaaacauggugacgcccgaaggcaaggucguggaucugggcugcgggcgcggaggcuggagcuacuauugugggggacuuaagaacguucgggaggugaaaggccugacaaaagggggaccgggccaugaggagccuauccccauguccaccuacggcuggaaucucgucagacugcagagcgggguggacguguucuuuacacccccugagaaaugcgauacacugcucugugacaucggagaauccucucccaacccuaccauugaggccggccgcacacuucggguucugaaucuggucgaaaacuggcucaauaacaauacgcaauucugcaucaaggugcugaacccguauaugcccagcgugauugagaaaauggaaacccuucagagaaaguacgggggagcucugguccgcaauccucucucccggaacucuacacacgagauguacuggguuagcaaugccaccggcaacaucguguccucugugaauaugauuagcagaaugcugaucaaccgcuuuacaaugaagcacaaaaaggcuaccuaugagcccgaugucgaccugggguccggaacgcggaauaucggcauugaaagcgagaucccuaaccucgacauuaucggcaaaagaauugaaaagaucaaacaggagcaugaaaccucuuggcacuacgaucaggaccaucccuauaagacaugggccuaccacggguccuaugagaccaagcaaacaggaagcgcuucuuccauggugaacggcguugugcgccuucugaccaaaccgugggaugucgugccuaugguuacacagauggccaugaccgacacgacacccuucgggcagcagagaguguuuaaggagaaagucgauacccggacccaagaaccuaaggagggaaccaagaagcugaugaagauuacggcggaauggcucuggaaagagcugggcaagaaaaagacaccccgcauguguacaagagaggaguucacccggaaagugagaagcaaugccgcucuuggggccaucuuuacagacgagaacaaguggaaaucugcucgggaagccguggaggauucccgcuucugggaacugaucgacagagagcggaaucuccaccuggagggaaagugcgaaaccugugucuacaacaugaugggcaagcgcgagaaaaagcugggcgaauuugggaaagccaagggaagcagagcgauuugguauauguggcucggcgcucgguuccuggaguuugaagcccuuggguuccugaaugaggaucauugguuuucccgcggaaacagccucucuggcguugagggggaaggccugcacagacuuggauacauccugcgggacgugagcaaaaaggagggcggggccauguacgcugaugacacagccggaugggacacccgcauuacgcucgaagaucugaagaaugaggaaauggugaccaaccauaugaaaggcgagcacaagaaacuggcugaggccaucuucaagcucacauaucagaauaaagucgugagaguucagcggccuacaccccgcgggacagugauggacauuaucuccagacgggaucagcgcggaucuggccaagucgggaccuacggccugaacacguucacaaauauggaagcgcagcuuaucagacagauggagggagaaggcauuuuuaagagcauccaacaucugaccgugacagaggagauugccguucagaacuggcucgcucggguggggagagaacgccugucccggauggccaucucuggagacgauugcgucgugaagccgcuugacgauagauucgcuagcgcccugaccgcgcucaaugacaugggcaaaguucgcaaggauauucagcagugggagccuucccggggguggaacgacuggacgcaagugcccuuuugcucucaccacuuccaugaacuggucaugaaagauggaagagugcuggucgugcccugucgcaaucaggacgagcucaucggccgggccagaaucagccagggggcuggcuggucccugaaggaaaccgccugccuuggaaaaagcuaugcucagauguggacacugauguacuuucaccgccgggaucucagacuggccgcuaacgccauuuguucugcgguuccuucccauugggugccgaccagccgcacaaccuggucuauccacgccaagcacgaguggaugacaaccgaggacaugcuugcugucuggaaccggguguggauucaagaaaaucccuggauggaggacaagacgccuguggaauccugggaggaaguucccuaucugggcaaaagagaggaucaguggugcgggagccucaucggacugacaucccgggccaccugggccaagaacauucagaccgcuaucaaucaggugagaucucugauuggcaacgaggaauacacagacuauaugccuagcaugaaacgcuuccggagagaggaagaggaagccgggguccucugguga

SEQ ID NO: 19904 - RNA, 9876 nt, Artificial Sequence
  derived and/or modified CDS sequence (opt5) from DENV-2__EU529695__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacaaacacugaccauccucaucagaacagggcugcucgugauuucuggaguuuuccccgugagcaucccgauuacggcugcggccugguaccugugggaggucaagaagcagcgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccacacaauguggcaugugaccagaggggccguccugaugcaccgcggaaagagaaucgagcccagcugggcggaugugaaaaaggaccucauuuccuacggcgggggauggaagcuggagggcgaauggaaagagggcgaagagguucaagugcuugcucuggaaccugggaagaauccgcgggccguccagacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaucccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcacaccggcagagaaauugucgaccucaugugucaugcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccaaagcaacgcuccuaucauggacgaggaaagagagauucccgaacggucuuggaacuccgggcacgagugggucacagauuuuaagggaaagaccgugugguucguuccuagcaucaaagccggcaacgacaucgccgcuugccuuagaaagaaugggaaaaaggugauucagcugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccauucuagcgccgcucagcggagaggccgcaucggaagaaacccuaaaaaugaaaacgaccaauauaucuacaugggcgagccccuggaaaaugaugaggacugcgcccacuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccagauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucauacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccaaccucacuggauugccgcuuccaucauucuggaguuuuuccuuaucgugcugcucauucccgaacccgagaaacagagaacgccucaggacaaccagcugacauacgucgugaucgccauccugaccguuguggcggccaccauggcuaaugaaaugggguuucucgagaagaccaagaaggaccuuggacugggcagcauuaucacccaagaguccgaaucuaacauucuggauaucgaccuccggccggccagcgcuuggacacuguaugccguggcgacgaccuucgucacacccaugcuucgccauuccauugaaaauucuagcguuaacgugucccugaccgccaucgcuaaucaggccacagugcucauggggcugggaagaggcuggccucugagcaaaauggauauuggggucccccuccuugcuaucggauguuacucucaggugaacccuaucacccugacggccgcucugcuccugcuuguugcccacuacgcgauuaucggccccggccugcaggccaaggcuacccgggaagcccaaaagcgcgcugccgccgggauuaugaaaaauccuacaguggacggaaucaccgucauugaucucgagccgauccccuaugacccuaaguuugaaaaacagcugggccaggugaugcugcucguccuuugcgugacacagguucugaugaugagaaccacgugggcgcugugugaggcucucacacuggccaccgggcccaucuccacacuuugggagggaaacccuggccgguucuggaauaccaccauugcugugagcauggccaacaucuuucgcgggucuuaccuggccggagcuggccuccuguucuccauuaugaagaauacaacgaacaccagacggggcacagggaauaucggagaaacccugggcgagaaauggaaaagcagacucaacgcccuugggaagucugaauuucaaauuuauaaaaagagcggaauccaggaggucgaucgcacacuggcgaaagagggcaucaagagaggggaaaccgaccaucacgccguguccagaggaucugcuaaacugcgcugguucguugagcggaacauggugacgcccgaaggcaaggucguggaucucggcugcgggagaggaggcuggagcuacuauugugggggacugaaaaaugugcgcgagguuaagggccuuacaaaagggggaccgggccaugaggagccuauucccauguccaccuacggcuggaaccugguccggcuccagagcgggguggacguguucuuuacacccccugagaaaugcgauacacugcugugugacaucggagaauccucucccaauccuaccauugaggccggcagaacacuccgcguccuuaaccugguugaaaauuggcugaacaauaacacgcaauucugcaucaaggugcucaauccguauaugcccagcgugauugagaaaauggaaacccugcagcggaaguacgggggagcucuugucagaaacccucugucccgcaauucuacacacgagauguacugggugagcaacgccaccggcaauaucguuuccucugugaacaugaucagccggaugcucauuaauagauuuacaaugaaacacaagaaggcgaccuaugagcccgaugucgaccugggguccggaacgcgcaacaucggcauugaaaacgagaucccuaaucuggacauuaucggcaaaagaauugaaaagaucaaacaggagcaugaaaccagcuggcacuacgaucaggaccaucccuauaagacaugggccuaccacgggucuuaugagaccaaacaaacaggauccgcuagcucuauggugaacggcguugugcggcuccuuaccaagccgugggaugucgugccuauggugacacagauggccaugaccgacacgacacccuucgggcagcagcgcgucuuuaaggagaaaguugauaccagaacccaagaaccuaaggagggaaccaagaagcugaugcggaucacggcugaauggcuguggaaagagcucggcaagaagaaaacccccagaauguguacacgggaggaguucacccgcaaggugagauccaaugccgcucugggggccauuuuuacagacgagaacaaauggaaaagcgcgcgggaagccguggaggauucucgcuucugggaacuugucgacagagagcggaaucugcaccucgagggaaaaugcgaaaccuguguguacaacaugaugggcaagcgcgagaaaaagcugggcgaauuugggaaggcuaaaggauccagagccaucugguauauguggcugggcgcucgguuccucgaguuugaagcccugggguuccuuaaugaggaucauugguuuagccgcggaaacucccugagcggcguugagggggaaggccuccacaagcugggauacauucuuagagacgugucuaaaaaggagggcggggccauguacgcggaugacacagcuggaugggacacccggaucacgcuggaagaucucaaaaaugaggaaauggucaccaaccauaugaagggcgagcacaagaaacuggccgaggccauuuucaagcugacauaucagaauaaagugguucgcgugcagagaccuacaccccgggggacagucauggacaucaucagccgcaaggaucagagaggauccggccaaguggggaccuacggccucaacacguucacaaauauggaagcucagcugauucggcagauggagggagaaggcaucuuuaaaucuauucaacaucuuaccguuacagaggagaucgccgugcagaacuggcuggcuagagucgggcgcgaacggcucagcagaauggccauuuccggagacgauugcguggucaagccgcuggacgaucgcuucgcgucugcccuuaccgcucugaaugacaugggcaaggugcggaaagauauccagcagugggagccuagcagaggguggaacgacuggacgcaaguucccuuuugcucccaccacuuccaugaacucgugaugaaggauggacgcguccugguggugcccugucggaaccaggacgagcugaucggcagagcccgcauuucucagggggcuggcuggagccucaaagaaaccgccugccugggaaaguccuaugcgcagauguggacacuuauguacuuucaccggagagaucugcgccucgccgcuaaugccaucuguagcgcuguuccuucucauugggugccgaccucccggacaaccuggagcauucacgccaaacacgaguggaugacaaccgaggacaugcuggcugucuggaacagaguguggauccaagaaaaucccuggauggaggacaagacgccuguugaaucuugggaggaagugcccuaucuuggcaagcgggaggaucaguggugcgggucccugauuggacucacaagcagagccaccugggcgaaaaacauccagaccgccauuaaucagguccgcucccugaucggcaacgaggaauacacagacuauaugccuucuaugaagcgguucagaaaagaggaagaggaagcuggggugcugugguga

SEQ ID NO: 19905 - RNA, 9876 nt, Artificial Sequence
  derived and/or modified CDS sequence (opt5) from DENV-2__EU482562__SS-prME
acagccggcgugaucauuaugcugauccccacagcuauggccuuccaccucacgacccggaacggggagccucauaugauugucggacggcaggaaaagggcaagucccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugauccuguaucucggggccaugguccaggccgacagcggaugugugguuucuuggaaguccaaagaacugaagugcggcagcgggauuuucaucacagauaaugugcacaccuggacagagcaguacaaguuucagccugaaucccccucuaaacuugcuagcgccauucaaaaggcucaugaggaaggcaucuguggaaucagauccgucacgcgccuggagaaccucauguggaaacagauuaccccggagcugaaucacauccugucugaaaacgaggugaaacuuacaauuaugaccggcgacaucaaagggauuaugcaggccggaaagcggagccucagaccucagcccacagaacugaaauauuccuggaagaccuggggcaaggcgaaaaugcugagcacggagucucauaaucaaaccuuccucaucgaugggccugaaacagccgagugccccaacaccaaucgcgcuuggaacucccuggagguugaagacuacggauuuggcguguucacaaccaauaucuggcuuaagcugcgggagaaacaggacgucuuuugugauagcaagcucaugucugccgcuauuaaagacaacagagccgugcacgcggauaugggcuauuggaucgaauccgcccugaaugacacauggaagauggagaaggcuagcuucauugagguuaaaucuugccacuggccuaagagccauacccugugguccaacggggugcuugaaagcgagaugaucauucccaaaaauuucgccggaccggucucucagcacaacuaccgcccuggcuaucauacgcagacagcugggcccuggcaccucggaaagcuggaaauggauuuugacuucugugagggcaccaccgugguggucacagaagauugcgggaaccggggacccucccugagaaccacgacagccagcggcaaacucaucaccgaguggugcugucgguccugcacacugccuccgcuucgcuacagaggcgaggacggguguugguacggaauggaaauucggccccugaaggagaaggaagagaaucucguuaacucucuggugaccgccggccaugggcaaaucgauaauuuuagccugggagugcuuggcauggcucucuuccuggaagagaugcugagaacacgcgucgggaccaaacacgcgauccuccugguggccguuuccuuugugacgcuuauuaccggaaacaugucuuuccgggaccugggcagagucauggugaugguuggcgcuacaaugaccgaugacaucgggaugggagugacauaucucgcccugcuggccgcuuuuaagguccgcccuaccuucgccgcgggccuucugcucagaaaacugacgagcaaggagcucaugauggcuacaauugggaucgcccugcuuucccagucuaccauucccgaaacaauccuggagcucaccgaugcccuggcucugggaaugauggugcuuaaaaucguucggaauauggaaaaguaccagcuggccgugaccauuauggcgaucagcugcgucccuaacgcugugauucuccaaaaugccuggaagguguccuguacaauccuggccgcugucagcguuucuccccuccugcuuacguccagccagcagaaagccgacuggauuccucuggcucucaccaucaagggccugaaccccacagccaucuuucugaccacacuuucucgcaccuccaaaaagagaagcuggccgcugaaugaggcgauuauggccguggggauggugucuauccucgcuuccagccugcucaaaaacgacauuccuaugacgggaccccuggucgccggcggccuucugacagugugcuauguucugaccgggcgguccgcugaucucgaacuggagcgcgccgccgacgugaagugggaggaucaggcugaaaucagcggaucuagcccuauucuuuccaucaccauuucugaggacggcagcauguccaucaaaaaugaagaggaggaacaaacacugaccauccucauuagaacagggcugcucgucaucucuggaguguuccccguuagcauuccgaucacggcggccgcuugguaccugugggaggugaagaagcagcgggccggcguccuuugggaugugccuucucccccucccgucgggaaagccgaacuggaggacggagcuuaucgcauuaagcagagaggcauccugggcuacagccagaucggggccggaguguauaaagaaggcaccuuucacacaauguggcauguuaccagaggggcggugcucaugcaccgcggaaagagaauugagcccagcugggcugaugucaaaaaggaccugaucuccuacggcgggggauggaaacuugagggcgaauggaaagagggcgaagaggugcaaguucuggcccucgaaccugggaagaacccgcgggccgugcagacaaaacccggacuguucaagaccaauacgggcaccauuggggcugucagccucgauuuuucuccuggaacauccggcagccccaucguggacagaaaagggaaggugguuggacuguacggcaacggcgucgugacccgcucuggggccuauguguccgcgauugcucagacagaaaagagcaucgaggauaauccugaaaucgaggacgauauuuuccggaaaaagagacuuaccaucauggaccugcaucccggagccggcaaaacaaagcgcuaccugccugccauuguccgggaagcuaucaaaagagggcuccgcacgcugauucuugccccgacccgggugguugcugccgagauggaagaggcgcugagaggacuccccauccgcuaucagaccccugccauucgggcugagcacaccggcagagaaaucguggaccugaugugucaugccaccuucacaaugcggcuccugucccccguccgcgugccuaacuacaaccuuaucauuauggaugaggcucacuuuacggaccccgccucuaucgccgcuagaggguauauuagcacccggguugaaaugggcgaggcggccggaaucuucaugacagcuaccccgccuggcucccgcgaucccuuuccccaaagcaaugccccuauuauggacgaggaaagagagauccccgaacggucuuggaacuccgggcacgagugggugacagauuucaagggaaagaccgucugguuugugccuagcaucaaagccggcaaugacauugcugccugccugagaaagaacgggaaaaagguuauccagcugucucgcaaaacguucgauagcgaauacgugaagacacgggcgaaugacugggauuuugucgugaccaccgacauuuccgagaugggagcuaacuucaaggccgagagagugaucgauccgcgccgguguaugaaacccgucauucucacagacggcgaagagagaguuauccuggccgggccuaugcccgugacccauucuagcgcugcccagcgccggggcagaaucggacgcaauccuaagaacgaaaaugaccaauauauuuacaugggcgagccccuugaaaacgaugaggacugcgcgcacuggaaagaggccaagaugcugcucgauaauaucaacacaccggaagggauuaucccuuccauguuugagcccgaaagagagaaaguggacgcuauugauggagaauaccggcugcgcggcgaggccagaaagaccuucgucgaccugaugcggcgcggggaucucccuguguggcuugcuuauagaguugccgcugagggaaucaauuacgccgaccggagaugguguuuugauggcauuaaaaacaaucagauccuggaagagaacguggaagucgagaucuggacgaaggagggggaacgcaagaaacugaagccccgguggcucgacgcgagaauuuauucugauccucuggcccuuaaagaguucaaggaguucgcugccggccgcaaaagccugacacucaaccugaucaccgagaugggacggcugcccacauuuaugacccagaaggcuagagacgcccucgauaaucuugccgugcugcauacggcugaagcgggcgggcgggccuacaaccacgcucuguccgagcucccggagacccuggaaacacuucugcuccugacccugcucgccacaguuaccggaggcauuuuccuuuuucugaugagcgggaagggaaucggcaaaaugacacugggcaugugcugcauuaucaccgccucuauccuccugugguaugcucagauucaaccucacuggaucgccgcguccauuauccuugaguucuuucugauugugcuccugauccccgaacccgagaagcagcgcacgccucaggacaaucagcugacauacgucgugaucgccauucucaccgucguggcugccaccauggcuaacgaaaugggguuccuugagaaaacaaagaaagaccugggacugggcagcaucaccacacaagaguccgaaucuaauauucucgauaucgaccugagaccggccagcgcguggacgcuuuaugccguugcuaccacauuugugacccccaugcugcggcauuccauugagaacucuagcgugaaugucucccucacagccaucgcuaaccaggccaccguucugauggggcugggaaagggcuggccucucagcaagauggauauuggggugccccuucuggcuaucggauguuacucucaggugaauccuaucacgcugaccgccgcgcuccugcuucuggucgcccacuacgcuauuaucggccccggccuccaggccaaagcuacacgcgaagcccaaaagagagccgcggcugggauuaugaaaaacccuaccguggacggaaucacaguuauugaucuggagccgauccccuaugacccuaaguucgaaaaacagcugggccaggugaugcuccuuauccugugcgucacccaggugcugaugaugcggacgacaugggcccucugugaggcucugacccuugccacagggcccauuuccacccugugggagggaaauccuggccgcuuuuggaacaccacaaucgccgucagcauggcuaauauuuucagagggucuuaccucgccggagcgggccugcuguuuuccaucaugaagaacacgaccaauacacggcgcggcaccgggaacauuggagaaacacucggcgagaaguggaaaagcagacuuaaugcccuggggaagucugaguuccaaaucuauaaaaagagcggaauccaggagguggaucggacccuggcuaaagagggcauuaagagaggggaaacggaccaucacgccguuucccgcggaucugcuaaacuccggugguuuguggagagaaacauggucacacccgaaggcaaggugguugaucugggcugcgggcgcggaggcuggagcuacuauugugggggacuuaagaacgugcgggaggucaaaggccugaccaaagggggaccgggccaugaagaaccuauccccauguccaccuacggcuggaaucucgugagacugcagagcgggguggacguuuucuucacacccccugagaaaugcgauacccugcucugugacauuggagaauccucucccaacccuacaaucgaggccggccgcacgcuucggguccugaaucugguggaaaacuggcucaauaacaauacccaauuuugcauuaaggugcugaacccguauaugcccagcgucaucgagaaaauggaaacacuucagagaaaguacgggggagcgcugguucgcaauccucucucccggaacucuacccacgagauguacugggugagcaaugccacaggcaacaucguguccucugucaauaugauuagcagaaugcugaucaaccgcuucaccaugaagcacaaaaaggcuacguaugagcccgauguggaccugggguccggaacccggaauauuggcaucgaaagcgagauuccuaaccucgacaucauuggcaaaagaaucgaaaagaucaaacaggagcaugaaacaucuuggcacuacgaucaggaccaucccuauaagaccugggccuaccacggguccuaugagacaaagcaaaccggaagcgcuucuuuuaugguuaacggcgugguccgccuucugacaaaaccgugggaugugguuccuauggugacccagauggccaugacggacacaacccccuucgggcagcagagagucuuuaaggagaaaguggauacccggacacaagaaccuaaggagggaacgaaaaagcugaugaagauuaccgcugaauggcucuggaaagagcugggcaagaaaaagacaccccgcauguguaccagagaggaguucacacggaaagugagauccaaugccgcgcuuggggccaucuuuaccgacgagaacaaguggaaaagcgcucgggaagccgucgaggauucucgcuucugggaacugauugacagagagcggaaucuccaccuggagggaaagugcgaaacauguguuuacaacaugaugggcaagcgcgagaaaaagcugggcgaauuugggaaagcuaagggauccagagccaucugguauauguggcucggcgcccgguuccuggaguuugaagcgcuuggguuccugaaugaggaucauugguuuagccgcggaaacucccucagcggcguggagggggaaggccugcacagacuuggauacauucugcgggacgugucuaaaaaggagggcggggcuauguacgccgaugacaccgccggaugggacacgcgcaucacccucgaagaucugaagaaugaggaaauggucacaaaccauaugaaaggcgagcacaagaaacuggcugaggccaucuucaagcucaccuaucagaauaaagugguuagagugcagcggccuacaccccgcgggaccgucauggacauuaucagcagacgggaucagcgcggauccggccaaguggggacguacggccugaacacauucaccaauauggaagcucagcuuauuagacagauggagggagaaggcaucuuuaagucuauucaacaucugacaguuaccgaggagaucgccgugcagaacuggcucgcgcgggucgggagagaacgccugagccggauggccaucuccggagacgauugcgugguuaagccgcuugacgauagauucgcuucugcccugacggcucucaaugacaugggcaaagugcgcaaggauauucagcagugggagccuagccggggguggaacgacuggacccaaguccccuuuugcucccaccacuuccaugaacuggugaugaaagauggaagaguccuggugguucccugucgcaaucaggacgagcucaucggccgggccagaauuucucagggggcgggcuggagccugaaggaaacagccugccuuggaaaauccuaugcucagauguggacccugauguacuuucaccgccgggaucucagacuggccgcuaacgccaucuguagcgcugugccuucucauugggucccgacaucccgcaccacauggagcauucacgccaagcacgaguggaugaccacggaggacaugcuugcgguguggaaccggguguggauccaagaaaaucccuggauggaggacaagacaccuguugaaucuugggaggaagugcccuaucugggcaaaagagaggaucaguggugcgggucccucauuggacugaccagccgggccaccugggcuaagaacauccagacagccaucaaucaggucagaucccugauuggcaacgaggaauacaccgacuauaugccuucuaugaaacgcuuccggagagaggaagaggaagccggggugcucugguga

SEQ ID NO: 19906 - RNA, 9876 nt, Artificial Sequence
  derived and/or modified CDS sequence (opt5) from DENV-2__EU482565__SS-prME
acagccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauagcacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauauccugggccggcucauuaccgucaacccuaucgugacagaaaaggacagcccgguuaacauugaggccgaacccccuuuuggggauucuuacaucaucauuggcguggagcccggacagcugaaacuuaauugguucaagaagggcuccagcaucgggcagauguuugagaccacaaugagaggagcuaaacgcauggccauucugggcgacaccgccugggauuucgggucucucggaggcgucuuuacgagcaucgggaaggcucugcaccaaguguucggcgccauuuacggagcggcuuuuuccggcguuucuuggacaaugaaaauccugaucggggugauuaucaccuggauuggaaugaacagccgguccaccagccuuucugucucccucgugcuggugggcguugucacacuguaucucggggugauggugcaggccgacagcggaugugucgugucuuggaagaauaaagaacugaagugcggcuccgggaucuucauuaccgauaacguucacacauggacggagcaguacaaguuucagccugaauccccucccaaacuugccuccgcuauccaaaaggcccaugaggaaggcaucuguggaauuagaucugugacccgccuggagaaucucauguggaaacagaucacacccgagcugaaccacauucugagcgaaaaugaggucaaacuuaccaucaugacaggcgacauuaaagggaucaugcaggcuggaaagcggucccucagaccccagccuaccgaacugaaauauucuuggaagacguggggcaaggccaaaaugcugagcaccgagucccauaaccaaacauuccucaucgaugggcccgaaaccgcggagugcccuaauacaaaccgcgccuggaauagccuggagguggaagacuacggauuuggcguuuucucuaccaacauuuggcuuaagcugcgggagaaacaggacguguuuugugauuccaagcucaugagcgcugccaucaaagacaauagagcuguccacgccgauaugggcuauuggauugaaucugcgcugaacgacacauggaagauggagaaggccuccuucaucgaggugaaaagcugccacuggcccaagucucauacccuguggagcaaugggguucuugaauccgagaugauuaucccgaaaaacuucgcuggaccugugagccagcacaacuaccgccccggcuaucauacgcagacagccgggcccuggcaccucggaaagcuggaaauggauuuugacuucugugagggcaccaccgucguggugacagaagauugcgggaaucggggaccuucucugagaaccacgacagcuuccggcaaacucauuaccgaguggugcugucggagcugcacacugccgccccuucgcuacagaggcgaggacggguguugguacggaauggaaauccggccucugaaggagaaggaagagaaccucgucaauucccugguuaccgccggccaugggcaaaucgauaacuuuucucugggagugcuuggcauggcccucuuccuggaagagaugcugagaacacgcguggggaccaaacacgcuauucuccuggucgcggugagcuuuguuacgcuuaucaccggaaauauguccuuccgggaccugggcagagugauggucauggugggcgccacaaugaccgaugacauugggaugggaguuacauaucucgcucugcuggccgccuuuaaggugcgccccaccuucgcugccggccuucugcucagaaaacugacgucuaaggagcucaugauggcgacaaucgggauugcucugcuuagccaguccaccaucccugaaacaauccuggagcucaccgaugcccuggcccugggaaugaugguccuuaaaauugugcggaacauggaaaaguaccagcuggcuguuaccaucauggccauuucuugcgugcccaaugcggucauccuccaaaacgcuuggaaggugagcuguacaauucuggccgccguguccgucagcccucuccugcuuacgucuucccagcagaaagcugacuggaucccccuggcccucaccaucaagggccugaauccgacagcuauuuuucugaccacacuuagccgcaccucuaaaaagagauccuggccucugaacgaggccguuauggcgguggggauggugagcauccucgccucuucccugcucaaaaaugacauucccaugacgggaccucuggucgcuggcggccuucugacagugugcuauguucugaccgggcggagcgccgaucucgaacuggagcgcgcugccgacgugaagugggaggaucaggccgaaaucuccggaagcucucccauucuuagcaucaccauuuccgaggacggcucuaugagcaucaaaaacgaagaggaggaacacacacugaccauccucauuagaacagggcugcucgucaucuccggaguguucccgguuucuauuccuaucacggcugcggccugguaccugugggaggugaagaagcaacgggcuggcguccuuugggaugugcccagcccuccgcccgucgggaaagccgaacuggaggacggagccuaucgcauuaagcagagaggcaucuuuggcuacucccagaucggggcuggaguguauaaagaaggcaccuuccauacaauguggcacguuaccagaggggccgugcugaugcaucgcggaaagagaauugagccuucuugggcggaugucaaaaaggaccucaucagcuacggcgggggauggaagcuggagggcgaauggaaagagggcgaagaggugcagguucuugcucuggaaccggggaagaauccccgggccgugcaaacaaaaccuggacucuuuaagaccaacacgggcaccauuggggccgucucccuggauuucagccccggaacaucuggcuccccuaucguggacagaaaagggaaggugguuggacucuacggcaauggcgucgugacccgcagcggggcuuaugugucugccauugcgcagacagagaaguccaucgaggauaaccccgaaaucgaggacgauauuuuccggaaaaagagacugaccaucauggaccuucacccuggagcuggcaaaacaaagcgcuaccugccggccauuguccgggaagccaucaaaagagggcugcgcacgcucauucuggcucccacccgggugguugccgcugagauggaagaggcccuuagaggacugccuauccgcuaucagacacccgcgauucgggccgagcauaccggcagagaaaucguggaccucaugugucacgcuaccuuuacaaugcggcugcucagcccuguccgcgugcccaacuacaaucugaucauuauggaugaggcccacuucacggacccggcuuccaucgccgccagaggguauauuucuacccggguugaaaugggcgaggcugcgggaaucuuuaugacagccaccccucccggcagccgcgaucccuucccucaguccaacgcucccauuauggacgaggaaagagagaucccugaacggagcuggaacucugggcaugagugggugacagauuuuaagggaaagaccgucugguucgugccguccaucaaagccggcaacgacauugccgcuugccuuagaaagaaugggaaaaagguuauccaacugagccgcaaaacguuugauucugaauacgugaagacacgggccaacgacugggauuucgucgugaccaccgacauuagcgagaugggagcgaauuuuagagcugagcgcgugaucgauccccggagauguaugaagccugucauucugacagacggcgaggaacgcguuauccucgccgggcccaugccugugacccacuccucugccgcucagcggagaggccgcaucggaagaaaccccaaaaaugaaaacgaccaguauauuuacaugggcgagccgcuggaaaaugaugaggacugcgcccauuggaaggaggcgaaaaugcuucuggauaacaucaauacaccugaagggauuauccccagcauguucgagccugaacgggagaagguggacgccauugauggagaauaccgccucagaggcgaggcucggaaaaccuuugucgaccugaugcgcagaggggaucugcccguguggcucgccuaucggguugcugccgagggaaucaacuacgcugacagacgcugguguuucgauggcauuaagaauaaccaaauccuugaagagaacguggaagucgagaucuggacgaaagagggggaacggaagaagcugaaaccuagauggcuggacgcccgcauuuauuccgauccccucgcgcugaaggaguucaaagaauuugccgcuggccggaagucucuuacacugaaucucaucaccgagaugggaagacugccgacauucaugacccagaaagcccgggacgcucuggauaaccucgccgugcuucacacggccgaaguuggcgggcgcgcuuacaaucacgcgcugagcgagcugccugagacccucgaaacacugcuucugcucacccugcuggccacagugaccggaggcauuuuucucuuccuuauguccgggaagggaaucggcaagaugacacugggcaugugcugcauuaucaccgcuagcauccugcucugguaugcccagauucagccccauuggaucgccgcuucuauuauccuggaguuuuuccuuauuguccugcucauccccgaaccugagaaacaaagaacgccgcaggacaaccagcugacauacguggucaucgccauucugaccgugguugcggccaccauggcuaaugaaaugggguuucucgagaagaccaagaaggaccuuggacugggcuccaucaccacacaggagcccgaaagcaacauucuggauaucgaccuccggccugccuccgcuuggacgcuguaugccguggcgaccacauucgugacccccaugcuucgccacucuauugagaauagcuccgucaacguuucucugacagccaucgcuaaucaagccaccgugcucauggggcugggaagaggcuggccucugagcaaaauggauauuggggugccccuccuugcuaucggauguuacucccaggucaacccuaucacgcugaccgccgcucugcuccugcuuguggcccauuacgcgauuaucggcccgggccugcaggccaaggcuacacgggaagcccagaagcgcgcugccgccgggauuaugaaaaaucccaccguugacggaaucacagugauugaucucgagccuauccccuaugacccuaaguuugaaaaacaacugggccaggucaugcugcucgugcuuugcgucacccaggugcugaugaugagaacgacaugggcgcugugugaggcucucacccuggccacagggcccaucagcacccuuugggagggaaacccgggccgguucuggaauaccacaauugcuguuucuauggccaacaucuuucgcggguccuaccuggccggagcuggccuccuguucagcauuaugaagaauacgaccaacacaagacggggcaccgggaauaucggagaaacacugggcgagaaauggaagucuagacucaacgcccuugggaaguccgaauuucagauuuauaaaaagagcggaauccaagagguggaucgcacccuggcgaaagagggcaucaagagaggggaaacggaccaccaugccgucucuagaggaagcgcuaaacugcgcugguucguggagcggaacaugguuacaccugaaggcaagguggucgaucucggcugcgggagaggaggcugguccuacuauugugggggacugaaaaaugugcgcgaggugaagggccuuaccaaagggggacccggccacgaggaacccauuccuaugucuaccuacggcuggaaccugguucggcuccagagcggggucgacguguucuuuacacccccugagaaaugcgauacccugcugugugacaucggagaauccagcccgaaucccacaauugaggccggcagaacgcuccgcgugcuuaaccuggucgaaaauuggcugaacaauaacacccaguucugcaucaagguucucaauccuuauaugcccuccgugauugagaaaauggaaacacugcaacggaaguacgggggagcucuugugagaaacccucugucucgcaauagcacccacgagauguacugggucuccaacgccacaggcaauaucgugucuagcguuaacaugaucucccggaugcucauuaauagauuuaccaugaaacauaagaaggcgacguaugagcccgauguggaccuggggucuggaacccgcaacgucggcaucgaaaacgagauuccgaaucuggacaucauuggcaaaagaaucgaaaagauuaaacaggagcacgaaacaagcuggcauuacgaucaggaccacccuuauaagaccugggccuaccacggguccuaugagacaaaacagaccggaagcgcuucuuccauggugaacggcguugugcggcuccuuacaaagcccugggaugucgugccuauggugacccaaauggccaugacggacacaacccccuucgggcagcagcgcgucuuuaaggagaaaguugauaccagaacacaggaaccuaaggagggaacgaaaaagcugaugcggaucaccgcugaauggcuguggaaagagcucggcaagaagaaaacacccagaauguguacccgggaggaguucacacgcaaggugagaagcaaugccgcucugggggccaucuuuaccgacgagaacaaauggaagucugcgcgggaagccguggaggauucccgcuucugggaacuugucgacagagagcggaaucugcaucucgagggaaaaugcgaaacauguguguacaacaugaugggcaagcgcgagaaaaagcugggcgaauuugggaaggcuaaaggaagcagagccauuugguauauguggcugggcgcucgguuccucgaguuugaagcccugggguuccuuaaugaggaucacugguuuucucgcggaaacucccugagcggcguugagggggaaggccuccauaagcugggauacauccuuagagacguguccaaaaaggagggcggggccauguacgcggaugacaccgcuggaugggacacgcggauuacccuggaagaucucaaaaaugaggaaauggucacaaaccacaugaagggcgagcauaagaaacuggccgaggccaucuucaagcugaccuaucaaaauaaagugguucgcgugcagagaccgacaccucgggggaccgucauggacauuaucagccgcaaggaucagagaggaucuggccagguggggacguacggccucaacacauucaccaauauggaagcucaacugauccggcagauggagggagaaggcauuuuuaaaagcauccagagacuuacaguuaccgaggagauugccgugcaaaacuggcuggcucgcgucgggcgggaaagacucucccgcauggccaucucuggagacgauugcguggucaagccccuggacgaucgguucgcgagcgcccuuacggcucugaaugacaugggcaaggugagaaaagauauucagcagugggagcccucccgcggguggaacgacuggacccagguuccuuuuugcucucaccacuuccaugaacucgugaugaaggauggacggguccugguggugccguguagaaaccaagacgagcugaucggccgcgcccggaucagccagggggcuggcuggucccucaaagaaacagccugccugggaaagucuuaugcgcagauguggacccuuauguacuuucacagacgcgaucugcggcucgccgcuaaugccauuuguagcgcuguucccucccauugggugccuacaagcagaaccacauggucuauccacgccaaacacgaguggaugaccacggaggacaugcuggcugucuggaaccggguguggauucaggaaaaucccuggauggaggacaagacaccuguugaauccugggaggaagugcccuaucuuggcaagagagaggaucaauggugcgggagccugaucggacucaccucucgcgccaccugggcgaaaaacauucagacagccaucaaucagguccggucccugauuggcaacgaggaauacaccgacuauaugccuagcaugaagagauuccgcaaagaggaagaggaagcuggggugcugugguga

SEQ ID NO: 19907 - RNA, 9876 nt, Artificial Sequence
  derived and/or modified CDS sequence (opt5) from DENV-2__EU529700__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaguauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaaccuggaaaaguaccagcucgcugugaccauuauggccaucagcugcgucccuaaugcggugauucugcaaaacgcuuggaagguguccuguacaauccucgccgccgucagcguuucuccccugcuucugacguccagccagcagaaagcugacuggauuccucucgcccugaccaucaagggccugaaucccacagcuaucuuucuuaccacacugucucgcaccuccaaaaagagaagcuggccgcucaacgaggccgugauggcgguggggauggucucuauucuggccuccagccuccugaaaaaugacaucccuaugacgggaccccuuguggcuggcggccugcugacaguuugcuaugugcucaccgggcgguccgccgaucuggaacuugagcgcgcugccgacgucaagugggaggaucaggccgaaauuagcggaucuagcccuauccuguccauuaccaucucugaggacggcagcauguccauuaaaaacgaagaggaggaacaaacacucaccauccugaucagaacagggcuccuggugauuucuggaguuuuccccgugagcaucccgauuacggcugcggccugguaccuuugggaggucaagaagcagcgggcuggcgugcugugggaugucccuucucccccucccguggggaaagccgaacuggaggacggagccuaucgcaucaagcagagaggcauuuuuggcuacagccagaucggggcuggaguuuauaaagaaggcaccuuccacacaauguggcaugugaccagaggggccguccucaugcaccgcggaaagagaaucgagcccagcugggcggaugugaaaaaggaccugauuuccuacggcgggggauggaaacuugagggcgaauggaaagagggcgaagagguucaagugcuggcucucgaaccugggaagaauccgcgggccguccagacaaaacccggacuguuuaagaccaacacgggcaccaucggggccgugagccucgauuucucuccuggaacauccggcagccccauuguggacagaaaagggaagguugucggacuguacggcaauggcguggugacccgcucuggggcuuaugucuccgccaucgcgcagacagaaaagagcauugaggauaacccugaaaucgaggacgauaucuuccggaaaaagagacuuaccauuauggaccugcaucccggagcuggcaaaacaaagcgcuaccugccugccaucgugcgggaagccauuaaaagagggcuccgcacgcugauccuugcuccgacccggguuguggccgcugagauggaagaggcccugagaggacuccccauucgcuaucagaccccugcgauccgggccgagcacaccggcagagaaauugucgaccugaugugucaugcuaccuuuacaaugcggcuccugucccccgugcgcguuccuaacuacaaucuuaucaucauggaugaggcccacuucacggaccccgcuucuauugccgccagaggguauaucagcacccggguggaaaugggcgaggcugcgggaauuuuuaugacagccaccccgccuggcucccgcgaucccuucccccaaagcaacgcuccuaucauggacgaggaaagagagauucccgaacggucuuggaacuccgggcacgagugggucacagauuuuaagggaaagaccgugugguucguuccuagcaucaaagccggcaacgacaucgccgcuugccugagaaagaaugggaaaaaggugauucagcugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccucacagacggcgaggaacgcgugauucuggccgggccuaugcccgugacccauucuagcgccgcucagcggagaggccgcaucggaagaaacccuaaaaaugaaaacgaccaauauaucuacaugggcgagccccuugaaaaugaugaggacugcgcccacuggaaggaggcgaaaaugcugcucgauaacauuaauacaccggaagggaucauuccuuccauguucgagcccgaacgggagaaggucgacgccaucgauggagaauaccgccugagaggcgaggcucggaaaaccuuuguggaccugaugcgcagaggggaucucccuguuuggcuugccuaucggguggcugccgagggaauuaacuacgcugacagacgcugguguuucgauggcaucaagaauaaccagauucuggaagagaacgucgaaguggagaucuggacgaaagagggggaacggaagaagcugaaacccagauggcucgacgcccgcaucuauucugauccucuggcgcuuaaggaguucaaagaauuugccgcuggccggaagucccugacacucaaucugauuaccgagaugggaagacugcccacauucaugacccagaaagcccgggacgcucucgauaaccuugccguucugcauacggccgaagugggcgggcgcgcuuacaaucacgcgcuguccgagcucccggagacccuggaaacacuucugcuccugacccugcucgccacagucaccggaggcaucuuucuuuuccugaugagcgggaagggaauuggcaagaugacacugggcaugugcugcaucauuaccgcuucuauccuccugugguaugcccagauccaaccucacuggauugccgcuuccaucauucuugaguuuuuccugaucgugcuccugauucccgaacccgagaaacagagaacgccucaggacaaccagcugacauacgucgugaucgccauccucaccguuguggcggccaccauggcuaaugaaaugggguuucuugagaagaccaagaaggaccugggacugggcagcauuaccacacaagaguccgaaucuaacauccucgauauugaccugcggccggccagcgcuuggacgcuuuaugccguggcgaccacauucgucacccccaugcugcgccauuccaucgaaaauucuagcguuaacgugucccucacagccauugcuaaucaggccaccgugcugauggggcugggaagaggcuggccucucagcaaaauggauaucggggucccccuucuggcuauuggauguuacucucaggugaacccuaucacgcugaccgccgcucuccugcuucugguugcccacuacgcgaucauuggccccggccuccaggccaaggcuacacgggaagcccaaaagcgcgcugccgccgggaucaugaaaaauccuaccguggacggaauuacagucaucgaucuggagccgauucccuaugacccuaaguuugaaaaacagcugggccaggugaugcuccuuguccugugcgugacccagguucugaugaugagaacgacaugggcgcucugugaggcucugacccuugccacagggcccaucuccacccugugggagggaaacccuggccgguucuggaauaccacaaucgcugugagcauggccaacauuuuucgcgggucuuaccucgccggagcuggccugcuguucuccaucaugaagaauacgaccaacacaagacggggcaccgggaauauuggagaaacacucggcgagaaauggaaaagcagacuuaacgcccuggggaagucugaauuucaaaucuauaaaaagagcggcauucaggaggucgaucgcacccuggcgaaagagggcaucaagagaggggaaacggaccaucacgccguguccagaggaucugcuaaacuccgcugguucguugagcggaacauggugacacccgaaggcaaggucguggaucugggcugcgggagaggaggcuggagcuacuauugugggggacuuaaaaaugugcgcgagguuaagggccugaccaaagggggaccgggccaugaggagccuauccccauguccaccuacggcuggaaccucguccggcugcagagcgggguggacguguucuuuacacccccugagaaaugcgauacccugcucugugacauuggagaauccucucccaauccuacaaucgaggccggcagaacgcuucgcguccugaaccugguugaaaauuggcucaacaauaacacccaauucugcauuaaggugcugaauccguauaugcccagcgugaucgagaaaauggaaacacuucagcggaaguacgggggagcucuggucagaaacccucucucccgcaauucuacccacgagauguacugggugagcaacgccacaggcaauauuguuuccucugugaacaugaucagccggaugcugaucaauagauuuaccaugaaacacaagaaggcgacguaugagcccgaugucgaccugggguccggaacccgcaacauuggcaucgaaaacgagauuccuaaucucgacaucauuggcaaaagaaucgaaaagauuaaacaggagcaugaaacaagcuggcacuacgaucaggaccaucccuauaagaccugggccuaccacgggucuuaugagacaaaacaaaccggauccgcuagcucuauggugaacggcguugugcggcuucugacaaagccgugggaugucgugccuauggugacccagauggccaugacggacacaacccccuucgggcagcagcgcgucuuuaaggagaaaguugauaccagaacacaagaaccuaaggagggaacgaaaaagcugaugcggaucaccgcugaauggcucuggaaagagcugggcaagaagaaaacacccagaauguguacccgggaggaguucacacgcaaggugagauccaaugccgcucuuggggccaucuuuaccgacgagaacaaauggaaaagcgcgcgggaagccguggaggauucucgcuucugggaacuggucgacagagagcggaaucuccaccuggagggaaaaugcgaaacauguguguacaacaugaugggcaagcgcgagaaaaagcugggcgaauuugggaaggcuaaaggauccagagccauuugguauauguggcucggcgcucgguuccuggaguuugaagcccuuggguuccugaaugaggaucauugguuuagccgcggaaacucccucagcggcguugagggggaaggccugcacaaacuuggauacauccugagagacgugucuaaaaaggagggcggggccauguacgcggaugacaccgcuggaugggacacgcggauuacccucgaagaucugaaaaaugaggaaauggucacaaaccauaugaagggcgagcacaagaaacuggccgaggccaucuucaagcucaccuaucagaauaaagugguucgcgugcagagaccuacaccccgggggaccgucauggacauuaucagccgcaaggaucagagaggauccggccaaguggggacguacggccugaacacauucaccaauauggaagcucagcuuauccggcagauggagggagaaggcauuuuuaaaucuauccaacaucugacaguuaccgaggagauugccgugcagaacuggcucgcuagagucgggcgcgaacggcugagcagaauggccaucuccggagacgauugcguggucaagccgcuugacgaucgcuucgcgucugcccugacggcucucaaugacaugggcaaggugcggaaagauauucagcagugggagccuagcagaggguggaacgacuggacccaaguucccuuuugcucccaccacuuccaugaacuggugaugaaggauggacgcguccugguggugcccugucggaaccaggacgagcucaucggcagagcccgcaucucucagggggcuggcuggagccugaaagaaacagccugccuuggaaaguccuaugcgcagauguggacccugauguacuuucaccggagagaucuccgccuggccgcuaaugccauuuguagcgcuguuccuucucauugggugccgacaucccggaccacauggagcauccacgccaaacacgaguggaugaccacggaggacaugcuugcugucuggaacagaguguggauucaagaaaaucccuggauggaggacaagacaccuguugaaucuugggaggaagugcccuaucugggcaagcgggaggaucaguggugcgggucccucaucggacugaccagcagagccaccugggcgaaaaacauucagacagccaucaaucagguccgcucccugauuggcaacgaggaauacaccgacuauaugccuucuaugaagcgguucagaaaagaggaagaggaagcuggggugcucugguga

SEQ ID NO: 19908 - RNA, 9876 nt, Artificial Sequence
  derived and/or modified CDS sequence (opt5) from DENV-2__EU529701__SS-prME
accgccggcgugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgauggaucucggagaacugugugaggacacaaucaccuacaaaugcccgcuucugcgccaaaaugaacccgaggauauugacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauccugcgccaucccggguucacaauuauggccgcuauccucgccuacaccauuggaaccacacacuuucagagagcucugaucuucauucuucugacggccguggcgccuagcaugaccaugcggugcaucggcauuuccaaccgcgauuuugucgaaggggugucuggaggcagcuggguugacaucgugcucgagcacggguccugugucacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaagggggaaucgugacaugcgccauguuuacgugcaaaaagaauauggaaggcaaagucguucagccugagaaccuggaauacaccauugugaucacaccccacagcggggaggagcaugcggugggaaaugacaccggcaagcacggcaaagaaauuaagaucacaccucagucuuccaucaccgaggccgaacuuacgggguauggaaccgucacaauggaguguagcccccggaccggccuggauuucaacgaaauggugcuccugcaaauggaggacaaggcuuggcuuguucaccgccagugguuucuggaucucccgcugccuuggcugcccggggccgacacacagggaucuaauuggauucagaaggagacccucgugacguucaagaacccucaugcuaaaaagcaagacgucgugguucugggcucccaggaaggggccaugcacacagcccuuaccggcgcuacagagauccagaugagcuccggaaaucugcucuuuaccggccaucugaaaugcagacuucggauggauaagcugcaacucaaagggaugucuuacagcauguguaccggaaaguucaagauugugaaagaaaucgcggagacacagcacggcacgauugucaucagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucauuggcgucgagcccggacagcugaaacuuaauugguucaagaagggcuccagcaucgggcaaauguuugagaccacaaugagaggagcuaaacgcauggccauccugggcgacaccgccugggauuucgggucucucggaggcguguuuacgagcguugggaaggcucugcaccagguguucggcgccauuuacggagcggcuuuuuccggcgucucuuggacaaugaaaaucuucauuggggugaucauuaccuggaucggaaugaacagccgguccaccagccugucugugucccuuguucucgucggcguggugacacuguaucugggggccaugguccaggccgacagcggaugugugguuucuuggaagaauaaagaacucaagugcggcuccgggaucuuuauuaccgauaacgugcacacauggacggagcaguacaaguuccaaccugaaagccccuccaaacuggcuucugccauccagaaggcucaugaggaaggcauuuguggaaucagaagcgucacccgccuugagaaucugauguggaaacagauuacaccggagcucaaccacauccuguccgaaaaugaggugaagcugaccaucaugacaggcgacauuaaagggaucaugcaggccggaaagcggucucuuagaccucaacccaccgaacucaaauauagcuggaagacguggggcaaggcgaaaaugcuguccaccgagagccauaaccagacauuucugauugaugggccugaaaccgccgagugccccaauacaaaccgcgcuuggaacucucucgagguugaagacuacggauucggcguguuuaccacaaacaucuggcugaaacuucgggagaaacaggacgucuucugugauuccaagcugaugagcgccgcuauuaaagacaauagagccgugcacgcggauaugggcuauuggaucgaaucugcccucaacgacaccuggaagauggagaaggcuuccuucaucgagguuaaaagcugccacuggccuaagucucauacgcuguggagcaauggggugcuggaauccgagaugauuauccccaaaaacuuugccggaccggucagccagcacaacuaccgcccuggcuaucauacacaaaccgcugggcccuggcaccuuggaaagcucgaaauggauuucgacuuuugugagggcaccacagugguggucaccgaagauugcgggaaucggggacccucucugagaacgacaaccgccuccggcaaacugauuacagaguggugcugucggagcugcacccucccuccgcugcgcuacagaggcgaggacggguguugguacggaauggaaauccggccccuuaaggagaaggaagagaaccugguuaauucccucgugacagccggccaugggcagauugauaacuucucucugggagugcugggcauggcucuuuuucucgaagagaugcugagaacccgcgucgggacgaaacacgcgauccugcucguggccguuagcuucgugacccugauuacaggaaauauguccuuucgggaccuuggcagagucauggugaugguuggcgcuaccaugacagaugacaucgggaugggagugaccuaucuggcccuccuggccgcuuucaagguccgcccuacguuugccgcgggccugcuucugagaaaacucacaucuaaggagcugaugauggcuaccaucgggauugcccuccugagccaguccacaauccccgaaaccauucuugagcugaccgaugcccucgcucugggaaugauggugcugaaaaucguucggaacauggaaaaguaccaacuugccgugacaauuauggcgaucucuugcgucccuaaugcugugauccugcagaacgccuggaaggugagcuguacgauucucgccgcugucuccguuagcccccugcuccugaccucuucccagcagaaagccgacuggaucccucuugcucugacaauuaagggccucaaucccaccgccaucuuccugacaacccugagccgcacgucuaaaaagagauccuggccgcuuaacgaggcgauuauggccguggggauggugagcauccuggcuucuucccuccugaaaaaugacaucccuaugacaggaccccucgucgccggcggccugcuuaccgugugcuauguucugaccgggcggagcgcugaucuggaacucgagcgcgccgccgacgugaagugggaggaucaagcugaaauuuccggaagcucuccuauccugagcauuacaaucuccgaggacggcucuaugagcauuaaaaacgaagaggaggaacagacccuuacaauccugauuagaacggggcuccuggucaucuccggaguguuucccguuucuaucccgauuaccgcggccgcuugguaccucugggaggugaagaagcagcgggccggcguccugugggaugugccuucucccccucccgucgggaaagccgaacuugaggacggagcuuaucgcaucaagcagagaggcauucugggcuacucccaaaucggggccggaguguauaaagaaggcacauuccacaccauguggcauguuacaagaggggcggugcugaugcaccgcggaaagagaauugagcccuccugggcugaugucaaaaaggaccucaucagcuacggcgggggauggaagcuggagggcgaauggaaagagggcgaagaggugcagguucuugcccuggaaccugggaagaauccgcgggccgugcagaccaaacccggacucuuuaagacgaacaccggcacaaucggggcugucucccuggauuucagcccuggaaccucuggcucccccauuguggacagaaaagggaaggugguuggacucuacggcaauggcgucgugacacgcagcggggccuaugugucugcgaucgcucagaccgagaaguccauugaggauaacccugaaaucgaggacgauauuuuccggaaaaagagacugacaaucauggaccuucaucccggagccggcaaaacgaagcgcuaccugccugccaucguccgggaagcuauuaaaagagggcugcgcacccucauccuggccccgacacgggugguugcugccgagauggaagaggcgcuuagaggacugcccauucgcuaucaaaccccugccauccgggcugagcacaccggcagagaaauuguggaccucaugugucaugccacauuuacgaugcggcugcucagccccguccgcgugccuaacuacaaucugaucauuauggaugaggcucacuucaccgaccccgccuccaucgccgcuagaggguauaucucuacacggguugaaaugggcgaggcggccggaauuuuuaugaccgcuacaccgccuggcagccgcgaucccuucccccaguccaacgccccuaucauggacgaggaaagagagauucccgaacggagcuggaacucugggcacgagugggugaccgauuuuaagggaaagacggucugguucgugccuuccaucaaagccggcaacgacauugcugccugccuuagaaagaaugggaaaaagguuauccagcugagccgcaaaacauuugauucugaauacgugaagacccgggcgaacgacugggauuucgucgugaccacagacaucagcgagaugggagcuaauuuuaaggccgagagagugauugauccgcgccgguguaugaaacccgucauccugaccgacggcgaagagagaguuauucucgccgggccuaugcccgugacacauuccucugcugcccaacgccggggcagaaucggacgcaacccuaagaaugaaaacgaccaguauauuuacaugggcgagccccuggaaaaugaugaggacugcgcgcacuggaaagaggccaagaugcuucuggauaacaucaauaccccggaagggaucauuccuagcauguucgagcccgaaagagagaaaguggacgcuaucgauggagaauaccggcuccgcggcgaggccagaaagacguuugucgaccugaugcggcgcggggaucugccuguguggcucgcuuauagaguugccgcugagggaauuaacuacgccgaccggagaugguguuucgauggcaucaaaaauaaccagauucuugaagagaacguggaagucgagaucuggacaaaggagggggaacgcaagaaacugaagccccgguggcuggacgcgagaauuuauuccgauccucucgcccugaaagaguucaaggaauuugcugccggccgcaaaucucuuacccugaaucucaucacagagaugggacggcugcccaccuucaugacgcagaaggcuagagacgcccuggauaaccucgccgugcuucauaccgcugaagcgggcgggaaggccuacaaucacgcucugagcgagcugccggagacacucgaaacccugcuucugcucacacugcuggccaccguuacaggaggcaucuuucucuuccuuauguccgggaaaggaauuggcaagaugacccugggcaugugcugcaucauuacggccagcauccugcucugguaugcucaaauucagccucacuggaucgccgcgucuaucauucuggaguuuuuccuuaucgugcugcucauucccgaacccgagaaacagcggacaccucaggacaaccaacugaccuacgucgugaucgccauucugaccgucguggcugccacaauggcuaaugaaaugggguuucucgagaagaccaaaaaggaccuuggacugggcuccaucacaacgcaggagagcgaauccaacauccuggauauugaccuccgcccggccucugcguggacccuguaugccguugcuacaaccuucgugacacccaugcuuagacauagcaucgaaaauagcucugugaacgucagccugaccgccauugcuaaucaggccacgguucucauggggcugggaaagggcuggccucuguccaaaauggauaucggggugccccuccuugcuauuggauguuacagccaggugaacccuaucacccugacagccgcgcugcuccugcuugucgcccacuacgcuauuaucggccccggccugcaagccaaggcuacccgggaagcccagaaacgcgccgcggcugggaucaugaagaauccuacaguggacggaauuaccguuaucgaucucgagccgauucccuaugacccuaaauuugaaaagcagcugggccaggugaugcugcucauccuuugcgucacgcaagugcugaugaugagaacaaccugggcccugugugaggcucucacacuggccaccgggcccauuucuacccuuugggagggaaacccuggccgguucuggaauacaacgaucgccgucuccauggcuaacaucuuucgcgggagcuaccuggccggagcgggccuccuguucucuauuaugaagaauaccacaaacaccagacggggcacagggaauaucggagaaacccugggcgagaaauggaagucccgccucaacgcccuugggaaaagcgaauuucagauuuauaagaaaucuggaauccaggagguggauagaacgcuggcuaaggagggcauuaaaagaggggaaacagaccaucacgccguuagcagaggauccgcuaagcugcgcugguucguggagcggaacauggucacccccgaaggcaaggugguugaucucggcugcgggagaggaggcuggucuuacuauugugggggacugaaaaaugugcgcgaggucaagggccuuaccaaagggggaccgggccaugaggaaccuauccccaugagcacauacggcuggaaccuggugcggcuccaauccgggguggacguuuucuuuacacccccugagaagugcgauacccugcugugugacaucggagaaagcucccccaauccuacgauugaggccggcagaacccuccgcguccuuaaccugguggaaaauuggcugaacaauaacacacaguucugcaucaaagugcucaauccguauaugcccucugucauugagaagauggaaacccugcagcggaaguacgggggagcgcuuguuagaaacccucugagccgcaauuccacacacgagauguacugggugucuaacgccaccggcaauaucgugagcuccgucaacaugauuucucggaugcucaucaauagauuuacgaugaaacacaagaaagcuaccuaugagcccgauguggaccuggggagcggaacacgcaacaucggcauugaauccgagaucccuaaccuggacauuaucggcaagcggauugagaagaucaagcaggagcaugaaaccagcuggcacuacgaucaagaccaucccuauaagacaugggccuaccacgggucuuaugagaccaaacagacaggauccgcuagcucuaugguuaauggcguggucagacuccuuaccaagccgugggaugugguuccuauggugacgcagauggccaugacagacaccacccccuucgggcagcaacgcgucuuuaaagagaagguggauacaagaacgcaggaaccuaaagagggaaccaagaagcugaugaaaauuacagcugaauggcuguggaaggagcucggcaaaaagaaaacaccccggauguguacacgcgaggaguucaccagaaaggugcgguccaacgccgcgcugggggccaucuuuacagacgagaauaaauggaaaagcgcuagagaagccgucgaggauucucgguucugggaacuuguugaccgcgagagaaaccugcaccucgagggaaagugcgaaaccuguguguacaauaugaugggcaaacgggagaagaaacugggcgaauuugggaaggcuaaaggaucccgcgccaucugguauauguggcugggcgccagauuccucgaguuugaagcgcugggguuccuuaacgaggaucauugguuuagccggggaaauucccugagcggcguggagggggaaggccuccaccgccugggauacauucuuagagacgucucuaagaaggagggcggggcuauguacgccgaugacacggccggaugggacacccggaucacacuggaagaucucaaaaacgaggaaauggugaccaaucauaugaagggcgagcacaaaaagcuggcugaggccauuuucaaacugacauaucagaacaagguugugcgcguccagagaccuacaccccgggggacggugauggacaucauuagccgcagagaucaacggggauccggccagguugggacauacggccucaauaccuucacaaacauggaagcucagcugauccgccaaauggagggagaaggcaucuuuaagucuauucagcaucuuaccgugacggaggagaucgccguccagaauuggcuggcgagaguggggcgggaaagacucagccgcauggccauuuccggagacgauugcguugugaaaccgcuggacgaucgguucgcuucugcccuuaccgcucugaacgacaugggcaaggucagaaaagauauccagcaaugggagccuagccgcggguggaaugacuggacacaggugcccuuuugcucccaccacuuccaugaacucgucaugaaggauggacgggugcugguugugcccuguagaaaccaggacgagcugauuggccgcgcccggaucucucagggggcgggcuggagccucaaagaaaccgccugccugggaaaguccuaugcucaaauguggacacuuauguacuuucacagacgcgaucugcggcucgccgcuaacgccaucuguagcgcugucccuucucauugggugccgaccuccagaacaaccuggagcauucacgccaagcacgaguggaugacgacagaggacaugcuggcgguguggaaucgcguuuggauccaggaaaaccccuggauggaggacaaaaccccuguggaaucuugggaggaaguccccuaucuuggcaagcgggaggaucaguggugcgggucccugauuggacucaccagcagagccacaugggcuaaaaauauccagaccgccauuaaccaagugcggucccugaucggcaaugaggaauacacagacuauaugccuucuaugaagagauuccgccgggaggaagaggaagccgggguucugugguga

SEQ ID NO: 19909 - RNA, 9876 nt, Artificial Sequence
  derived and/or modified CDS sequence (opt5) from DENV-2__EU569704__SS-prME
accgccggcgugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgaucgaucucggagaacugugugaggacaccauuaccuacaaaugcccgcuucugcgccaaaaugaacccgaggauaucgacuguuggugcaauuccacgucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaaggcgggauugugacaugcgccauguuuacgugcaaaaagaauauggaagggaaagucguucugccugagaaccuugaauacaccaucgugauuacaccccacagcggggaggagcaugcggugggaaaugacaccggcaagcacggcaaagaaaucaagaucacaccucagucuuccauuaccgaggccgaacugacgggguauggaaccgucacaauggaguguagcccccggaccggccucgauuucaacgaaauggugcugcuucagauggaggacaaggcuuggcugguucaccgccaaugguuucucgaucugccgcugccuuggcuccccggggccgacacacagggaucuaauuggauccagaaggagacccuggugacguucaagaacccucaugcuaaaaagcaggacgucgugguucuuggcucccaagaaggggccaugcacacagcccugaccggcgcuacagagauucagaugagcuccggaaaucuccuguuuaccggccaucuuaaaugcagacugcggauggauaagcuccagcugaaagggaugucuuacagcauguguaccggaaaguucaagaucgugaaagaaauugcggagacacaacacggcacgaucgucaucagagugcaguaugagggggacggaucccccugcaagauucccuucgaaaucauggaucuggagaaacgccauguccucggccggcugauuaccgugaacccuaucguuacagaaaaggacagcccggugaacauugaggccgaacccccuuuuggggauucuuacaucauuaucggcgucgagcccggacagcuuaaacugaauugguucaagaagggcuccagcaucgggcagauguuugagaccacaaugagaggagcuaaacgcauggccauucucggcgacaccgccugggauuucgggucucugggaggcguguuuacgagcaucgggaaggcucugcaccaaguuuucggcgccauuuacggagcggcuuuuuccggcgugucuuggacaaugaaaauccuuauuggggucaucaucaccuggauuggaaugaacagccgguccaccagccucucugugucccuggugcugguuggcgucgugacacucuaucugggggccauggugcaggccgacagcggaugugucgugucuuggaagaauaaagaacuuaagugcggcuccgggaucuucauuaccgauaacguucacacauggacggagcaguacaaguuucagccugaaagccccuccaaacuggcuucugccauccaaaaggcucaugaggaaggcauuuguggaaucagaagcgugacccgccucgagaaucugauguggaaacagaucacaccggagcugaaccacauucuuuccgaaaaugaggucaagcucaccaucaugacaggcgacauuaaagggaucaugcaggccggaaagcggucucugagaccucagcccaccgaacugaaauauagcuggaagacguggggcaaggcgaaaaugcucuccaccgagagccauaaccaaacauuccugauugaugggccugaaaccgccgagugccccaauacaaaccgcgcuuggaacucucuugagguggaagacuacggauuuggcguuuucaccacaaacaucuggcugaagcuccgggagaaacaggacguguuuugugauuccaagcugaugagcgccgcuaucaaagacaauagagccguccacgcggauaugggcuauuggauugaaucugcccugaacgacaccuggaagauggagaaggcuuccuucaucgaggugaaaagcugccacuggccuaagucucauacgcuuuggagcaaugggguucucgaauccgagaugauuauccccaaaaacuucgccggaccggugagccagcacaacuaccgcccuggcuaucauacacagaccgcugggcccuggcaccugggaaagcuggaaauggauuuugacuucugugagggcaccacagucguggugaccgaagauugcgggaaucggggacccucucucagaacgacaaccgccuccggcaaacugauuacagaguggugcugucggagcugcacccuuccuccgcugcgcuacagaggcgaggacggguguugguacggaauggaaauccggccccucaaggagaaggaagagaaccuggucaauucccugguuacagccggccaugggcaaauugauaacuuuucucuuggaauccucggcauggcucuguuccuggaagagaugcucagaacccgcguggggacgaaacacgcgauccugcuuguggccgucagcuuugugacccugauuacaggaaauauguccuuccgggaccucggcagaguuauggugauggucggcgcuaccaugacagaugacaucgggaugggagugaccuaucuggcccugcuugccgcuuuuaagguucgcccuacguucgccgcgggccugcuccugagaaaacucacaucuaaggagcugaugauggcuaccauugggaucgcccuucugagccaguccacaauucccgaaaccauccucgagcugaccgaugcccuggcucuuggaaugauggugcugaaaaucguccggaacauggaaaaguaccagcucgccgugacaauuauggcgaucucuugcguuccuaaugcugugauucugcaaaacgccuggaaggucagcuguacgauccucgccgcuguguccgugagcccccugcuucugaccucuucccagcagaaagccgacuggauuccucucgcucugacaaucaagggccugaaucccaccgccaucuuucuuacaacccugagccgcacgucuaaaaagagauccuggccgcucaacgaggcgauuauggccgucgggaugguuagcauccuggcuucuucccuccugaaaaaugacauuccuaugacaggaccccuuguggccggcggccugcugaccgugugcuauguccucaccgggcggagcgcugaucuggaacuugagcgcgccgccgacgugaagugggaggaucaggcugaaaucuccggaagcucuccuauucugagcaucacaauuuccgaggacggcucuaugagcaucaaaaacgaagaggaggaacaaacccucacaauccugauuagaacggggcuccugguuaucuccggaguguuccccgucucuauuccgaucaccgcggccgcuugguaccuuugggaggugaagaagcagcgggccggcguucugugggaugugccuucucccccucccgucgggaaagccgaacuggaggacggagcuuaucgcauuaagcagagaggcauccucggcuacucccagaucggggccggaguguauaaagaaggcacauuucacaccauguggcaugucacaagaggggcggugcugaugcaccgcggaaagagaauugagcccuccugggcugauguuaaaaaggaccuuaucagcuacggcgggggauggaagcuggagggcgaauggaaagagggcgaagaggugcaaguccucgcccuggaaccugggaagaauccgcgggccgugcagaccaaacccggacucuucaagacgaacaccggcacaauuggggcuguuucccuggauuuuagcccuggaaccucuggcucccccaucguggacagaaaagggaaggucgugggacuuuacggcaauggcgugguuacacgcagcggggccuaugucucugcgauugcucagaccgagaaguccaucgaggauaacccugaaaucgaggacgauauuuuccggaaaaagagacugacaaucauggaccugcaucccggagccggcaaaacgaagcgcuaccucccugccauugugcgggaagcuaucaaaagagggcugcgcacccuuauucuggccccgacacggguggucgcugccgagauggaagaggcgcucagaggacugcccauccgcuaucagaccccugccauucgggcugagcacaccggcagagaaaucguggaccucaugugucaugccacauucacgaugcggcugcuuagccccguucgcgugccuaacuacaaucugaucauuauggaugaggcucacuuuaccgaccccgccuccaucgccgcuagaggguauauuucuacacgggucgaaaugggcgaggcggccggaaucuucaugaccgcuacaccgccuggcagccgcgaucccuuuccccaauccaacgccccuauuauggacgaggaaagagagauccccgaacggagcuggaacucugggcacgagugggugaccgauuucaagggaaagacgguuugguuugugccuuccaucaaagccggcaacgacauugcugccugccugagaaagaaugggaaaaaggucauccagcucagccgcaaaacauucgauucugaauacgugaagacccgggcgaacgacugggauuuuguugugaccacagacauuagcgagaugggagcuaauuucaaggccgagagagucaucgauccgcgccgguguaugaaacccgugauucugaccgacggcgaagagagagugauccuugccgggccuaugcccgucacacauuccucugcugcccagcgccggggcagaaucggacgcaacccuaagaaugaaaacgaccaauauauuuacaugggcgagccccuggaaaaugaugaggacugcgcgcacuggaaagaggccaagaugcuccuggauaacaucaauaccccggaagggauuaucccuagcauguuugagcccgaaagagagaaaguugacgcuauugauggagaauaccggcugcgcggcgaggccagaaagacguucguggaccucaugcggcgcggggaucuuccuguguggcuggcuuauagagucgccgcugagggaaucaacuacgccgaccggagaugguguuuugauggcauuaaaaauaaccagauccuggaagagaacguggaaguugagaucuggacaaaggagggggaacgcaagaaacucaagccccgguggcuggacgcgagaauuuauuccgauccucuugcccugaaagaguucaaggaguucgcugccggccgcaaaucucucacccugaaucugaucacagagaugggacggcuccccaccuuuaugacgcagaaggcuagagacgcccuugauaaccuggccgugcugcauaccgcugaagcgggcgggcgggccuacaaucacgcucucagcgagcugccggagacacuugaaacccugcuccugcugacacuccuugccaccgucacaggaggcauuuuccuguuucugauguccgggaagggaaucggcaaaaugacccucggcaugugcugcauuaucacggccagcauccugcuuugguaugcucagauucaaccucacuggaucgccgcgucuauuauccuggaguucuuucucauugugcugcugauccccgaacccgagaagcagcgcacaccucaggacaaccagcucaccuacguugugaucgccauucuuaccgucguggcugccacaauggcuaaugaaaugggguuccuggagaaaaccaagaaagaccugggacucggcuccaucacaacgcaagagagcgaauccaacauucuggauaucgaccuuagaccggccucugcguggacccuguaugccgucgcuacaaccuuugugacacccaugcuccggcauagcauugaaaauagcucuguuaacgugagccugaccgccaucgcuaaucaggccacggugcugauggggcucggaaagggcuggccucuuuccaagauggauauuggggucccccugcuggcuaucggauguuacagccagguuaacccuaucacccucacagccgcgcugcuucugcucguggcccacuacgcuauuaucggccccggccugcaggccaaagcuacccgcgaagcccaaaagagagccgcggcugggauuaugaaaaauccuacaguggacggaaucaccgucauugaucuggagccgauccccuaugacccuaaguucgaaaaacagcucggccaggugaugcuucugauccugugcguuacacaggugcucaugaugcggacaaccugggcccugugugaggcucuuacacuggccaccgggcccauuucuacccucugggagggaaacccuggccgcuuuuggaauacaacgaucgccgucuccauggcuaacauuuucagagggagcuaccuggccggagcgggccugcucuuuucuaucaugaagaauaccacaaacacccggcgcggcacagggaauauuggagaaacccuuggcgagaaguggaaauccagacugaacgcccugggaaagagcgaguuccaaaucuauaaaaagucuggaauccaggagguggaucggacgcucgcuaaagagggcauuaagagaggggaaacagaccaucacgccgucagccgcggauccgcuaaacugcggugguuuguggagagaaacaugguuacccccgaaggcaagguggucgaucuuggcugcgggcgcggaggcuggucuuacuauugugggggacugaagaaugugcgggagguuaaaggccucaccaaagggggaccgggccaugaagaaccuauccccaugagcacauacggcuggaaccuggugagacugcaguccggggucgacguguucuucacacccccugagaaaugcgauacacuccuuugugacauuggagaaagcucccccaauccuacgaucgaggccggccgcacccugcgggugcugaaccucguugaaaauuggcugaacaauaacacacaauuuugcauuaagguccuuaauccguauaugcccucugugaucgagaaaauggaaacccugcagagaaaguacgggggagcgcucgugcgcaacccucugagcagaaauuccacacacgagauguacugggucucuaacgccaccggcaauaucguuagcuccgugaacaugauuucuagaaugcugaucaaucgcuucacgaugaagcacaaaaaggcuaccuaugagcccgauguggaccucgggagcggaacacggaacauuggcaucgaauccgagauuccuaaccuugacaucauuggcaaaagaaucgaaaagaucaaacaggagcaugaaaccagcuggcacuacgaucaggaccaucccuauaagacaugggccuaccacgggucuuaugagaccaagcaaacaggauccgcuagcucuauggucaauggcgugguucgccugcugaccaaaccgugggauguggucccuauggugacgcagauggccaugacagacaccacccccuuugggcagcagagaguuuucaaggagaaaguggauacacggacgcaagaaccuaaggagggaaccaaaaagcucaugaagauuacagcugaauggcuguggaaagagcuuggcaagaaaaagacaccccgcauguguacaagagaggaauuuacccggaaagucagauccaacgccgcgcugggggccaucuucacagacgagaauaaguggaaaagcgcucgggaagccguggaggauucucgcuuuugggaacucauugacagagagcggaaccugcaccuggagggaaagugcgaaaccuguguguacaauaugaugggcaagcgcgagaaaaagcucggcgaguucgggaaagcuaagggauccagagccaucugguauauguggcugggcgcccgguuucuugaguucgaagcgcugggguuucucaacgaggaucauugguucagccgcggaaauucccugagcggcgucgagggggaaggccuucacagacugggauacauucuccgggacguuucuaaaaaggagggcggggcuauguacgccgaugacacggccggaugggacacccgcaucacacuggaagaucugaagaacgaggaaauggugaccaaucauaugaaaggcgagcacaagaaacucgcugaggccaucuuuaagcugacauaucagaacaaaguggucagagugcagcggccuacaccccgcgggacgguuauggacauuaucagcagacgggaucagcgcggauccggccaaguggggacauacggccuuaauaccuucacaaacauggaagcucagcugauuagacagauggagggagaaggcaucuucaagucuauucaacaucucaccgucacggaggagaucgccgugcagaauuggcuggcgcggguugggagagaacgccuuagccggauggccaucuccggagacgauugcguggucaagccgcuggacgauagauuugcuucugcccucaccgcucugaacgacaugggcaaagugcgcaaggauauucagcagugggagccuagccggggguggaaugacuggacacaaguucccuucugcucccaccacuuucaugaacuggugaugaaagauggaagaguccucgugguccccugucgcaaccaggacgagcugaucggccgggccagaauuucucagggggcgggcuggagccuuaaggaaaccgccugccugggaaaauccuaugcucagauguggacacucauguacuuccaccgccgggaucugagacuugccgcuaacgccaucuguagcgcugugccuucucauuggguuccgaccucccgcacaaccuggagcauucacgccaagcacgaguggaugacgacagaggacaugcuggcgguguggaaucgggucuggauccaagaaaaccccuggauggaggacaagaccccuguggaaucuugggaggaagugcccuaucucggcaaaagagaggaucaguggugcgggucccugauuggacugaccagccgggccacaugggcuaagaauauccagaccgccaucaaccagguuagaucccucauuggcaaugaggaauacacagacuauaugccuucuaugaaacgcuuucggagagaggaagaggaagccggggugcugugguga

SEQ ID NO: 19910 - RNA, 9876 nt, Artificial Sequence
  derived and/or modified CDS sequence (opt5) from DENV-2__EU482568__SS-prME
accgccggagugaucauuaugcugauccccacagcuauggccuuccaccucacgaccagaaauggggaaccucauaugauugugggacggcaggaaaagggaaaaagccugcuuuuuaagaccgaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaaggcgggauugugacaugcgccauguuuacgugcaaaaagaauauggaagggaaagucguucugccugagaaccuugaauacaccaucgugauuacaccccacagcggggaggagcaugcggugggaaaugacaccggcaagcacggcaaagaaaucaagaucacaccucagucuuccauuaccgaggccgaacugacgggguauggaaccgucacaauggaguguagcccccggaccggccucgauuucaacgaaauggugcugcuucagauggaggacaaggcuuggcugguucaccgccaaugguuucucgaucugccgcugccuuggcuccccggggccgacacacagggaucuaauuggauccagaaggagacccuggugacguucaagaacccucaugcuaaaaagcaggacgucgugguucuuggcucccaagaaggggccaugcacacagcccugaccggcgcuacagagauucagaugagcuccggaaaucuccuguuuaccggccaucuuaaaugcagacugcggauggauaagcuccagcugaaagggaugucuuacagcauguguaccggaaaguucaagaucgugaaagaaauugcggagacacaacacggcacgaucgucaucagagugcaguaugagggggacggaucccccugcaagauucccuucgaaaucauggaucuggagaaacgccauguccucggccggcugauuaccgugaacccuaucguuacagaaaaggacagcccggugaacauugaggccgaacccccuuuuggggauucuuacaucauuaucggcgucgagcccggacagcuuaaacugaauugguucaagaagggcuccagcaucgggcagauguuugagaccacaaugagaggagcuaaacgcauggccauucucggcgacaccgccugggauuucgggucucugggaggcguguuuacgagcaucgggaaggcucugcaccaaguuuucggcgccauuuacggagcggcuuuuuccggcgugucuuggacaaugaaaauccuuauuggggucaucaucaccuggauuggaaugaacagccgguccaccagccucucugugucccuggugcugguuggcgucgugacacucuaucugggggccauggugcaggccgacagcggaugugucgugucuuggaagaauaaagaacuuaagugcggcuccgggaucuucauuaccgauaacguucacacauggacggagcaguacaaguuucagccugaaagccccuccaaacuggcuucugccauccaaaaggcucaugaggaaggcauuuguggaaucagaagcgugacccgccucgagaaucugauguggaaacagaucacaccggagcugaaccacauucuuuccgaaaaugaggucaagcucaccaucaugacaggcgacauucgggggaucaugcaggccggaaaaagaucucugcgcccucagcccaccgaacugaaguauagcuggaaaacguggggcaaggcgaagaugcucuccaccgagagccauaaccaaacauuccugauugaugggccugaaaccgccgagugccccaauacaaaccgggcuuggaacucucuugagguggaagacuacggauuuggcguuuucaccacaaacaucuggcugaaacucagagagaagcaggacguguuuugugauuccaaacugaugagcgccgcuaucaaggacaaucgcgccguccacgcggauaugggcuauuggauugaaucugcccugaacgacaccuggaaaauggagaaggcuuccuucaucgaggucaagagcugccacuggccuaaaucucauacgcuuuggagcaaugggguucucgaauccgagaugauuauccccaagaacuucgccggaccggugagccagcacaacuaccggccuggcuaucauacacagaccgcugggcccuggcaccugggaaaacuggaaauggauuuugacuucugugagggcaccacagucguggugaccgaagauugcgggaauagaggacccucucuccggacgacaaccgccuccggcaagcugauuacagaguggugcugucgcagcugcacccuuccuccgcugagauaccggggcgaggacggguguugguacggaauggaaaucagaccccucaaagagaaggaagagaaccuggucaauucccugguuacagccggccaugggcaaauugauaacuuuucucuuggaauccucggcauggcucuguuccuggaagagaugcuccgcacccggguggggacgaagcacgcgauccugcuuguggccgucagcuuugugacccugauuacaggaaauauguccuucagagaccucggccgcguuauggugauggucggcgcuaccaugacagaugacaucgggaugggagugaccuaucuggcccugcuugccgcuuuuaaaguuagaccuacguucgccgcgggccugcuccugcggaagcucacaucuaaagagcugaugauggcuaccauugggaucgcccuucugagccaguccacaauucccgaaaccauccucgagcugaccgaugcccuggcucuuggaaugauggugcugaagaucguccgcaacauggaaaaauaccagcucgccgugacaauuauggcgaucucuugcguuccuaaugcugugauucugcaaaacgccuggaaggucagcuguacgauccucgccgcuguguccgugagcccccugcuucugaccucuucccagcagaaggccgacuggauuccucucgcucugacaaucaaaggccugaaucccaccgccaucuuucuuacaacccugagcagaacgucuaagaaacgguccuggccgcucaacgaggcgauuauggccgucgggaugguuagcauccuggcuucuucccuccugaagaaugacauuccuaugacaggaccccuuguggccggcggccugcugaccgugugcuauguccucaccgggcgcagcgcugaucuggaacuugagagagccgccgacgugaaaugggaggaucaggcugaaaucuccggaagcucuccuauucugagcaucacaauuuccgaggacggcucuaugagcaucaagaacgaagaggaggaacaaacccucacaauccugauucggacggggcuccugguuaucuccggaguguuccccgucucuauuccgaucaccgcggccgcuugguaccuuugggaggugaaaaagcagcgcgccggcguucugugggaugugccuucucccccucccgucgaaaaggccgagcuggaagacggggcuuauagaauuaaacagcggggaauccucggcuacucccagaucggcgccgggguguauaaggagggaacauuucacaccauguggcaugucacacgcggcgcggugcugaugcacagagggaaacggguugagcccuccugggcugaugugaagaaagaccuuauuagcuacggaggcggguggaagcuggaaggagaguggaaggaaggcgaggaaguccaagugcucgcccuggagccuggcaaaaauccgagagccguucagaccaagcccggacucuucaaaacgaacaccggaacaaucggcgcugugucccuggauuuuagcccugggaccucuggaucccccauugucgaccgcaagggcaaagugguggggcuuuacggaaauggcguugucacacggagcggcgccuaugugucugcgaucgcucagaccgagaaguccauugaagauaacccugagaucgaagacgauaucuucagaaagaaacgccugacaauuauggaccugcaucccggggccggaaagacgaaacgguaccucccugccaucgugagagaggcuauuaagcgcggccugcggacccuuauccuggccccgacaagagucguggcugccgaaauggaggaggcgcuccgcgggcugcccauucgguaucagaccccugccaucagagcugaacacaccggacgggagauuguugaccucaugugucaugccacauucacgaugcgccugcuuagccccgugagagucccuaacuacaaucugaucaucauggaugaagcucacuuuaccgaccccgccuccauugccgcucggggcuauaucucuacacgcguggagaugggggaggcggccggcauuuucaugaccgcuacaccgccuggaagcagagaucccuuuccccaauccaacgccccuaucauggacgaagaacgggaaauucccgagagaagcuggaacucuggccacgaauggguuaccgauuucaaagggaagacggugugguuugucccuuccaucaaggccggaaacgacaucgcugccugccugcgcaaaaauggcaagaaagugauucagcucagccggaagacauucgauucugaguacguuaaaaccagagcgaacgacugggauuuuguggucaccacagacaucagcgagaugggggcuaauuucaaggccgaacgcgugauugauccgcggagauguaugaagcccgugauccugaccgacggagaggaacgcgucauucuugccggcccuaugcccguuacacauuccucugcugcccagcggagagggcgcaucggcagaaacccuaaaaaugagaacgaccaauauaucuacaugggagaaccccuggagaaugaugaggacugcgcgcacuggaaggaagccaaaaugcuccuggauaacauuaauaccccggagggcaucauuccuagcauguuugaacccgagcgggaaaagguggacgcuaucgauggggaguaccgccugagaggagaggcccggaaaacguucguggaccucaugcgcagaggcgaucuuccugucuggcuggcuuaucggguggccgcugaagggauuaacuacgccgacagacgcugguguuuugauggaaucaagaauaaccagauucuggaggaaaacguugagguggagaucuggacaaaagaaggcgagcggaagaagcucaaacccagauggcuggacgcgcgcaucuauuccgauccucuugcccugaaggaguucaaagaguucgcugccgggcggaagucucucacccugaaucugauuacagaaaugggcagacuccccaccuuuaugacgcagaaagcucgggacgcccuugauaaccuggccguccugcauaccgcugaggcgggaggccgcgccuacaaucacgcucucagcgagcugccggaaacacuugagacccugcuccugcugacacuccuugccaccgugacagggggaaucuuccuguuucugauguccggcaaggggauuggaaagaugacccucggcaugugcugcaucauuacggccagcauccugcuuugguaugcucagauccaaccucacuggauugccgcgucuaucauucuggaguucuuucucaucguucugcugauucccgagcccgaaaaacagagaacaccucaggacaaccagcucaccuacguggucaucgccauccuuaccguggucgcugccacaauggcuaaugagaugggcuuccuggagaagaccaaaaaggaccuggggcucggauccauuacaacgcaagaaagcgaguccaacauccuggauauugaccuucggccggccucugcguggacccuguaugccguggcuacaaccuuuguuacacccaugcuccgccauagcaucgaaaauuccucugugaacgugagccugaccgccauugcuaaucaggccacgguccugaugggccucgggaaaggauggccucuuuccaagauggauaucggcguuccccugcuggcuauuggguguuacagccaggugaacccuaucacccucacagccgcgcugcuucugcucguggcccacuacgcuaucauuggacccggccugcaggccaaggcuaccagagaggcccaaaaacgggccgcggcuggcaucaugaagaauccuacagucgacgggauuaccgugaucgaucuggaaccgauucccuaugacccuaaauucgagaagcagcucggacagguuaugcuucugauccugugcgugacgcagguccucaugaugcgcacaaccugggcccugugugaggcucuuacacuggccaccggccccaucucuacccucugggaagggaacccuggaagauuuuggaauacaacgauugccguguccauggcuaacaucuuccggggcagcuaccuggccggggcgggacugcucuuuucuauuaugaaaaauaccacaaacacccgcagaggcacaggcaauaucggggagacccuuggagaaaaguggaagucccggcugaacgcccugggcaaaagcgaguuccaaauuuauaagaaaucugggauccaggaggucgauagaacgcucgcuaaggaaggaaucaaacgcggcgagacagaccaucacgccgugagccggggguccgcuaagcugagaugguuuguugaacgcaacauggugacccccgagggaaaagucguggaucuuggcugcggcagagggggauggucuuacuauuguggcgggcugaagaauguucgggaagugaagggacucaccaaaggcgggccgggacaugaggagccuauucccaugagcacauacggcuggaaccugguccgccugcaguccggcguggacguguucuucacacccccugaaaagugcgauacacuccuuugugacaucggggagagcucccccaauccuacgauugaagccggacggacccugagaguucugaaccucgucgagaauuggcugaacaauaacacacaauuuugcaucaaagugcuuaauccguauaugcccucugugauugaaaagauggagacccugcagcgcaaauacggcggggcgcucguccggaacccucugagcagaaauuccacacacgagauguacuggguuucuaacgccaccggaaauaucgugagcuccgugaacaugaucucucgcaugcugauuaaucgguucacgaugaagcacaagaaagcuaccuaugaacccgaugucgaccucggcagcgggacaagaaacaucggaauugaguccgaaaucccuaaccuugacauuaucggcaagcgcauugagaaaaucaagcaggaacaugagaccagcuggcacuacgaucaggaccaucccuauaaaacaugggccuaccacggcucuuaugagaccaagcaaacaggguccgcuagcucuauggugaauggaguugugagacugcugaccaagccgugggaugucgugccuaugguuacgcagauggccaugacagacaccacccccuuuggccagcagcggguguucaaagaaaaggucgauacacgcacgcaagagccuaaagaagggaccaagaaacucaugaagaucacagcugaguggcuguggaaggagcuuggcaagaagaaaacccccagaauguguacacgggaagaguuuaccagaaaggugcgguccaacgccgcgcugggcgccauuuucacagacgaaaauaaauggaaaagcgcucgcgaggccguggaagauucuagauuuugggagcucaucgaccgggagcgcaaccugcaccuggaagggaaaugcgagaccugugucuacaauaugaugggaaagagagaaaagaaacucggcgaguucggcaaggcuaaagggucccgggccauuugguauauguggcugggagcccgcuuucuugaguucgaggcgcugggcuuucucaacgaggaucauugguucagcagagggaauagccugagcggaguugaaggcgaggggcuucaccggcugggcuacauccuccgcgacgugucuaagaaagaaggaggcgcuauguacgccgaugacacggccgggugggacaccagaauuacacuggaggaucugaagaacgaagagauggugaccaaucauaugaagggagagcacaaaaagcucgcugaagccaucuuuaaacugacauaucagaacaaggucgugcggguucagcgcccuacccccagaggcacggugauggacaucauuagccggcgcgaucagagaggguccggacaagucggcacauacgggcuuaauaccuucacaaacauggaggcucagcugauccggcagauggaaggcgagggaauuuucaaaucuauccaacaucucaccgugacggaggaaauugccguucagaauuggcuggcgagagugggccgcgagcggcuuagcagaauggccaucuccggggacgauugcgucgugaagccgcuggacgaucgcuuugcuucugcccucaccgcucugaacgacaugggaaagguucggaaagauauccagcagugggaaccuagcagaggcuggaaugacuggacacaagugcccuucugcucccaccacuuucaugagcuggucaugaaggaugggcgcgugcucgucgugcccugucggaaccaggacgaacugauuggcagagcccgcaucucucagggcgcgggguggagccuuaaagagaccgccugccugggcaaguccuaugcucagaugugggcccucauguacuuccaccggagagaucugcgccuugcugccaacgcuauuuguagcgccguuccuucucauugggugccgacaucccggaccacauggagcauccacgcgaaacacgaguggaugaccacggaagacaugcuggccgucuggaauagaguguggauucaagagaaccccuggauggaagacaagacaccuguggagucuugggaagagguucccuaucucggaaagcgggaggaucaguggugcggcucccugaucgggcugaccagcagagcuaccugggccaaaaauauucagacagccaucaaccaggugcgcucccucaucggaaaugaagaguacaccgacuauaugccuucuaugaagcgguuuagacgcgaagaggaagaggcuggcguccugugguga

SEQ ID NO: 19911 - RNA, 9876 nt, Artificial Sequence
  derived and/or modified CDS sequence (opt5) from DENV-2__EU482569__SS-prME
accgccggcgugaucauuaugcugauccccacggcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugacacuguaucucggggccaugguccaggccgacagcggaugugugguuucuuggaagaauaaagaacugaagugcggcuccgggaucuucauuaccgauaacgugcacacauggacggagcaguacaaguuucagccugaaagccccuccaaacuugcuucugccauccaaaaggcucaugaggaaggcauuuguggaaucagaagcgucacccgccuggagaaucucauguggaaacagaucacaccggagcugaaccacauucuguccgaaaaugaggugaaacuuaccaucaugacaggcgacauuaaagggaucaugcaggccggaaagcggucucucagaccucagcccaccgaacugaaauauagcuggaagacguggggcaaggcgaaaaugcuguccaccgagagccauaaccaaacauuccucauugaugggccugaaaccgccgagugccccaauacaaaccgcgcuuggaacucucuggagguugaagacuacggauuuggcguguucaccacaaacaucuggcuuaagcugcgggagaaacaggacgucuuuugugauuccaagcucaugagcgccgcuaucaaagacaauagagccgugcacgcggauaugggcuauuggauugaaucugcccugaacgacaccuggaagauggagaaggcuuccuucaucgagguuaaaagcugccacuggccuaagucucauacgcuguggagcaauggggugcuugaauccgagaugauuauccccaaaaacuucgccggaccggucagccagcacaacuaccgcccuggcuaucauacacagaccgcugggcccuggcaccucggaaagcuggaaauggauuuugacuucugugagggcaccacagugguggucaccgaagauugcgggaaucggggacccucucugagaacgacaaccgccuccggcaaacucauuacagaguggugcugucggagcugcacccugccuccgcuucgcuacagaggcgaggacggguguugguacggaauggaaauccggccccugaaggagaaggaagagaaccucguuaauucccuggugacagccggccaugggcaaauugauaacuuuucucugggagugcuuggcauggcucucuuccuggaagagaugcugagaacccgcgucgggacgaaacacgcgauccuccugguggccguuagcuuugugacccuuaucacaggaaauauguccuuccgggaccugggcagagucauggugaugguuggcgcuaccaugacagaugacauugggaugggagugaccuaucucgcccugcuggccgcuuuuaagguccgcccuacguucgccgcgggccuucugcucagaaaacugacaucuaaggagcucaugauggcuaccaucgggauugcccugcuuagccaguccacaauccccgaaaccauucuggagcucaccgaugcccuggcucugggaaugauggugcuuaaaaucguucggaacauggaaaaguaccagcuggccgugacaaucauggcgauuucuugcgucccuaaugcugugauccuccaaaacgccuggaaggugagcuguacgauucuggccgcugucuccguuagcccccuccugcuuaccucuucccagcagaaagccgacuggaucccucuggcucucacaauuaagggccugaaucccaccgccaucuuucugacaacccuuagccgcacgucuaaaaagagauccuggccgcugaacgaggcgaucauggccguggggauggugagcauucucgcuucuucccugcucaaaaaugacaucccuaugacaggaccccuggucgccggcggccuucugaccgugugcuauguucugaccgggcggagcgcugaucucgaacuggagcgcgccgccgacgugaagugggaggaucaggcugaaauuuccggaagcucuccuauccuuagcauuacaaucuccgaggacggcucuaugagcauuaaaaacgaagaggaggaacaaacccugacaauccucaucagaacggggcugcucgucauuuccggaguguuccccguuucuaucccgauuaccgcggccgcuugguaccugugggaggugaagaagcagcgggccggcguccuuugggaugugccuucucccccucccgucgggaaagccgaacuggaggacggagcuuaucgcaucaagcagagaggcauucugggcuacucccagaucggggccggaguguauaaagaaggcacauuucacaccauguggcauguuacaagaggggcggugcucaugcaccgcggaaagagaaucgagcccuccugggcugaugucaaaaaggaccugauuagcuacggcgggggauggaaacuugagggcgaauggaaagagggcgaagaggugcaaguucuggcccucgaaccugggaagaauccgcgggccgugcagaccaaacccggacuguucaagacgaacaccggcacaaucggggcugucucccucgauuuuagcccuggaaccucuggcucccccauuguggacagaaaagggaaggugguuggacuguacggcaauggcgucgugacacgcagcggggccuaugugucugcgaucgcucagaccgagaaguccauugaggauaacccugaaaucgaggacgauaucuuccggaaaaagagacuuacaauuauggaccugcaucccggagccggcaaaacgaagcgcuaccugccugccaucguccgggaagcuauuaaaagagggcuccgcacccugauccuugccccgacacgggugguugcugccgagauggaagaggcgcugagaggacuccccauucgcuaucagaccccugccauccgggcugagcacaccggcagagaaauuguggaccugaugugucaugccacauucacgaugcggcuccugagccccguccgcgugccuaacuacaaucuuaucaucauggaugaggcucacuuuaccgaccccgccuccauugccgcuagaggguauaucucuacacggguugaaaugggcgaggcggccggaauuuucaugaccgcuacaccgccuggcagccgcgaucccuuuccccaauccaacgccccuaucauggacgaggaaagagagauucccgaacggagcuggaacucugggcacgagugggugaccgauuucaagggaaagacggucugguuugugccuuccaucaaagccggcaacgacaucgcugccugccugagaaagaaugggaaaaagguuauucagcugagccgcaaaacauucgauucugaauacgugaagacccgggcgaacgacugggauuuugucgugaccacagacaucagcgagaugggagcuaauuucaaggccgagagagugauugauccgcgccgguguaugaaacccgucauccucaccgacggcgaagagagaguuauucuggccgggccuaugcccgugacacauuccucugcugcccagcgccggggcagaaucggacgcaacccuaagaaugaaaacgaccaauauaucuacaugggcgagccccuugaaaaugaugaggacugcgcgcacuggaaagaggccaagaugcugcucgauaacauuaauaccccggaagggaucauuccuagcauguuugagcccgaaagagagaaaguggacgcuaucgauggagaauaccggcugcgcggcgaggccagaaagacguucgucgaccugaugcggcgcggggaucucccuguguggcuugcuuauagaguugccgcugagggaauuaacuacgccgaccggagaugguguuuugauggcaucaaaaauaaccagauucuggaagagaacguggaagucgagaucuggacaaaggagggggaacgcaagaaacugaagccccgguggcucgacgcgagaaucuauuccgauccucuggcccuuaaagaguucaaggaguucgcugccggccgcaaaucucugacccucaaucugauuacagagaugggacggcugcccaccuuuaugacgcagaaggcuagagacgcccucgauaaccuugccgugcugcauaccgcugaagcgggcgggcgggccuacaaucacgcucugagcgagcucccggagacacuggaaacccuucugcuccugacacugcucgccaccguuacaggaggcaucuuccuuuuucugauguccgggaagggaauuggcaaaaugacccugggcaugugcugcaucauuacggccagcauccuccugugguaugcucagauccaaccucacuggauugccgcgucuaucauucuugaguucuuucugaucgugcuccugauucccgaacccgagaagcagcgcacaccucaggacaaccagcugaccuacgucgugaucgccauccucaccgucguggcugccacaauggcuaaugaaaugggguuccuugagaaaaccaagaaagaccugggacugggcuccauuacaacgcaagagagcgaauccaacauccucgauauugaccugagaccggccucugcguggacccuuuaugccguugcuacaaccuuugugacacccaugcugcggcauagcaucgaaaauagcucugugaacgucagccucaccgccauugcuaaucaggccacgguucugauggggcugggaaagggcuggccucucuccaagauggauaucggggugccccuucuggcuauuggauguuacagccaggugaacccuaucacccugacagccgcgcuccugcuucuggucgcccacuacgcuaucauuggccccggccuccaggccaaagcuacccgcgaagcccaaaagagagccgcggcugggaucaugaaaaauccuacaguggacggaauuaccguuaucgaucuggagccgauucccuaugacccuaaguucgaaaaacagcugggccaggugaugcuccuuauccugugcgucacacaggugcugaugaugcggacaaccugggcccucugugaggcucugacacuugccaccgggcccaucucuacccugugggagggaaacccuggccgcuuuuggaauacaacgauugccgucuccauggcuaacaucuucagagggagcuaccucgccggagcgggccugcuguuuucuauuaugaagaauaccacaaacacccggcgcggcacagggaauaucggagaaacccucggcgagaaguggaaauccagacuuaacgcccuggggaagaacgaguuccaaauuuauaaaaagagcggaauccaggagguggaucggacgcuggcuaaagagggcaucaagagaggggaaacagaccaucacgccguuucucgcggaagcgcuaaacuccggugguuuguggagagaaauauggucauucccgaaggcaaggugguugaucugggcugcgggcgcggaggcugguccuacuauugugggggacuuaagaacgugcgggaggucaaaggccugaccaaagggggaccgggccaugaagaaccuauccccaugucuaccuacggcuggaaucucgugagacugcagagcgggguggacguuuucuucacacccccugagaaaugcgauacccugcucugugacauuggagaauccagccccaacccuacaaucgaggccggccgcacgcuucggguccugaaucugguggaaaacuggcucaauaacaauacccaauuuugcauuaaggugcugaacccguauaugcccuccgucaucgagaaaauggaaacacuucagagaaaguacgggggagcgcugguucgcaauccucucucucggaacagcacccacgagauguacuggguguccaaugccacaggcaacaucgugucuagcgucaauaugauuuccagaaugcugaucaaccgcuucaccaugaagcacaaaaaggcuacguaugagcccgauguggaccuggggucuggaacccggaacauuggcaucgaaagcgagauuccuaaucucgacaucauuggcaaaagaaucgaaaagaucaaacaggagcaugaaacauccuggcacuacgaucaggaccaucccuauaagaccugggccuaccacgggagcuaugagacaaagcaaaccggaucugcuuccagcaugguuaacggcgugguccgccuucugacaaaaccgugggaugugguuccuauggugacccagauggccaugacggacacaacccccuuugggcagcagagagucuucaaggagaaaguggauacccggacacaagaaccuaaggagggaacgaaaaagcugaugaagauuaccgcugaauggcucuggaaagagcugggcaagaaaaagacaccccgcauguguaccagagaggaauuuacacggaaagugagaucuaaugccgcgcuuggggccaucuucaccgacgagaacaaguggaaauccgcucgggaagccgucgaggauagccgcuuuugggaacugauugacagagagcggaaucuccaccuggagggaaagugcgaaacauguguuuacaacaugaugggcaagcgcgagaaaaagcugggcgaguucgggaaagcuaagggaucuagagccaucugguauauguggcucggcgcccgguuucuggaguucgaagcgcuuggguuucugaaugaggaucauugguucucccgcggaaacagccucuccggcguggagggggaaggccugcacagacuuggauacauucugcgggacgugagcaaaaaggagggcggggcuauguacgccgaugacaccgccggaugggacacgcgcaucacccucgaagaucugaagaaugaggaaauggucacaaaccauaugaaaggcgagcacaagaaacuggcugaggccaucuuuaagcucaccuaucagaauaaagugguuagagugcagcggccuacaccccgcgggaccgucauggacauuaucucuagacgggaucagcgcggaagcggccaaguggggacguacggccugaacacauucaccaauauggaagcucagcuuauuagacagauggagggagaaggcaucuucaaguccauucaacaucugacaguuaccgaggagaucgccgugcagaacuggcucgcgcgggucgggagagaacgccugucucggauggccaucagcggagacgauugcgugguuaagccgcuugacgauagauuugcuuccgcccugacggcucucaaugacaugggcaaagugcgcaaggauauucagcagugggagccuucucggggguggaacgacuggacccaaguccccuucugcagccaccacuuucaugaacuggugaugaaagauggaagaguccuggugguucccugucgcaaccaggacgagcucaucggccgggccagaauuucccagggggcgggcuggucucugaaggaaacagccugccuuggaaaaagcuaugcucagauguggacccugauguacuuccaccgccgggaucucagacuggccgcuaaugccaucuguuccgcugugccuagccauugggucccgacaucucgcaccacaugguccauucacgccaagcacgaguggaugaccacggaggacaugcuugcgguguggaaccggguguggauccaagaaaaucccuggauggaggacaagacaccuguugaaagcugggaggaagugcccuaucugggcaaaagagaggaucaguggugcgggucucucauuggacugaccucccgggccaccugggcuaagaacauccagacagccaucaaucaggucagaagccugauuggcaacgaggaauacaccgacuauaugccuuccaugaaacgcuuucggagagaggaagaggaagccggggugcucugguga

SEQ ID NO: 19912 - RNA, 9876 nt, Artificial Sequence
  derived and/or modified CDS sequence (opt5) from DENV-2__EU482570__SS-prME
accgcgggagugaucauuaugcugauccccaccgcuauggccuuccaccucacgaccagaaauggggaaccucauaugauugucggacggcaggaaaagggcaaaucccugcuuuuuaagaccgaagacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuucugugcaagcauuccaugguggauagaggcuggggcaacggguguggacucuucggcaaaggcgggauugugacaugcgccauguuuacgugcaaaaagaauauggaagggaaagucguucagccugagaaccuggaauacaccaucgugauuacaccccacagcggggaggagcaugcggugggaaaugacaccggcaagcacggcaaagaaaucaagaucacaccucagucuuccauuaccgaggccgaacuuacgggguauggaaccgucacaauggaguguagcccccggaccggccuggauuucaacgaaauggugcuccugcaaauggaggacaaggcuuggcuuguucaccgccagugguuucuggaucucccgcugccuuggcugcccggggccgacacacagggaucuaauuggauccagaaggagacccucgugacguucaagaacccucaugcuaaaaagcaagacgucgugguucugggcucccaggaaggggccaugcacacagcccuuaccggcgcuacagagauucagaugagcuccggaaaucugcucuuuaccggccaucugaaaugcagacuucggauggauaagcugcaacucaaagggaugucuuacagcauguguaccggaaaguucaagaucgugaaagaaauugcggagacacagcacggcacgaucgucaucagagugcaguaugagggggacggaucccccugcaagauucccuucgaaaucauggaucuggagaaacgccauguccugggccggcucauuaccgugaacccuaucguuacagaaaaggacagcccggugaacauugaggccgaacccccuuuuggggauucuuacaucauuaucggcgucgagcccggacagcugaaacuuaauugguucaagaagggcuccagcaucgggcaaauguuugagaccacaaugagaggagcuaaacgcauggccauucugggcgacaccgccugggauuucgggucucucggaggcguguuuacgagcaucgggaaggcucugcaccagguuuucggcgccauuuacggagcggcuuuuuccggcgugucuuggacaaugaaaauccugauuggggucaucaucaccuggauuggaaugaacagccgguccaccagccuuucugugucccucgugcugguuggcgucgugacacuguaucucggggccauggugcaggccgacagcggaugugucgugucuuggaagaauaaagaacugaagugcggcuccgggaucuucauuaccgauaacguucacacauggacggagcaguacaaguuucaaccugaaagccccuccaaacuugcuucugccauccagaaggcucaugaggaaggcauuuguggaaucagaagcgugacccgccuggagaaucucauguggaaacaggucacaccggagcugaaccacauccuguccgaaaaugaggugaaacuuaccauuaugacaggcgacaucaaagggauuaugcaggccggaaagcggucucucagaccucaacccaccgaacugaaauauagcuggaagacguggggcaaggcgaaaaugcuguccaccgagagccauaaccagacauuccucaucgaugggccugaaaccgccgagugccccaauacaaaccgcgcuuggaacucucuggagguugaagacuacggauuuggcguguucaccacaaacauuuggcuuaagcugcgggagaaacaggacgucuuuugugauuccaagcucaugagcgccgcuaucaaagacaauagagccgugcacgcggauaugggcuauuggaucgaaucugcccugaacgacaccuggaagauggagaaggcuuccuucauugagguuaaaagcugccacuggccuaagucucauacgcuguggagcaauggggugcuugaauccgagaugaucauucccaaaaacuucgccggaccggucagccagcacaacuaccgcccuggcuaucauacacaaaccgcugggcccuggcaccucggaaagcuggaaauggauuuugacuucugugagggcaccacagugguggucaccgaagauugcgggaaucggggacccucucugagaacgacaaccgccuccggcaaacucaucacagaguggugcugucggagcugcacccugccuccgcuucgcuacagaggcgaggacggguguugguacggaauggaaauucggccccugaaggagaaggaagagaaccucguuaauucccuggugacagccggccaugggcagaucgauaacuuuucucugggagugcuuggcauggcucucuuccuggaagagaugcugagaacccgcgucgggacgaaacacgcgauucuccugguggccguuagcuuugugacccuuaucacaggaaauauguccuuccgggaccugggcagagucauggugaugguuggcgcuaccaugacagaugacaucgggaugggagugaccuaucucgcccugcuggccgcuuuuaagguccgcccuacguucgccgcgggccuucugcucagaaaacugacaucuaaggagcucaugauggcuaccauugggaucgcccugcuuagccaguccacaauucccgaaaccauccuggagcucaccgaugcccuggcucugggaaugauggugcuuaaaauuguucggaacauggaaaaguaccaacuggccgugacaaucauggcgaucucuugcgucccuaaugcugugauucuccagaacgccuggaaggugggcuguacgauccuggccgcugucagcguuagcccccuccugcuuaccagcucucagcagaaagccgacuggauuccucuggcucucacaaucaaggggcugaaucccaccgccauuuuucugacaacccuuucccgcacgagcaaaaagagaucuuggccgcugaacgaggcgaucauggccgugggaaugguguccauccucgcuagcucucugcucaaaaaugacauuccuaugacaggcccccuggucgccggcgggcuucugaccgugugcuauguucugaccggacgguccgcugaucucgaacuggagcgcgccgccgacgugaagugggaggaucaagcugaaaucagcggcuccagcccuauucuuucuaucacaauuagcgaggacggguccaugucuaucaaaaacgaagaggaggaacagacccugacaauucucaucagaacgggacugcucgucaucagcggcguguuccccguuuccauuccgaucaccgcggccgcuugguaccugugggaggugaagaagcagcgggccgggguccuuugggaugugccuucucccccucccgucggaaaagccgaacuggaggacggcgcuuaucgcauuaagcagagaggcauccugggguacagccaaauuggagccggcguguauaaagaagggacauuucacaccauguggcauguuacacggggagcggugcucaugcaccgcggcaagagaaucgagcccuccugggcugaugucaaaaaggaccugaucucuuacgggggaggcuggaaacuugagggcgaauggaaagagggggaagaggugcagguucuggcccucgaaccuggaaagaauccgcgggccgugcagaccaaacccggccuguucaagacgaacaccgggacaauuggagcugucagccucgauuuuuccccuggcaccagcgggucucccaucguggacagaaaaggaaaggugguuggccuguacggcaauggggucgugacacgcuccggagccuaugugagcgcgauugcucagaccgagaagucuaucgaggauaacccugaaauugaggacgauaucuuccggaaaaagagacuuacaaucauggaccugcaucccggcgccgggaaaacgaagcgcuaccugccugccauuguccgggaagcuaucaaaagaggacuccgcacccugauucuugccccgacacgggugguugcugccgagauggaagaggcgcugagaggccuccccauccgcuaucaaaccccugccauucgggcugagcacaccgggagagaaaucguggaccugaugugucaugccacauucacgaugcggcuccugucccccguccgcgugccuaacuacaaucuuauuaucauggaugaggcucacuuuaccgaccccgccagcaucgccgcuagaggcuauauuuccacacggguugaaaugggagaggcggccggcaucuucaugaccgcuacaccgccugggucucgcgaucccuuuccccagagcaacgccccuauuauggacgaggaaagagagauccccgaacgguccuggaauagcggacacgagugggugaccgauuucaagggcaagacggucugguuugugccuucuauuaaagccgggaacgacaucgcugccugccugagaaagaauggcaagaagguuauccagcugucccgcaaaacauucgauagcgaauacgugaagacccgggcgaacgacugggauuuugucgugaccacagacauuucugagaugggcgcuaauuucaaggccgagagagugaucgauccgcgccgguguaugaaacccgucauucucaccgacggggaagagagaguuauccuggccggcccuaugcccgugacacauagcuccgcugcccaacgccggggaagaauuggccgcaacccuaagaaugaaaacgaccaguauaucuacaugggggagccccuugaaaaugaugaggacugcgcgcacuggaaagaggccaagaugcugcucgauaacaucaauaccccggaaggaauuaucccuucuauguuugagcccgaaagagagaaaguggacgcuauugauggcgaauaccggcugcgcggggaggccagaaagacguucgucgaccugaugcggcgcggagaucucccuguguggcuugcuuauagaguugccgcugagggcaucaacuacgccgaccggagaugguguuuugaugggauuaaaaauaaccagauccuggaagagaacguggaagucgagauuuggacaaaggagggcgaacgcaagaaacugaagccccgguggcucgacgcgagaaucuauagcgauccucuggcccuuaaagaguucaaggaguucgcugccggacgcaaaucccugacccucaaucugaucacagagaugggccggcugcccaccuuuaugacgcagaaggcuagagacgcccucgauaaccuugccgugcugcauaccgcugaagccgggggaaaggccuacaaucacgcucugucugagcucccggagacacuggaaacccuucugcuccugacacugcucgccaccguuacaggcgggauuuuccuuuuucugaugagcggaaaaggcaucggcaagaugacccuggggaugugcugcauuaucacggccuccauucuccugugguaugcucaaauccagccucacuggaucgccgcgagcauuauccuugaguucuuucugauugugcuccugauccccgaacccgagaaacagcggacaccucaggacaaccaacugaccuacgucgugauugccauccucaccgucguggcugccacaauggcuaaugaaaugggauuccuugagaagaccaaaaaggaccugggccuggggucuaucacaacgcaggaguccgaaagcaacauucucgauaucgaccugcgcccggccuccgcguggacccuuuaugccguugcuacaaccuuugugacacccaugcugagacauucuauugagaauagcuccgugaacgucucucucaccgccaucgcuaaucaggccacgguucugaugggacugggcaagggguggccucucagcaaaauggauauuggagugccccuucuggcuaucggcuguuacucccaggugaacccuauuacccugacagccgcgcuccugcuucuggucgcccacuacgcuaucaucggccccgggcuccaagccaaggcuacccgggaagcccagaaacgcgccgcggcuggaauuaugaagaauccuacaguggacggcaucaccguuauugaucuggagccgauccccuaugacccuaaauucgaaaagcagcugggacaggugaugcuccuuauucugugcgucacgcaagugcugaugaugagaacaaccugggcccucugugaggcucugacacuugccaccggacccaucagcacccugugggagggcaacccugggcgguuuuggaauacaacgaucgccgucucuauggcuaacauuuuccgcggauccuaccucgccggcgcgggccugcuguuuagcaucaugaagaauaccacaaacaccagacgggggacaggaaauauuggcgaaacccucggggagaaauggaagucucgccuuaacgcccugggaaaauccgaguuccagaucuauaagaaaagcggcauucaggagguggauagaacgcuggcuaaggaggggaucaaacggggagaaacagaccaucacgccguuucuagaggcagcgcuaagcuccgcugguuuguggagcggaacauggucacccccgaaggcaaggugguugaucuggggugcggaagaggcgggugguccuacuauuguggaggccuuaaaaaugugcgcgaggucaaggggcugaccaaaggaggcccgggccaugaagaaccuauccccaugucuacauacggguggaaccucgugcggcugcaaagcggaguggacguuuucuucacacccccugagaagugcgauacacugcucugugacauuggcgaauccagccccaauccuacgaucgaggccgggagaacccuucgcguccugaaccugguggaaaauuggcucaacaauaacacacaguuuugcauuaaagugcugaauccguauaugcccuccgucaucgagaagauggaaacccuucagcggaaguacggaggcgcgcugguuagaaacccucucucucgcaauagcacacacgagauguacuggguguccaacgccaccgggaauauugugucuagcgucaacaugaucucccggaugcugaucaauagauucacgaugaaacacaagaaagcuaccuaugagcccgauguggaccugggaucuggcacacgcaacauuggcaucgaaagcgagauuccuaaccucgacaucauugggaagcggaucgagaagauuaagcaggagcaugaaaccuccuggcacuacgaucaagaccaucccuauaagacaugggccuaccacggaagcuaugagaccaaacagacaggcucugcuuccagcaugguuaaugggguggucagacuucugaccaagccgugggaugugguuccuauggugacgcagauggccaugacagacaccacccccuuuggacagcaacgcgucuucaaagagaagguggauacaagaacgcaggaaccuaaagagggcaccaagaagcugaugaaaaucacagcugaauggcucuggaaggagcuggggaaaaagaaaacaccccggauguguacacgcgaggaauuuaccagaaaggugcggucuaacgccgcgcuuggagccaucuucacagacgagaauaaauggaaguccgcuagagaagccgucgaggauagccgguuuugggaacugguugaccgcgagagaaaccuccaccuggagggcaagugcgaaaccuguguguacaauaugaugggcaaacgggagaagaaacugggggaguucggaaaggcuaaaggcucucgcgccauuugguauauguggcucggggccagauuucuggaguucgaagcgcuuggauuucugaacgaggaucauugguucucccggggcaauagccucuccgggguggagggcgaaggacugcaccgccuuggcuacauccugaaggacgucagcaagaaagaagggggagcuauguacgccgaugacacggccggcugggacaccagaauuacacucgaagaucugaagaacgaggaaauggugaccaaucauaugaaaggggagcacaagaaacuggcugaggccaucuuuaagcucacauaucagaacaagguugugcggguccagcgcccuacccccagaggaacggugauggacauuaucucucggcgcgaucaaagaggcagcgggcagguuggcacauacggacugaauaccuucacaaacauggaagcucagcuuauccggcaaauggagggcgaagggauuuucaaauccauccagcaucugaccgugacggaggagauugccguccagaauuggcucgcgcgcgugggaagagaacggcugucuagaaugguuaucagcggcgacgauugcguggucaagccgcuugacgaucgcuuugccuccgcucugaccgcccucaacgacauggggaaagugcggaaggauauucagcaaugggagccuucuagaggauggaaugacuggacacagguccccuucugcagccaccacuuucaugaacuggugaugaaagauggccgcguucuggugguccccugucggaaccaggacgagcucaucgggagagcucgcaucucccagggcgccggauggucucugaaggaaaccgcgugccuuggcaagagcuaugcccaaauguggacacugauguacuuccaccggagagaucuccgccuggcugccaacgcuauuuguuccgccgugccuagccauugggugccgaccucucggacaaccugguccauccacgcuaaacacgaguggaugacgacagaggacaugcuugccguuuggaauagaguguggauucaggaaaaccccuggauggaggacaagaccccugucgaaagcugggaggaagugcccuaucuggggaaacgcgaggaucaguggugcggaucucucaucggccugaccucccgggcgacaugggccaagaauauucagaccgcuaucaaccaaguuagaagccugauugggaaugaggaauacacagacuauaugccuuccaugaaacgguuuagacgcgaggaagaggaagccggagugcucugguga

SEQ ID NO: 19913 - RNA, 9876 nt, Artificial Sequence
  derived and/or modified CDS sequence (opt5) from DENV-2__EU482571__SS-prME
accgccggcgugaucauuaugcugauccccaccgcuauggccuuccaccucacgacccggaauggggaaccucauaugauugucggacggcaggaaaagggcaaaagccugcuuuuuaagaccgaggacgggguuaauaugugcacccugauggcgaucgaucucggagaacugugugaggacaccauuaccuacaaaugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaaggcgggauugugacaugcgccauguuuacgugcaaaaagaauauggaagggaaagucguucugccugagaaccuugaauacaccaucgugauuacaccccacagcggggaggagcaugcggugggaaaugacaccggcaagcacggcaaagaaaucaagaucacaccucagucuuccauuaccgaggccgaacugacgggguauggaaccgucacaauggaguguagcccccggaccggccucgauuucaacgaaauggugcugcuucagauggaggacaaggcuuggcugguucaccgccaaugguuucucgaucugccgcugccuuggcuccccggggccgacacacagggaucuaauuggauccagaaggagacccuggugacguucaagaacccucaugcuaaaaagcaggacgucgugguucuuggcucccaagaaggggccaugcacacagcccugaccggcgcuacagagauucagaugagcuccggaaaucuccuguuuaccggccaucuuaaaugcagacugcggauggauaagcuccagcugaaagggaugucuuacagcauguguaccggaaaguucaagaucgugaaagaaauugcggagacacaacacggcacgaucgucaucagagugcaguaugagggggacggaucccccugcaagauucccuucgaaaucauggaucuggagaaacgccauguccucggccggcugauuaccgugaacccuaucguuacagaaaaggacagcccggugaacauugaggccgaacccccuuuuggggauucuuacaucauuaucggcgucgagcccggacagcuuaaacugaauugguucaagaagggcuccagcaucgggcagauguuugagaccacaaugagaggagcuaaacgcauggccauucucggcgacaccgccugggauuucgggucucugggaggcguguuuacgagcaucgggaaggcucugcaccaaguuuucggcgccauuuacggagcggcuuuuuccggcgugucuuggacaaugaaaauccuuauuggggucaucaucaccuggauuggaaugaacagccgguccaccagccucucugugucccuggugcugguuggcgucgugacacucuaucugggggccauggugcaggccgacagcggaugugucgugucuuggaagaauaaagaacuuaagugcggcuccgggaucuucauuaccgauaacguucacacauggacggagcaguacaaguuucagccugaaagccccuccaaacuggcuucugccauccaaaaggcucaugaggaaggcauuuguggaaucagaagcgugacccgccucgagaaucugauguggaaacagaucacaccggagcugaaccacauucuuuccgaaaaugaggucaagcucaccaucaugacaggcgacauuaaagggaucaugcaggccggaaagcggucucugagaccucagcccaccgaacugaaauauagcuggaagacguggggcaaggcgaaaaugcucuccaccgagagccauaaccaaacauuccugauugaugggccugaaaccgccgagugccccaauacaaaccgcgcuuggaacucucuugagguggaagacuacggauuuggcguuuucaccacaaacaucuggcugaagcuccgggagaaacaggacguguuuugugauuccaagcugaugagcgccgcuaucaaagacaauagagccguccacgcggauaugggcuauuggauugaaucugcccugaacgacaccuggaagauggagaaggcuuccuucaucgaggugaaaagcugccacuggccuaagucucauacgcuuuggagcaaugggguucucgaauccgagaugauuauccccaaaaacuucgccggaccggugagccagcacaacuaccgcccuggcuaucauacacagaccgcugggcccuggcaccugggaaagcuggaaauggauuuugacuucugugagggcaccacagucguggugaccgaagauugcgggaaucggggacccucucucagaacgacaaccgccuccggcaaacugauuacagaguggugcugucggagcugcacccuuccuccgcugcgcuacagaggcgaggacggguguugguacggaauggaaauccggccccucaaggagaaggaagagaaccuggucaauucccugguuacagccggccaugggcaaauugauaacuuuucucuuggagugcucggcauggcucuguuccuggaagagaugcucagaacccgcguggggacgaaacacgcgauccugcuugucgccgugagcuuuguuacccugaucacaggaaauauguccuuccgggaccucggcagagugauggucauggugggcgcuaccaugacagaugacauugggaugggaguuaccuaucuggcccugcuugccgcuuuuaaggugcgcccuacguucgccgcgggccugcuccugagaaaacucacaucuaaggagcugaugauggcuaccaucgggauugcccuucugagccaguccacaauccccgaaaccauucucgagcugaccgaugcccuggcucuuggaaugaugguccugaaaaucgugcggaacauggaaaaguaccagcucgccguuacaaucauggcgauuucuugcgugccuaaugcugucauccugcaaaacgccuggaaggugagcuguacgauucucgccgcuguguccgucagcccccugcuucugaccucuucccagcagaaagccgacuggaucccucucgcucugacaauuaagggccugaaucccaccgccaucuuucuuacaacccugagccgcacgucuaaaaagagauccuggccgcucaacgaggcgaucauggccguugggauggugagcauucuggcuucuucccuccugaaaaaugacaucccuaugacaggaccccuuguggccggcggccugcugaccgucugcuaugugcucaccgggcggagcgcugaucuggaacuugagcgcgccgccgacguuaagugggaggaucaggcugaaauuuccggaagcucuccuauccugagcauuacaaucuccgaggacggcucuaugagcauuaaaaacgaagaggaggaacaaacccucacaauccugaucagaacggggcuccuggugauuuccggagucuuccccgugucuaucccgauuaccgcggccgcuugguaccuuugggagguuaagaagcagcgggccggcgugcugugggaugucccuucucccccucccguggggaaagccgaacuggaggacggagcuuaucgcaucaagcagagaggcauucucggcuacucccagaucggggccggagucuauaaagaaggcacauuucacaccauguggcaugugacaagaggggcgguucugaugcaccgcggaaagagaaucgagcccuccugggcugaugugaaaaaggaccuuauuagcuacggcgggggauggaagcuggagggcgaauggaaagagggcgaagagguccaagugcucgcccuggaaccugggaagaauccgcgggccguucagaccaaacccggacucuucaagacgaacaccggcacaaucggggcugugucccuggauuuuagcccuggaaccucuggcucccccauugucgacagaaaagggaagguggugggacuuuacggcaauggcguugucacacgcagcggggccuaugugucugcgaucgcucagaccgagaaguccauugaggauaacccugaaaucgaggacgauaucuuccggaaaaagagacugacaauuauggaccugcaucccggagccggcaaaacgaagcgcuaccucccugccaucgugcgggaagcuauuaaaagagggcugcgcacccuuauccuggccccgacacgggucguggcugccgagauggaagaggcgcucagaggacugcccauucgcuaucagaccccugccauccgggcugagcacaccggcagagaaauuguugaccucaugugucaugccacauucacgaugcggcugcuuagccccgugcgcgucccuaacuacaaucugaucaucauggaugaggcucacuuuaccgaccccgccuccauugccgcuagaggguauaucucuacacggguggaaaugggcgaggcggccggaauuuucaugaccgcuacaccgccuggcagccgcgaucccuuuccccaauccaacgccccuaucauggacgaggaaagagagauucccgaacggagcuggaacucugggcacgaguggguuaccgauuucaagggaaagacggugugguuugucccuuccaucaaagccggcaacgacaucgcugccugccugagaaagaaugggaaaaaggugauucagcucagccgcaaaacauucgauucugaauacguuaagacccgggcgaacgacugggauuuuguggucaccacagacaucagcgagaugggagcuaauuucaaggccgagagagugauugauccgcgccgguguaugaaacccgugauccugaccgacggcgaagagagagucauucuugccgggccuaugcccguuacacauuccucugcugcccagcgccggggcagaaucggacgcaacccuaagaaugaaaacgaccaauauaucuacaugggcgagccccuggaaaaugaugaggacugcgcgcacuggaaagaggccaagaugcuccuggauaacauuaauaccccggaagggaucauuccuagcauguuugagcccgaaagagagaaaguggacgcuaucgauggagaauaccggcugcgcggcgaggccagaaagacguucguggaccucaugcggcgcggggaucuuccugucuggcuggcuuauagaguggccgcugagggaauuaacuacgccgaccggagaugguguuuugauggcaucaaaaauaaccagauucuggaagagaacguugaaguggagaucuggacaaaggagggggaacgcaagaaacucaagccccgguggcuggacgcgagaaucuauuccgauccucuugcccugaaagaguucaaggaguucgcugccggccgcaaaucucucacccugaaucugauuacagagaugggacggcuccccaccuuuaugacgcagaaggcuagagacgcccuugauaaccuggccguccugcauaccgcugaagcgggcgggcgggccuacaaucacgcucucagcgagcugccggagacacuugaaacccugcuccugcugacacuccuugccaccgugacaggaggcaucuuccuguuucugauguccgggaagggaauuggcaaaaugacccucggcaugugcugcaucauuacggccagcauccugcuuugguaugcucagauccaaccucacuggauugccgcgucuaucauucuggaguucuuucucaucguucugcugauucccgaacccgagaagcagcgcacaccucaggacaaccagcucaccuacguggucaucgccauccuuaccguggucgcugccacaauggcuaaugaaaugggguuccuggagaaaaccaagaaagaccugggacucggcuccauuacaacgcaagagagcgaauccaacauccuggauauugaccuuagaccggccucugcguggacccuguaugccguggcuacaaccuuuguuacacccaugcuccggcauagcaucgaaaauagcucugugaacgugagccugaccgccauugcuaaucaggccacgguccugauggggcucggaaagggcuggccucuuuccaagauggauaucgggguuccccugcuggcuauuggauguuacagccaggugaacccuaucacccucacagccgcgcugcuucugcucguggcccacuacgcuaucauuggccccggccugcaggccaaagcuacccgcgaagcccaaaagagagccgcggcugggaucaugaaaaauccuacagucgacggaauuaccgugaucgaucuggagccgauucccuaugacccuaaguucgaaaaacagcucggccagguuaugcuucugauccugugcgugacgcagguccucaugaugcggacaaccugggcccugugugaggcucuuacacuggccaccgggcccaucucuacccucugggagggaaacccuggccgcuuuuggaauacaacgauugccguguccauggcuaacaucuucagagggagcuaccuggccggagcgggccugcucuuuucuauuaugaagaauaccacaaacacccggcgcggcacagggaauaucggagaaacccuuggcgagaaguggaaauccagacugaacgcccugggaaagagcgaguuccaaauuuauaaaaagucuggaauccaggaggucgaucggacgcucgcuaaagagggcaucaagagaggggaaacagaccaucacgccgugagccgcggauccgcuaaacugcggugguuuguugagagaaacauggugacccccgaaggcaaggucguggaucuuggcugcgggcgcggaggcuggucuuacuauugugggggacugaagaauguucgggaggugaaaggccucaccaaagggggaccgggccaugaagaaccuauucccaugagcacauacggcuggaaccuggucagacugcaguccgggguggacguguucuucacacccccugagaaaugcgauacacuccuuugugacaucggagaaagcucccccaauccuacgauugaggccggccgcacccugcggguucugaaccucgucgaaaauuggcugaacaauaacacacaauuuugcaucaaggugcuuaauccguauaugcccucugugauugagaaaauggaaacccugcagagaaaguacgggggagcgcucguccgcaacccucugagcagaaauuccacacacgagauguacuggguuucuaacgccaccggcaauaucgugagcuccgugaacaugaucucuagaaugcugauuaaucgcuucacgaugaagcacaaaaaggcuaccuaugagcccgaugucgaccucgggagcggaacacggaacaucggcauugaauccgagaucccuaaccuugacauuaucggcaaaagaauugaaaagaucaaacaggagcaugaaaccagcuggcacuacgaucaggaccaucccuauaagacaugggccuaccacgggucuuaugagaccaagcaaacaggauccgcuagcucuauggugaauggcguugugcgccugcugaccaaaccgugggaugucgugccuaugguuacgcagauggccaugacagacaccacccccuuugggcagcagagaguguucaaggagaaagucgauacacggacgcaagaaccuaaggagggaaccaaaaagcucaugaagaucacagcugccuggcuguggaaagaacuuggcaagaaaaagacaccccgcauguguacaagagaggaguuuacccggaaagugagauccaacgcggcccugggggcuauuuucacagacgaaaauaaguggaaaagcgcccgggaggcuguggaagauucucgcuuuugggagcucaucgacagagaacggaaccugcaccuggagggaaagugcgagaccugugucuacaauaugaugggcaagcgcgagaagaagcucggcgaguucgggaaagccaagggauccagagccauuugguauauguggcugggcgcgcgguuucuugaguucgaggcucugggguuucucaacgaagaucauugguucagccgcggaaauucccugagcggcguugagggggagggccuucacagacugggauacauccuccgggacgugucuaaaaaggaaggcggggccauguacgccgaugacacggcuggaugggacacccgcauuacacuggaggaucugaagaacgaagagauggugaccaaucauaugaaaggcgaacacaagaaacucgccgaggcuaucuuuaagcugacauaucagaacaaagucgugagaguucagcggccuacaccccgcgggacggugauggacaucauuagcagacgggaucagcgcggauccggccaagucgggacauacggccuuaauaccuucacaaacauggaggcccagcugaucagacagauggaaggagagggcauuuucaagucuauccaacaucucaccgugacggaagagauugcgguucagaauuggcuggcccggguggggagagagcgccuuagccggauggcuaucuccggagacgauugcgucgugaagccgcuggacgauagauuugccucugcucucaccgcccugaacgacaugggcaaaguucgcaaggauauccagcagugggaaccuagccggggguggaaugacuggacacaagugcccuucugcucccaccacuuucaugagcuggucaugaaagauggaagagugcucgucgugcccugucgcaaccaggacgaacugauuggccgggcgagaaucucucagggggccggcuggagccuuaaggagaccgcuugccugggaaaauccuaugcccagauguggacacucauguacuuccaccgccgggaucugagacuugcugccaacgcuauuuguagcgccguuccuucucauugggugccgaccucccgcacaaccuggagcauccacgcgaagcacgaauggaugacgacagaggacaugcuggccgucuggaaucggguguggauucaagagaaccccuggauggaagacaagaccccuguggagucuugggaagagguucccuaucucggcaaaagagaagaucaguggugcgggucccugaucggacugaccagccgggcuacaugggccaagaauauucagaccgccaucaaccaggugagaucccucaucggcaaugaggaguacacagacuauaugccuucuaugaaacgcuuucggagagaagaggaagaggcugggguccugugguga

SEQ ID NO: 19914 - RNA, 9876 nt, Artificial Sequence
  derived and/or modified CDS sequence (opt5) from DENV-2__EU482572__SS-prME
accgccggagugaucauuaugcugauccccacagcuauggccuuccaccucacgaccagaaauggggaaccucauaugauugucggacggcaggaaaagggcaagagccugcuuuuuaagaccgaagacgggguuaauaugugcacccugauggcgaucgaucucggagaacugugugaggacacaauuaccuacaagugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaaggcgggauugugacaugcgccauguuuacgugcaaaaagaauauggaagggaaagucguucagccugagaaccuggaauacaccaucgugauuacaccccacagcggggaggagcaugcggugggaaaugacaccggcaagcacggcaaagaaaucaagaucacaccucagucuuccauuaccgaggccgaacuuacgggguauggaaccgucacaauggaguguagcccccggaccggccuggauuucaacgaaauggugcuccugcaaauggaggacaaggcuuggcuuguucaccgccagugguuucuggaucucccgcugccuuggcugcccggggccgacacacagggaucuaauuggauccagaaggagacccucgugacguucaagaacccucaugcuaaaaagcaagacgucgugguucugggcucccaggaaggggccaugcacacagcccuuaccggcgcuacagagauucagaugagcuccggaaaucugcucuuuaccggccaucugaaaugcagacuucggauggauaagcugcaacucaaagggaugucuuacagcauguguaccggaaaguucaagaucgugaaagaaauugcggagacacagcacggcacgaucgucaucagagugcaguaugagggggacggaucccccugcaagauucccuucgaaaucauggaucuggagaaacgccauguccugggccggcucauuaccgugaacccuaucguuacagaaaaggacagcccggugaacauugaggccgaacccccuuuuggggauucuuacaucauuaucggcgucgagcccggacagcugaaacuuaauugguucaagaagggcuccagcaucgggcaaauguuugagaccacaaugagaggagcuaaacgcauggccauucugggcgacaccgccugggauuucgggucucucggaggcguguuuacgagcaucgggaaggcucugcaccagguuuucggcgccauuuacggagcggcuuuuuccggcgugucuuggacaaugaaaauccugauuggggucaucaucaccuggauuggaaugaacagccgguccaccagccuuucugugucccucgugcugguuggcgucgugacacuguaucucggggccauggugcaggccgacagcggaugugucgugucuuggaagaauaaagaacugaagugcggcuccgggaucuucauuaccgauaacguucacacauggacggagcaguacaaguuucaaccugaaagccccuccaaacuugcuucugccauccagaaggcucaugaggaaggcauuuguggaaucagaagcgugacccgccuggagaaucucauguggaaacaggucacaccggagcugaaccacauccuguccgaaaaugaggugaaacuuaccauuaugacaggcgacaucaaagggauuaugcaggccggaaagcggucucucagaccucaacccaccgaacugaaauauagcuggaagacguggggcaaggcgaaaaugcuguccaccgagagccauaaccagacauuccucaucgaugggccugaaaccgccgagugccccaauacaaaccgcgcuuggaacucucuggagguugaagacuacggauuuggcguguucaccacaaacauuuggcuuaagcugcgggagaaacaggacgucuuuugugauuccaagcucaugagcgccgcuaucaaagacaauagagccgugcacgcggauaugggcuauuggaucgaaucugcccugaacgacaccuggaagauggagaaggcuuccuucauugagguuaaaagcugccacuggccuaagucucauacgcuguggagcaauggggugcuugaauccgagaugaucauucccaaaaacuucgccggaccggucagccagcacaacuaccgcccuggcuaucauacacaaaccgcugggcccuggcaccucggaaagcuggaaauggauuuugacuucugugagggcaccacagugguggucaccggggauugcggaaaucggggccccucucugagaacgacaaccgccuccggcaaacucaucacagaauggugcugucggagcugcacccugccuccgcuucgcuacagaggggaggacggauguugguacggcauggagauucggccccugaaggaaaaggaggaaaaccucguuaauucccuggugacagccgggcauggacagaucgauaacuuuucucugggcgugcuugggauggcucucuuccuggaggaaaugcugagaacccgcgucggaacgaaacacgcgauucuccugguggccguuagcuuugugacccuuaucacaggcaauauguccuuccgggaccugggcagagucauggugaugguuggggcuaccaugacagaugacaucggaaugggcgugaccuaucucgcccugcuggccgcuuuuaagguccgcccuacguucgccgcggggcuucugcucagaaaacugacaucuaaggagcucaugauggcuaccauuggaaucgcccugcuuagccaguccacaauucccgagaccauccuggaacucaccgaugcccuggcucugggcaugauggugcuuaaaauuguucggaacauggagaaguaccaacuggccgugacaaucauggcgaucucuugcgucccuaaugcugugauucuccagaacgccuggaaggugagcuguacgauccuggccgucguuuccgugagcccccuccugcuuaccucuucccagcagaaagcugacuggauuccucuggcccucacaaucaaggggcugaaucccaccgcuauuuuucugacaacccuuagccgcacgucuaaaaagagauccuggccgcugaacgaagccaucauggcggugggaauggucagcauccucgccucuucccugcucaaaaaugacauuccuaugacaggcccccugguggcuggcgggcuucugaccguuugcuaugugcugaccggacggagcgccgaucucgagcuggaacgcgcugccgacgucaagugggaggaucaagccgagaucuccggcagcucuccuauucuuagcaucacaauuuccgaagacgggucuaugagcaucaaaaacgaggaagaggagcagacccugacaauucucaucagaacgggacugcucgugaucuccggcguuuuccccgugucuauuccgaucaccgcugcggccugguaccugugggaagucaagaagcagcgggcuggggugcuuugggaugucccuucucccccucccgugggaaaagccgagcuggaagacggcgccuaucgcauuaagcagagaggcauccugggguacucccaaauuggagcuggcguuuauaaagaggggacauuucacaccauguggcaugugacacggggagccguccucaugcaccgcggcaagagaaucgaacccuccugggcggaugugaaaaaggaccugaucagcuacgggggaggcuggaaacuugagggcgaguggaaagaaggggaggaaguucaggugcuggcucucgagccuggaaagaauccgcgggccguccagaccaaacccggccuguucaagacgaacaccgggacaauuggagccgugucccucgauuuuagcccuggcaccucugggucccccaucguggacagaaaaggaaagguugucggccuguacggcaaugggguggugacacgcagcggagcuuaugucucugccauugcgcagaccgaaaaguccaucgaggauaacccugagauugaagacgauaucuuccggaaaaagagacuuacaaucauggaccugcaucccggcgcugggaaaacgaagcgcuaccugccugccauugugcgggaggccaucaaaagaggacuccgcacccugauucuugcuccgacacggguuguggccgcugaaauggaggaagcccugagaggccuccccauccgcuaucaaaccccugcgauucgggccgagcacaccgggagagagaucgucgaccugaugugucaugcuacauucacgaugcggcuccugagccccgugcgcguuccuaacuacaaucuuauuaucauggaugaagcccacuuuaccgaccccgcuuccaucgccgccagaggcuauauuucuacacggguggagaugggagaagcugcgggcaucuucaugaccgccacaccgccugggagccgcgaucccuuuccccaguccaacgcuccuauuauggacgaggagagagaaauccccgagcggagcuggaacucuggacacgaaugggucaccgauuucaagggcaagacggugugguuuguuccuuccauuaaagccgggaacgacaucgccgcuugccugagaaagaauggcaagaaggugauccagcugagccgcaaaacauucgauucugaguacgucaagacccgggccaacgacugggauuuuguggugaccacagacauuagcgaaaugggcgcgaauuucaaggcugagagagucaucgauccgcgccgguguaugaaacccguuauucucaccgacggggaggaaagagugauccuggccggcccuaugcccgugacacauuccucugccgcucaacgccggggaagaauuggccgcaacccuaagaaugagaacgaccaguauaucuacaugggggaaccccuugagaaugaugaagacugcgcccacuggaaagaggcgaagaugcugcucgauaacaucaauaccccggagggaauuaucccuagcauguuugaacccgagagagaaaaagucgacgccauugauggcgaguaccggcugcgcggggaagcuagaaagacguucguggaccugaugcggcgcggagaucucccuguuuggcuugccuauagaguggcugccgagggcaucaacuacgcugaccggagaugguguuuugaugggauuaaaaauaaccagauccuggaggaaaacgucgagguggaaauuuggacaaaggagggcgagcgcaagaaacugaagccccgguggcucgacgccagaaucuauuccgauccucuggcgcuuaaagaguucaaggaguucgccgcuggacgcaaaucucugacccucaaucugaucacagaaaugggccggcugcccaccuuuaugacgcagaaggccagagacgcucucgauaaccuugccguucugcauaccgccgaggcugggggaaaggcguacaaucacgcccugagcgaacucccggagacacuggagacccuucugcuccugacacugcucgcuaccgugacaggcgggauuuuccuuuuucugauguccggaaaaggcaucggcaagaugacccuggggaugugcugcauuaucacggccagcauucuccugugguaugcccaaauccagccucacuggaucgcugccucuauuauccuugaguucuuucugauuguccuccugauccccgagcccgaaaaacagcggacaccucaggacaaccaacugaccuacguggucauugcgauccucaccgugguugccgcuacaauggccaaugagaugggauuccuugaaaagaccaaaaaggaccugggccugggguccaucacaacgcaggagagcgaguccaacauucucgauaucgaccugcgcccggcuucugccuggacccuuuaugcgguggccacaaccuuugugacacccaugcugagacauagcauugaaaauuccucugucaacguuagccucaccgcuaucgccaaucaggcuacggugcugaugggacugggcaagggguggccucucuccaaaauggauauuggagugccccuucuggccaucggcuguuacagccaggucaacccuauuacccugacagcugcccuccugcuucugguggcgcacuacgccaucaucggccccgggcuccaagcuaaggccacccgggaggcucagaaacgcgccgccgcgggaauuaugaagaauccuacaguugacggcaucaccgugauugaucuggaaccgauccccuaugacccuaaauucgagaagcagcuggggcaggucaugcuccuuauucugugcgugacgcaagucaugaugaugagaacaaccugggcucugugugaagcccucacacuggcuaccggacccaucucuacccuuugggagggcaacccugggcgguuuuggaauacaacgaucgccguguccauggccaacauuuuccgcggaagcuaccuggcuggcgccggccuccuguuuucuaucaugaagaauaccacaaacaccagacgggggacaggaaauauuggcgagacccugggggaaaaauggaagucccgccucaacgcgcuuggaaaaagcgaguuccagaucuauaagaaaucuggcauucaggaaguugauagaacgcuggccaaggaggggaucaaacggggagagacagaccaucacgcugugagcagaggcuccgccaagcugcgcugguuugucgaacggaacauggugacccccgagggcaagguuguggaucucgggugcggaagaggcggguggucuuacuauuguggaggccugaaaaauguccgcgaagugaaggggcuuaccaaaggaggcccgggccaugaggaaccuauccccaugagcacauacggguggaaccuggugcggcuccaauccggaguugacgucuucuucacacccccugagaagugcgauacacugcugugugacauuggcgagagcucccccaauccuacgaucgaagcugggagaacccuccgcgugcuuaaccugguggagaauuggcugaacaauaacacacaguuuugcauuaaaguccucaauccguauaugcccucuguuaucgaaaagauggagacccugcagcggaaguacggaggcgcccuugugagaaacccucugagccgcaauuccacacacgaaauguacugggugucuaacgcgaccgggaauauugucagcuccgugaacaugaucucucggaugcucaucaauagauucacgaugaaacacaagaaagccaccuaugagcccgauguugaccugggaagcggcacacgcaacauuggcaucgaguccgaaauuccuaaccuggacaucauugggaagcggaucgagaaaauuaagcaggaacaugagaccagcuggcacuacgaucaagaccaucccuauaagacaugggcuuaccacggaucuuaugaagccaaacagaccggcuccgcuagcucuauggugaauggggucgugagacuccuuacaaagccgugggauguugugccuauggucacccagauggccaugacggacacaacccccuuuggacagcaacgcguguucaaagagaagguggauaccagaacacaggagccuaaagaaggcacgaagaagcugaugaaaaucaccgcugaguggcuguggaaggaacucgggaaaaagaaaacaccccggauguguacccgcgaggaguuuacaagaaagguccgguccaacgccgcgcugggagccaucuucaccgacgaaaauaaauggaaaagcgcuagagaggccguugaagauucucgguuuugggagcuuguggaccgcgaaagaaaccugcaccucgagggcaagugcgagacauguguguacaauaugaugggcaaacgggaaaagaaacugggggaguucggaaaggcuaaaggcucccgcgccauuugguauauguggcugggggccagauuucucgaguucgaggcgcugggauuucuuaacgaagaucauugguucagccggggcaauucccugagcggggucgagggcgagggacuccaccgccugggcuacauccuuagagacgugucuaagaaggaagggggagcuauguacgccgaugacaccgccggcugggacacgcggauuacccuggaggaucucaaaaacgaagagaugguuacaaaucauaugaagggggaacacaaaaagcuggcugaggccaucuuuaaacugaccuaucagaacaaggugguccgcgugcagagaccuacaccccggggaaccguuauggacauuaucagccgcagagaucaacggggcuccggacaggugggcacguacggacucaauacauucaccaacauggaggcucagcugauccgccaaauggaaggcgaggggauuuucaagucuauccagcaucuuacagucaccgaagagauugccgugcagaauuggcuggcgagaguuggacgggagagacucagccgcauggugaucuccggcgacgauugcgucgugaaaccgcuggacgaucgguuugccucugcucuuacggcccugaacgacauggggaaggucagaaaagauauucagcaaugggaaccuagccgcggauggaaugacuggacccaggugcccuucugcucccaccacuuucaugagcucguuaugaaggauggccgggugcuggucgugcccuguagaaaccaggacgaacugaucgggcgcgcucggaucucucagggcgccggauggagccucaaagagacagcgugccugggcaaguccuaugcccaaauguggacccuuauguacuuccacagacgcgaucugcggcucgcugccaacgcuauuuguagcgccgugccuucucauuggguuccgacauccagaaccacauggagcauccacgcuaagcacgaauggaugaccacggaggacaugcuggccguguggaaucgcgucuggauucaggagaaccccuggauggaagacaaaacaccuguggagucuugggaagagguucccuaucuugggaagcgggaagaucaguggugcggaucccugaucggccucaccagcagagcgaccugggccaaaaauauucagacagcuaucaaccaagugcggucccugauugggaaugaggaguacaccgacuauaugccuucuaugaagagauuucgccgggaagaggaagaggccggaguccugugguga

SEQ ID NO: 19915 - RNA, 9876 nt, Artificial Sequence
  derived and/or modified CDS sequence (opt5) from DENV-2__EU482573__SS-prME
accgccggcgugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgaucgaucucggagaacugugugaggacaccauuaccuacaaaugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaaggcgggauugugacaugcgccauguuuacgugcaaaaagaauauggaagggaaagucguucugccugagaaccuugaauacaccaucgugauuacaccccacagcggggaggagcaugcggugggaaaugacaccggcaagcacggcaaagaaaucaagaucacaccucagucuuccauuaccgaggccgaacugacgggguauggaaccgucacaauggaguguagcccccggaccggccucgauuucaacgaaauggugcugcuucagauggaggacaaggcuuggcugguucaccgccaaugguuucucgaucugccgcugccuuggcuccccggggccgacacacagggaucuaauuggauccagaaggagacccuggugacguucaagaacccucaugcuaaaaagcaggacgucgugguucuuggcucccaagaaggggccaugcacacagcccugaccggcgcuacagagauucagaugagcuccggaaaucuccuguuuaccggccaucuuaaaugcagacugcggauggauaagcuccagcugaaagggaugucuuacagcauguguaccggaaaguucaagaucgugaaagaaauugcggagacacaacacggcacgaucgucaucagagugcaguaugagggggacggaucccccugcaagauucccuucgaaaucauggaucuggagaaacgccauguccucggccggcugauuaccgugaacccuaucguuacagaaaaggacagcccggugaacauugaggccgaacccccuuuuggggauucuuacaucauuaucggcgucgagcccggacagcuuaaacugaauugguucaagaagggcuccagcaucgggcagauguuugagaccacaaugagaggagcuaaacgcauggccauucucggcgacaccgccugggauuucgggucucugggaggcguguuuacgagcaucgggaaggcucugcaccaaguuuucggcgccauuuacggagcggcuuuuuccggcgugucuuggacaaugaaaauccuuauuggggucaucaucaccuggauuggaaugaacagccgguccaccagccucucugugucccuggugcugguuggcgucgugacacucuaucugggggccauggugcaggccgacagcggaugugucgugucuuggaagaauaaagaacuuaagugcggcuccgggaucuucauuaccgauaacguucacacauggacggagcaguacaaguuucagccugaaagccccuccaaacuggcuucugccauccaaaaggcucaugaggaaggcauuuguggaaucagaagcgugacccgccucgagaaucugauguggaaacagaucacaccggagcugaaccacauucuuuccgaaaaugaggucaagcucaccaucaugacaggcgacauuaaagggaucaugcaggccggaaagcggucucugagaccucagcccaccgaacugaaauauagcuggaagacguggggcaaggcgaaaaugcucuccaccgagagccauaaccaaacauuccugauugaugggccugaaaccgccgagugccccaauacaaaccgcgcuuggaacucucuugagguggaagacuacggauuuggcguuuucaccacaaacaucuggcugaagcuccgggagaaacaggacguguuuugugauuccaagcugaugagcgccgcuaucaaagacaauagagccguccacgcggauaugggcuauuggauugaaucugcccugaacgacaccuggaagauggagaaggcuuccuucaucgaggugaaaagcugccacuggccuaagucucauacgcuuuggagcaaugggguucucgaauccgagaugauuauccccaaaaacuucgccggaccggugagccagcacaacuaccgcccuggcuaucauacacagaccgcugggcccuggcaccugggaaagcuggaaauggauuuugacuucugugagggcaccacagucguggugaccgaagauugcgggaaucggggacccucucucagaacgacaaccgccuccggcaaacugauuacagaguggugcugucggagcugcacccuuccuccgcugcgcuacagaggcgaggacggguguugguacggaauggaaauccggccccucaaggagaaggaagagaaccuggucaauucccugguuacagccggccaugggcaaauugauaacuuuucucuuggagugcucggcauggcucuguuccuggaagagaugcucagaacccgcguggggacgaaacacgcgauccugcuugucgccgugagcuuuguuacccugaucacaggaaauauguccuuccgggaccucggcagagugauggucauggugggcgcuaccaugacagaugacauugggaugggaguuaccuaucuggcccugcuugccgcuuuuaaggugcgcccuacguucgccgcgggccugcuccugagaaaacucacaucuaaggagcugaugauggcuaccaucgggauugcccuucugagccaguccacaauccccgaaaccauucucgagcugaccgaugcccuggcucuuggaaugaugguccugaaaaucgugcggaacauggaaaaguaccagcucgccguuacaaucauggcgauuucuugcgugccuaaugcugucauccugcaaaacgccuggaaggugagcuguacgauucucgccgcuguguccgucagcccccugcuucugaccucuucccagcagaaagccgacuggaucccucucgcucugacaauuaagggccugaaucccaccgccaucuuucuuacaacccugagccgcacgucuaaaaagagauccuggccgcucaacgaggcgaucauggccguugggauggugagcauucuggcuucuucccuccugaaaaaugacaucccuaugacaggaccccuuguggccggcggccugcugaccgucugcuaugugcucaccgggcggagcgcugaucuggaacuugagcgcgccgccgacguuaagugggaggaucaggcugaaauuuccggaagcucuccuauccugagcauuacaaucuccgaggacggcucuaugagcauuaaaaacgaagaggaggaacaaacccucacaauccugaucagaacggggcuccuggugauuuccggagucuuccccgugucuaucccgauuaccgcggccgcuugguaccuuugggagguuaagaagcagcgggccggcgugcugugggaugucccuucucccccucccguggggaaagccgaacuggaggacggagcuuaucgcaucaagcagagaggcauucucggcuacucccagaucggggccggagucuauaaagaaggcacauuucacaccauguggcaugugacaagaggggcgguucugaugcaccgcggaaagagaaucgagcccuccugggcugaugugaaaaaggaccuuauuagcuacggcgggggauggaagcuggagggcgaauggaaagagggcgaagagguccaagugcucgcccuggaaccugggaagaauccgcgggccguucagaccaaacccggacucuucaagacgaacaccggcacaaucggggcugugucccuggauuuuagcccuggaaccucuggcucccccauugucgacagaaaagggaagguggugggacuuuacggcaauggcguugucacacgcagcggggccuaugugucugcgaucgcucagaccgagaaguccauugaggauaacccugaaaucgaggacgauaucuuccggaaaaagagacugacaauuauggaccugcaucccggagccggcaaaacgaagcgcuaccucccugccaucgugcgggaagcuauuaaaagagggcugcgcacccuuauccuggccccgacacgggucguggcugccgagauggaagaggcgcucagaggacugcccauucgcuaucagaccccugccauccgggcugagcacaccggcagagaaauuguugaccucaugugucaugccacauucacgaugcggcugcuuagccccgugcgcgucccuaacuacaaucugaucaucauggaugaggcucacuuuaccgaccccgccuccauugccgcuagaggguauaucucuacacggguggaaaugggcgaggcggccggaauuuucaugaccgcuacaccgccuggcagccgcgaucccuuuccccaauccaacgccccuaucauggacgaggaaagagagauucccgaacggagcuggaacucugggcacgaguggguuaccgauuucaagggaaagacggugugguuugucccuuccaucaaagccggcaacgacaucgcugccugccugagaaagaaugggaaaaaggugauucagcucagccgcaaaacauucgauucugaauacguuaagacccgggcgaacgacugggauuuuguggucaccacagacaucagcgagaugggagcuaauuucaaggccgagagagugauugauccgcgccgguguaugaaacccgugauccugaccgacggcgaagagagagucauucuugccgggccuaugcccguuacacauuccucugcugcccagcgccggggcagaaucggacgcaacccuaagaaugaaaacgaccaauauaucuacaugggcgagccccuggaaaaugaugaggacugcgcgcacuggaaagaggccaagaugcuccuggauaacauuaauaccccggaagggaucauuccuagcauguuugagcccgaaagagagaaaguggacgcuaucgauggagaauaccggcugcgcggcgaggccagaaagacguucguggaccucaugcggcgcggggaucuuccugucuggcuggcuuauagaguggccgcugagggaauuaacuacgccgaccggagaugguguuuugauggcaucaaaaauaaccagauucuggaagagaacguugaaguggagaucuggacaaaggagggggaacgcaagaaacucaagccccgguggcuggacgcgagaaucuauuccgauccucuugcccugaaagaguucaaggaguucgcugccggccgcaaaucucucacccugaaucugauuacagagaugggacggcuccccaccuuuaugacgcagaaggcuagagacgcccuugauaaccuggccguccugcauaccgcugaagcgggcgggcgggccuacaaucacgcucucagcgagcugccggagacacuugaaacccugcuccugcugacacuccuugccaccgugacaggaggcaucuuccuguuucugauguccgggaagggaauuggcaaaaugacccucggcaugugcugcaucauuacggccagcauccugcuuugguaugcucagauccaaccucacuggauugccgcgucuaucauucuggaguucuuucucaucguucugcugauucccgaacccgagaagcagcgcacaccucaggacaaccagcucaccuacguggucaucgccauccuuaccguggucgcugccacaauggcuaaugaaaugggguuccuggagaaaaccaagaaagaccugggacucggcuccauuacaacgcaagagagcgaauccaacauccuggauauugaccuuagaccggccucugcguggacccuguaugccguggcuacaaccuuuguuacacccaugcuccggcauagcaucgaaaauagcucugugaacgugagccugaccgccauugcuaaucaggccacgguccugauggggcucggaaagggcuggccucuuuccaagauggauaucgggguuccccugcuggcuauuggauguuacagccaggugaacccuaucacccucacagccgcgcugcuucugcucguggcccacuacgcuaucauuggccccggccugcaggccaaagcuacccgcgaagcccaaaagagagccgcggcugggaucaugaaaaauccuacagucgacggaauuaccgugaucgaucuggagccgauucccuaugacccuaaguucgaaaaacagcucggccagguuaugcuucugauccugugcgugacgcagguccucaugaugcggacaaccugggcccugugugaggcucuuacacuggccaccgggcccaucucuacccucugggagggaaacccuggccgcuuuuggaauacaacgauugccguguccauggcuaacaucuucagagggagcuaccuggccggagcgggccugcucuuuucuauuaugaagaauaccacaaacacccggcgcggcacagggaauaucggagaaacccuuggcgagaaguggaaauccagacugaacgcccugggaaagagcgaguuccaaauuuauaaaaagucuggaauccaggaggucgaucggacgcucgcuaaagagggcaucaagagaggggaaacagaccaucacgccgugagccgcggauccgcuaaacugcggugguuuguugagagaaacauggugacccccgaaggcaaggucguggaucuuggcugcgggcgcggaggcuggucuuacuauugugggggacugaagaauguucgggaggugaaaggccucaccaaagggggaccgggccaugaagaaccuauucccaugagcacauacggcuggaaccuggucagacugcaguccgggguggacguguucuucacacccccugagaaaugcgauacacuccuuugugacaucggagaaagcucccccaauccuacgauugaggccggccgcacccugcggguucugaaccucgucgaaaauuggcugaacaauaacacacaauuuugcaucaaggugcuuaauccguauaugcccucugugauugagaaaauggaaacccugcagagaaaguacgggggagcgcucguccgcaacccucugagcagaaauuccacacacgagauguacuggguuucuaacgccaccggcaauaucgugagcuccgugaacaugaucucuagaaugcugauuaaucgcuucacgaugaagcacaaaaaggcuaccuaugagcccgaugucgaccucgggagcggaacacggaacaucggcauugaauccgagaucccuaaccuugacauuaucggcaaaagaauugaaaagaucaaacaggagcaugaaaccagcuggcacuacgaucaggaccaucccuauaagacaugggccuaccacgggucuuaugagaccaagcaaacaggauccgcuagcucuauggugaauggcguugugcgccugcugaccaaaccgugggaugucgugccuaugguuacgcagauggccaugacagacaccacccccuuugggcagcagagaguguucaaggagaaagucgauacacggacgcaagaaccuaaggagggaaccaaaaagcucaugaagaucacagcugaauggcuguggaaagagcuuggcaagaaaaagacaccccgcauguguacaagagaggaauuuacccggaaagugagauccaacgccgcgcugggggccauuuucacagacgagaauaaguggaaaagcgcucgggaagccguggaggauucucgcuuuugggaacucaucgacagagagcggaaccugcaccuggagggaaagugcgaaaccugugucuacaauaugaugggcaagcgcgagaaaaagcucggcgaguucgggaaagcuaagggauccagagccauuugguauauguggcugggcgcccgguuucuugaguucgaagcgcugggguuucucaacgaggaucauugguucagccgcggaaauucccugagcggcguugagggggaaggccuucacagacugggauacauccuccgggacgugucuaaaaaggagggcggggcuauguacgccgaugacacggccggaugggacacccgcauuacacuggaagaucugaagaacgaggaaauggugaccaaucauaugaaaggcgagcacaagaaacucgcugaggccaucuuuaagcugacauaucagaacaaagucgugagaguucagcggccuacaccccgcgggacggugauggacaucauuagcagacgggaucagcgcggauccggccaagucgggacauacggccuuaauaccuucacaaacauggaagcucagcugaucagacagauggagggagaaggcauuuucaagucuauccaacaucucaccgugacggaggagauugccguucagaauuggcuggcgcggguggggagagaacgccuuagccggauggccaucuccggagacgauugcgucgugaagccgcuggacgauagauuugcuucugcccucaccgcucugaacgacaugggcaaaguucgcaaggauauccagcagugggagccuagccggggguggaaugacuggacacaagugcccuucugcucccaccacuuucaugaacuggucaugaaagauggaagagugcucgucgugcccugucgcaaccaggacgagcugauuggccgggccagaaucucucagggggcgggcuggagccuuaaggaaaccgccugccugggaaaauccuaugcucagauguggacacucauguacuuccaccgccgggaucugagacuugccgcuaacgccauuuguagcgcuguuccuucucauugggugccgaccucccgcacaaccuggagcauccacgccaagcacgaguggaugacgacagaggacaugcuggcggucuggaaucggguguggauucaagaaaaccccuggauggaggacaagaccccuguggaaucuugggaggaaguucccuaucucggcaaaagagaggaucaguggugcgggucccugaucggacugaccagccgggccacaugggcuaagaauauucagaccgccaucaaccaggugagaucccucaucggcaaugaggaauacacagacuauaugccuucuaugaaacgcuuucggagagaggaagaggaagccgggguccugugguga

SEQ ID NO: 19916 - RNA, 9876 nt, Artificial Sequence
  derived and/or modified CDS sequence (opt5) from DENV-2__EU482574__SS-prME
accgccggcgugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgaucgaucucggagaacugugugaggacaccauuaccuacaaaugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaaggcgggauugugacaugcgccauguuuacgugcaaaaagaauauggaagggaaagucguucugccugagaaccuugaauacaccaucgugauuacaccccacagcggggaggagcaugcggugggaaaugacaccggcaagcacggcaaagaaaucaagaucacaccucagucuuccauuaccgaggccgaacugacgggguauggaaccgucacaauggaguguagcccccggaccggccucgauuucaacgaaauggugcugcuucacauggaggacaaggcuuggcugguucaucgccagugguuucucgaucugccgcugccuuggcuccccggggccgacacacaaggaucuaauuggauccagaaggagacccuggugacguucaagaacccucacgcuaaaaagcaggacgucgugguucuuggcucccaggaaggggccaugcauacagcccugaccggcgcuacagagauucaaaugagcuccggaaaucuccuguuuaccggccaccuuaaaugcagacugcggauggauaagcuccagcugaaagggaugucuuacagcauguguaccggaaaguucaagaucgugaaagaaauugcggagacacagcauggcacgaucgucaucagagugcaauaugagggggacggaucccccugcaagauucccuucgaaaucauggaucuggagaaacgccacguccucggccggcugauuaccgugaacccuaucguuacagaaaaggacagcccggugaacauugaggccgaacccccuuuuggggauucuuacaucauuaucggcgucgagcccggacagcuuaaacugaauugguucaagaagggcuccagcaucgggcagauguuugagaccacaaugagaggagcuaaacgcauggccauucucggcgacaccgccugggauuucgggucucugggaggcguguuuacgagcaucgggaaggcucugcaccagguuuucggcgccauuuacggagcggcuuuuuccggcgugucuuggacaaugaaaauccuuauuggggucaucaucaccuggauuggaaugaacagccgguccaccagccucucugugucccuggugcugguuggcgucgugacacucuaucugggggccauggugcaagccgacagcggaugugucgugucuuggaagaauaaagaacuuaagugcggcuccgggaucuucauuaccgauaacguucauacauggacggagcaguacaaguuucagccugaaagccccuccaaacuggcuucugccauccagaaggcucacgaggaaggcauuuguggaaucagaagcgugacccgccucgagaaucugauguggaaacaaaucacaccggagcugaaccauauucuuuccgaaaaugaggucaagcucaccaucaugacaggcgacauuaaagggaucaugcaggccggaaagcggucucugagaccucagcccaccgaacugaaauauagcuggaagacguggggcaaggcgaaaaugcucuccaccgagagccacaaccagacauuccugauugaugggccugaaaccgccgagugccccaauacaaaccgcgcuuggaacucucuugagguggaagacuacggauuuggcguuuucaccacaaacaucuggcugaagcuccgggagaaacaagacguguuuugugauuccaagcugaugagcgccgcuaucaaagacaauagagccguccacgcggauaugggcuauuggauugaaucugcccugaacgacaccuggaagauggagaaggcuuccuucaucgaggugaaaagcugccauuggccuaagucucacacgcuuuggagcaaugggguucucgaauccgagaugauuauccccaaaaacuucgccggaccggugagccagcauaacuaccgcccuggcuaucacacacagaccgcugggcccuggcaucugggaaagcuggaaauggauuuugacuucugugagggcaccacagucguggugaccgaagauugcgggaaucggggacccucucucagaacgacaaccgccuccggcaaacugauuacagaguggugcugucggagcugcacccuuccuccgcugcgcuacagaggcgaggacggguguugguacggaauggaaauccggccccucaaggagaaggaagagaaccuggucaauucccugguuacagccggccacgggcagauugauaacuuuucucuuggagugcucggcauggcucuguuccuggaagagaugcucagaacccgcguggggacgaaacacgcgauccugcuugucgccgugagcuuuguuacccugaucacaggaaauauguccuuccgggaccucggcagagugauggucauggugggcgcuaccaugacagaugacauugggaugggaguuaccuaucuggcccugcuugccgcuuuuaaggugcgcccuacguucgccgcgggccugcuccugagaaaacucacaucuaaggagcugaugauggcuaccaucgggauugcccuucugagccaauccacaauccccgaaaccauucucgagcugaccgaugcccuggcucuuggaaugaugguccugaaaaucgugcggaacauggaaaaguaccagcucgccguuacaaucauggcgauuucuugcgugccuaaugcugucauccugcagaacgccuggaaggugagcuguacgauucucgccgcuguguccgucagcccccugcuucugaccucuucccaacagaaagccgacuggaucccucucgcucugacaauuaagggccugaaucccaccgccaucuuucuuacaacccugagccgcacgucuaaaaagagauccuggccgcucaacgaggcgaucauggccguugggauggugagcauucuggcuucuucccuccugaaaaaugacaucccuaugacaggaccccuuguggccggcggccugcugaccgucugcuaugugcucaccgggcggagcgcugaucuggaacuugagcgcgccgccgacguuaagugggaggaucaggcugaaauuuccggaagcucuccuauccugagcauuacaaucuccgaggacggcucuaugagcauuaaaaacgaagaggaggaacagacccucacaauccugaucagaacggggcuccuggugauuuccggagucuuccccgugucuaucccgauuaccgcggccgcuugguaccuuugggagguuaagaagcaacgggccggcgugcugugggaugucccuucucccccucccguggggaaagccgaacuggaggacggagcuuaucgcaucaagcagagaggcauucucggcuacucccagaucggggccggagucuauaaagaaggcacauuucauaccauguggcacgugacaagaggggcgguucugaugcaucgcggaaagagaaucgagcccuccugggcugaugugaaaaaggaccuuauuagcuacggcgggggauggaagcuggagggcgaauggaaagagggcgaagagguccaggugcucgcccuggaaccugggaagaauccgcgggccguucaaaccaaacccggacucuucaagacgaacaccggcacaaucggggcugugucccuggauuuuagcccuggaaccucuggcucccccauugucgacagaaaagggaagguggugggacuuuacggcaauggcguugucacacgcagcggggccuaugugucugcgaucgcucagaccgagaaguccauugaggauaacccugaaaucgaggacgauaucuuccggaaaaagagacugacaauuauggaccugcaccccggagccggcaaaacgaagcgcuaccucccugccaucgugcgggaagcuauuaaaagagggcugcgcacccuuauccuggccccgacacgggucguggcugccgagauggaagaggcgcucagaggacugcccauucgcuaucagaccccugccauccgggcugagcauaccggcagagaaauuguugaccucaugugucacgccacauucacgaugcggcugcuuagccccgugcgcgucccuaacuacaaucugaucaucauggaugaggcucacuuuaccgaccccgccuccauugccgcuagaggguauaucucuacacggguggaaaugggcgaggcggccggaauuuucaugaccgcuacaccgccuggcagccgcgaucccuuuccccaguccaacgccccuaucauggacgaggaaagagagauucccgaacggagcuggaacucugggcaugaguggguuaccgauuucaagggaaagacggugugguuugucccuuccaucaaagccggcaacgacaucgcugccugccugagaaagaaugggaaaaaggugauucaacucagccgcaaaacauucgauucugaauacguuaagacccgggcgaacgacugggauuuuguggucaccacagacaucagcgagaugggagcuaauuucaaggccgagagagugauugauccgcgccgguguaugaaacccgugauccugaccgacggcgaagagagagucauucuugccgggccuaugcccguuacacacuccucugcugcccagcgccggggcagaaucggacgcaacccuaagaaugaaaacgaccaguauaucuacaugggcgagccccuggaaaaugaugaggacugcgcgcauuggaaagaggccaagaugcuccuggauaacauuaauaccccggaagggaucauuccuagcauguuugagcccgaaagagagaaaguggacgcuaucgauggagaauaccggcugcgcggcgaggccagaaagacguucguggaccucaugcggcgcggggaucuuccugucuggcuggcuuauagaguggccgcugagggaauuaacuacgccgaccggagaugguguuuugauggcaucaaaaauaaccaaauucuggaagagaacguugaaguggagaucuggacaaaggagggggaacgcaagaaacucaagccccgguggcuggacgcgagaaucuauuccgauccucuugcccugaaagaguucaaggaguucgcugccggccgcaaaucucucacccugaaucugauuacagagaugggacggcuccccaccuuuaugacgcagaaggcuagagacgcccuugauaaccuggccguccugcacaccgcugaagcgggcgggcgggccuacaaucacgcucucagcgagcugccggagacacuugaaacccugcuccugcugacacuccuugccaccgugacaggaggcaucuuccuguuucugauguccgggaagggaauuggcaaaaugacccucggcaugugcugcaucauuacggccagcauccugcuuugguaugcucagauccagccucauuggauugccgcgucuaucauucuggaguucuuucucaucguucugcugauucccgaacccgagaagcaacgcacaccucaggacaaccagcucaccuacguggucaucgccauccuuaccguggucgcugccacaauggcuaaugaaaugggguuccuggagaaaaccaagaaagaccugggacucggcuccauuacaacgcaggagagcgaauccaacauccuggauauugaccuuagaccggccucugcguggacccuguaugccguggcuacaaccuuuguuacacccaugcuccggcacagcaucgaaaauagcucugugaacgugagccugaccgccauugcuaaucaagccacgguccugauggggcucggaaagggcuggccucuuuccaagauggauaucgggguuccccugcuggcuauuggauguuacagccaggugaacccuaucacccucacagccgcgcugcuucugcucguggcccauuacgcuaucauuggccccggccugcaggccaaagcuacccgcgaagcccagaagagagccgcggcugggaucaugaaaaauccuacagucgacggaauuaccgugaucgaucuggagccgauucccuaugacccuaaguucgaaaaacaacucggccagguuaugcuucugauccugugcgugacgcagguccucaugaugcggacaaccugggcccugugugaggcucuuacacuggccaccgggcccaucucuacccucugggagggaaacccuggccgcuuuuggaauacaacgauugccguguccauggcuaacaucuucagagggagcuaccuggccggagcgggccugcucuuuucuauuaugaagaauaccacaaacacccggcgcggcacagggaauaucggagaaacccuuggcgagaaguggaaauccagacugaacgcccugggaaagagcgaguuccagauuuauaaaaagucuggaauccaagaggucgaucggacgcucgcuaaagagggcaucaagagaggggaaacagaccaccaugccgugagccgcggauccgcuaaacugcggugguuuguugagagaaacauggugacccccgaaggcaaggucguggaucuuggcugcgggcgcggaggcuggucuuacuauugugggggacugaagaauguucgggaggugaaaggccucaccaaagggggaccgggccacgaagaaccuauucccaugagcacauacggcuggaaccuggucagacugcaguccgggguggacguguucuucacacccccugagaaaugcgauacacuccuuugugacaucggagaaagcucccccaauccuacgauugaggccggccgcacccugcggguucugaaccucgucgaaaauuggcugaacaauaacacacaguuuugcaucaaggugcuuaauccguauaugcccucugugauugagaaaauggaaacccugcaaagaaaguacgggggagcgcucguccgcaacccucugagcagaaauuccacacacgagauguacuggguuucuaacgccaccggcaauaucgugagcuccgugaacaugaucucuagaaugcugauuaaucgcuucacgaugaagcauaaaaaggcuaccuaugagcccgaugucgaccucgggagcggaacacggaacaucggcauugaauccgagaucccuaaccuugacauuaucggcaaaagaauugaaaagaucaaacaggagcacgaaaccagcuggcauuacgaucaggaccaccccuauaagacaugggccuaccacgggucuuaugagaccaagcagacaggauccgcuagcucuauggugaauggcguugugcgccugcugaccaaaccgugggaugucgugccuaugguuacgcaaauggccaugacagacaccacccccuuugggcagcagagaguguucaaggagaaagucgauacacggacgcaggaaccuaaggagggaaccaaaaagcucaugaagaucacagcugaauggcuguggaaagagcuuggcaagaaaaagacaccccgcauguguacaagagaggaauuuacccggaaagugagauccaacgccgcgcugggggccauuuucacagacgagaauaaguggaaaagcgcucgggaagccguggaggauucucgcuuuugggaacucaucgacagagagcggaaccugcaucuggagggaaagugcgaaaccugugucuacaauaugaugggcaagcgcgagaaaaagcucggcgaguucgggaaagcuaagggauccagagccauuugguauauguggcugggcgcccgguuucuugaguucgaagcgcugggguuucucaacgaggaucacugguucagccgcggaaauucccugagcggcguugagggggaaggccuucauagacugggauacauccuccgggacgugucuaaaaaggagggcggggcuauguacgccgaugacacggccggaugggacacccgcauuacacuggaagaucugaagaacgaggaaauggugaccaaucacaugaaaggcgagcauaagaaacucgcugaggccaucuuuaagcugacauaucaaaacaaagucgugagaguucagcggccuacaccccgcgggacggugauggacaucauuagcagacgggaucagcgcggauccggccaggucgggacauacggccuuaauaccuucacaaacauggaagcucaacugaucagacagauggagggagaaggcauuuucaagucuauccagcaccucaccgugacggaggagauugccguucaaaauuggcuggcgcggguggggagagaacgccuuagccggauggccaucuccggagacgauugcgucgugaagccgcuggacgauagauuugcuucugcccucaccgcucugaacgacaugggcaaaguucgcaaggauauccagcagugggagccuagccggggguggaaugacuggacacaggugcccuucugcucccaccauuuucacgaacuggucaugaaagauggaagagugcucgucgugcccugucgcaaccaagacgagcugauuggccgggccagaaucucucagggggcgggcuggagccuuaaggaaaccgccugccugggaaaauccuaugcucagauguggacacucauguacuuccaucgccgggaucugagacuugccgcuaacgccauuuguagcgcuguuccuucucacugggugccgaccucccgcacaaccuggagcauccacgccaagcaugaguggaugacgacagaggacaugcuggcggucuggaaucggguguggauucaggaaaaccccuggauggaggacaagaccccuguggaaucuugggaggaaguucccuaucucggcaaaagagaggaucaauggugcgggucccugaucggacugaccagccgggccacaugggcuaagaauauucagaccgccaucaaccaggugagaucccucaucggcaaugaggaauacacagacuauaugccuucuaugaaacgcuuucggagagaggaagaggaagccgggguccugugguga

SEQ ID NO: 19917 - RNA, 9876 nt, Artificial Sequence
  derived and/or modified CDS sequence (opt5) from DENV-2__EU482575__SS-prME
acagccggcgugaucauuaugcugauccccacagcuauggccuuccaccucacgaccagaaauggggagccucauaugauugucggacggcaggaaaagggcaaaucccugcuuuuuaagacagaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagagacggcgcgaaaagagaagcguggcucucgucccucacgugggaaugggccuggagacccggacggaaacauggauguccucugagggcgccuggaaacauguucagcgcaucgagaccuggauucugagacaccccggguucacaaucauggccgcuauucucgccuacaccaucggaaccacacauuuucagcgggcucugauuuucauccuucugacggccguggcgccuagcaugaccaugcgcugcauuggcaucuccaacagagauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugcggaaauauugcaucgaagcuaagcucacaaacaccaccacagagagccgcuguccgacccaaggagagcccucucugaaugaggaacaggacaaaagauuucugugcaagcacuccaugguggaucggggcuggggcaacggguguggacucuucggcaaagggggaauugugacaugcgccauguuuacgugcaaaaagaauauggaaggcaaagucguucugccugagaaccuugaauacaccaucgugauuacaccccauagcggggaggagcacgcggugggaaaugacaccggcaagcauggcaaagaaaucaagaucacaccucagucuuccauuaccgaggccgaacugacgggguauggaaccgucacaauggaguguagcccccgcaccggccucgauuucaacgaaauggugcugcuucagauggaggacaaggcuuggcugguucacagacaaugguuucucgaucugccgcugccuuggcuccccggggccgacacacagggaucuaauuggauccagaaggagacccuggugacguucaagaacccucacgcuaaaaagcaggacgucgugguucuuggcucccaagaaggggccaugcauacagcccugaccggcgcuacagagauucagaugagcuccggaaaucuccuguuuaccggccaccuuaaaugccggcugagaauggauaagcuccagcugaaagggaugucuuacagcauguguaccggaaaguucaagaucgugaaagaaauugcggagacacaacauggcacgaucgucauccgcgugcaguaugagggggacggaucccccugcaagauucccuucgaaaucauggaucuggagaaacggcacguccucggcagacugauuaccgugaacccuaucguuacagaaaaggacagcccggugaacauugaggccgaacccccuuuuggggauucuuacaucauuaucggcgucgagcccggacagcuuaaacugaauugguucaagaagggcuccagcaucgggcagauguuugagaccacaaugcgcggagcuaaacggauggccauucucggcgacaccgccugggauuucgggucucugggaggcguguuuacgagcaucgggaaggcucugcaucaaguuuucggcgccauuuacggagcggcuuuuuccggcgugucuuggacaaugaaaauccuuauuggggucaucaucaccuggauuggaaugaacagcagauccaccagccucucugugucccuggugcugguuggcgucgugacacucuaucugggggccauggugcaggccgacagcggaugugucgugucuuggaagaauaaagaacuuaagugcggcuccgggaucuucauuaccgauaacguucacacauggacggagcaguacaaguuucagccugaaagccccuccaaacuggcuucugccauccaaaaggcucacgaggaaggcauuuguggaauccgcagcgugacccggcucgagaaucugauguggaaacagaucacaccggagcugaaccauauucuuuccgaaaaugaggucaagcucaccaucaugacaggcgacauuaaagggaucaugcaggccggaaagagaucucugcgcccucagcccaccgaacugaaauauagcuggaagacguggggcaaggcgaaaaugcucuccaccgagagccacaaccaaacauuccugauugaugggccugaaaccgccgagugccccaauacaaaccgggcuuggaacucucuugagguggaagacuacggauuuggcguuuucuccaccaacaucuggcugaagcucagagagaaacaggacguguuuugugauagcaagcugaugucugccgcuaucaaagacaaucgcgccguccaugcggauaugggcuauuggauugaauccgcccugaacgacacauggaagauggagaaggcuagcuucaucgaggugaaaucuugccacuggccuaagagccacacccuuugguccaaugggguucucgaaagcgagaugauuauccccaaaaacuucgccggaccggugucucagcauaacuaccggccuggcuaucacacgcagacagcugggcccuggcaucugggaaagcuggaaauggauuuugacuucugugagggcaccaccgucguggugacagaagauugcgggaauagaggacccucccuccggaccacgacagccagcggcaaacugauuaccgaguggugcugucgcuccugcacacuuccuccgcugagauaccggggcgaggacggguguugguacggaauggaaaucagaccccucaaggagaaggaagagaaccuggucaauucucugguuaccgccggccacgggcaaauugauaacuuuagccuuggagugcucggcauggcucuguuccuggaagagaugcuccgcacacggguggggaccaaacaugcgauccugcuugucgccguguccuuuguuacgcugaucaccggaaauaugucuuucagagaccucggccgcgugauggucauggugggcgcuacaaugaccgaugacauugggaugggaguuacauaucuggcccugcuugccgcuuuuaaggugagaccuaccuucgccgcgggccugcuccugcggaaacucacgagcaaggagcugaugauggcuacaaucgggauugcccuucugucccagucuaccauccccgaaacaauucucgagcugaccgaugcccuggcucuuggaaugaugguccugaaaaucgugcgcaacauggaaaaguaccagcucgccguuaccaucauggcgauuagcugcgugccuaaugcugucauccugcaaaacgccuggaagguguccuguacaauucucgccgcugugagcgucucuccccugcuucugacguccagccagcagaaagccgacuggaucccucucgcucugaccauuaagggccugaaucccacagccaucuuucuuaccacacugucuagaaccuccaaaaagcggagcuggccgcucaacgaggcgaucauggccguugggauggugucuauucuggcuuccagccuccugaaaaaugacaucccuaugacgggaccccuuguggccggcggccugcugacagucugcuaugugcucaccgggcgcuccgcugaucuggaacuugagagagccgccgacguuaagugggaggaucaggcugaaauuagcggaucuagcccuauccuguccauuaccaucucugaggacggcagcauguccauuaaaaacgaagaggaggaacaaacacucaccauccugauccggacagggcuccuggugauuucuggagucuuccccgugagcaucccgauuacggcggccgcuugguaccuuugggagguuaagaagcagcgcgccggcgugcugugggaugucccuucucccccucccguggggaaagccgaacuggaggacggagcuuauagaaucaagcagcggggcauucucggcuacagccagaucggggccggagucuauaaagaaggcaccuuucacacaauguggcacgugacccgcggggcgguucugaugcauagaggaaagcggaucgagcccagcugggcugaugugaaaaaggaccuuauuuccuacggcgggggauggaagcuggagggcgaauggaaagagggcgaagagguccaagugcucgcccuggaaccugggaagaauccgagagccguucagacaaaacccggacucuucaagaccaacacgggcaccaucggggcugugagccuggauuuuucuccuggaacauccggcagccccauugucgaccgcaaagggaagguggugggacuuuacggcaauggcguugucacccggucuggggccuauguguccgcgaucgcucagacagaaaagagcauugaggauaacccugaaaucgaggacgauaucuuccgcaagaagcgccugaccauuauggaccugcaccccggagccggcaaaacaaagcgguaccucccugccaucgugagagaagcuauuaaacgcgggcugcggacgcuuauccuggccccgaccagagucguggcugccgagauggaagaggcgcuccgcggacugcccauucgguaucagaccccugccaucagagcugagcauaccggccgggaaauuguugaccucaugugucacgccaccuucacaaugcgccugcuuucccccgugagagucccuaacuacaaucugaucaucauggaugaggcucauuuuacggaccccgccucuauugccgcucggggguauaucagcacccgcguggaaaugggcgaggcggccggaauuuucaugacagcuaccccgccuggcuccagagaucccuuuccccaaagcaacgccccuaucauggacgaggaacgggagauucccgaaagaucuuggaacuccgggcacgaguggguuacagauuucaagggaaagaccgugugguuugucccuagcaucaaagccggcaacgacaucgcugccugccugcgcaagaaugggaaaaaggugauucagcucucucggaaaacguucgauagcgaauacguuaagacaagagcgaacgacugggauuuuguggucaccaccgacaucuccgagaugggagcuaauuucaaggccgagcgcgugauugauccgcggagauguaugaaacccgugauccugacagacggcgaagaaagagucauucuugccgggccuaugcccguuacccacucuagcgcugcccagcggagaggccgcaucggaagaaacccuaagaaugaaaacgaccaauauaucuacaugggcgagccccuggaaaaugaugaggacugcgcgcauuggaaagaggccaagaugcuccuggauaacauuaauacaccggaagggaucauuccuuccauguuugagcccgaacgggagaaaguggacgcuaucgauggagaauaccgccugagaggcgaggcccggaagaccuucguggaccucaugcgcagaggggaucuuccugucuggcuggcuuaucggguggccgcugagggaauuaacuacgccgacagacgcugguguuuugauggcaucaaaaauaaccagauucuggaagagaacguugaaguggagaucuggacgaaggagggggaacggaagaaacucaagcccagauggcuggacgcgcgcaucuauucugauccucuugcccugaaagaguucaaggaguucgcugccggccggaaaagccucacacugaaucugauuaccgagaugggaagacuccccacauuuaugacccagaaggcucgggacgcccuugauaaccuggccguccugcacacggcugaagcgggcgggcgcgccuacaaucaugcucucuccgagcugccggagacccuugaaacacugcuccugcugacccuccuugccacagugaccggaggcaucuuccuguuucugaugagcgggaagggaauuggcaaaaugacacucggcaugugcugcaucauuaccgccucuauccugcuuugguaugcucagauccaaccucacuggauugccgcguccaucauucuggaguucuuucucaucguucugcugauucccgaacccgagaagcagagaacgccucaggacaaccagcucacauacguggucaucgccauccuuaccguggucgcugccaccauggcuaaugaaaugggguuccuggagaaaacaaagaaagaccugggacucggcagcauuaccacacaagaguccgaaucuaacauccuggauauugaccuucggccggccagcgcguggacgcuguaugccguggcuaccacauuuguuacccccaugcuccgccacuccaucgaaaauucuagcgugaacgugucccugacagccauugcuaaucaggccaccguccugauggggcucggaaagggcuggccucuuagcaagauggauaucgggguuccccugcuggcuauuggauguuacucucaggugaacccuaucacgcucaccgccgcgcugcuucugcucguggcccauuacgcuaucauuggccccggccugcaggccaaagcuacaagagaagcccaaaagcgggccgcggcugggaucaugaaaaauccuaccgucgacggaauuacagugaucgaucuggagccgauucccuaugacccuaaguucgaaaaacagcucggccagguuaugcuucugauccugugcgugacccagguccucaugaugcgcacgacaugggcccugugugaggcucuuacccuggccacagggcccaucuccacccucugggagggaaacccuggcagauuuuggaauaccacaauugccgugagcauggcuaacaucuuccgggggucuuaccuggccggagcgggccugcucuuuuccauuaugaagaauacgaccaacacacgcagaggcaccgggaauaucggagaaacacuuggcgagaaguggaaaagccggcugaacgcccuggggaagucugaguuccaaauuuauaaaaagagcggaauccaggaggucgauagaacccucgcuaaagagggcaucaagcgcggggaaacggaccaccaugccgugucccggggaucugcuaaacugagaugguuuguugagcgcaacauggugacacccgaaggcaaggucguggaucuuggcugcgggcggggaggcuggagcuacuauugugggggacugaagaauguuagagaggugaaaggccucaccaaagggggaccgggccacgaggaaccuauucccauguccaccuacggcuggaaccugguccgccugcagagcgggguggacguguucuucacacccccugagaaaugcgauacccuccuuugugacaucggagaauccucucccaauccuacaauugaggccggccggacgcugagaguucugaaccucgucgaaaauuggcugaacaauaacacccaauuuugcaucaaggugcuuaauccguauaugcccagcgugauugagaaaauggaaacacugcagcgcaaguacgggggagcgcucguccggaacccucuguccagaaauucuacccaugagauguacuggguuagcaacgccacaggcaauaucguguccucugugaacaugaucagccgcaugcugauuaaucgguucaccaugaagcacaaaaaggcuacguaugagcccgaugucgaccucggguccggaaccagaaacaucggcauugaaagcgagaucccuaaccuugacauuaucggcaaacgcauugaaaagaucaaacaggagcacgaaacaucuuggcauuacgaucaggaccaccccuauaagaccugggccuaccauggguccuaugagacaaagcaaaccggaagcgcuucuuccauggugaauggcguugugagacugcugacaaaaccgugggaugucgugccuaugguuacccagauggccaugacggacacaacccccuuugggcagcagcggguguucaaggagaaagucgauacccgcacacaagaaccuaaggagggaacgaaaaagcucaugaagaucaccgcugaauggcuguggaaagagcuuggcaagaaaaagacacccagaauguguacccgggaggaauuuacaagaaaagugcggagcaacgccgcgcugggggccauuuucaccgacgagaauaaguggaaaucugcucgcgaagccguggaggauuccagauuuugggaacucaucgaccgggagcgcaaccugcaccuggagggaaagugcgaaacaugugucuacaauaugaugggcaagagagagaaaaagcucggcgaguucgggaaagcuaagggaagccgggccauuugguauauguggcugggcgcccgcuuucuugaguucgaagcgcugggguuucucaacgaggaucacugguucuccagaggaaauagccugucuggcguugagggggaaggccuucaucggcugggauacauccuccgcgacgugagcaaaaaggagggcggggcuauguacgccgaugacaccgccggaugggacacgagaauuacccuggaagaucugaagaacgaggaaauggugacaaaucacaugaaaggcgagcauaagaaacucgcugaggccaucuuuaagcugaccuaucagaacaaagucgugcggguucagcgcccuacacccagagggaccgugauggacaucauuucccggcgcgaucagagaggaucuggccaagucgggacguacggccuuaauacauucaccaacauggaagcucagcugauccggcagauggagggagaaggcauuuucaagagcauccaacaccucacagugaccgaggagauugccguucagaauuggcuggcgagaguggggcgcgaacggcuuuccagaauggccaucucuggagacgauugcgucgugaagccgcuggacgaucgcuuugcuagcgcccucacggcucugaacgacaugggcaaaguucggaaggauauccagcagugggagccuuccagaggguggaaugacuggacccaagugcccuucugcucucaucacuuucacgaacuggucaugaaagauggacgcgugcucgucgugcccugucggaaccaggacgagcugauuggcagagcccgcaucagccagggggcgggcuggucccuuaaggaaacagccugccugggaaaaagcuaugcucagauguggacccucauguacuuccaucggagagaucugcgccuugccgcuaacgccauuuguucugcuguuccuucccacugggugccgacaagccggaccacauggucuauccaugccaagcacgaguggaugaccacggaggacaugcuggcggucuggaauagaguguggauucaagaaaaccccuggauggaggacaagacaccuguggaauccugggaggaaguucccuaucucggcaaacgggaggaucaguggugcgggagccugaucggacugaccuccagagccaccugggcuaagaauauucagacagccaucaaccaggugcgcucucucaucggcaaugaggaauacaccgacuauaugccuagcaugaaacgguuuagacgcgaggaagaggaagccgggguccugugguga

SEQ ID NO: 19918 - RNA, 9876 nt, Artificial Sequence
  derived and/or modified CDS sequence (opt5) from DENV-2__EU482578__SS-prME
accgccggcgugaucauuaugcugauccccaccgcuauggccuuccaccucacgacccggaacggggagccucauaugauugucggacggcaggaaaagggcaagucccugcuuuuuaagaccgaggacgggguuaauaugugcacccugauggcgaucgaucucggagaacugugugaggacaccauuaccuacaagugcccgcuucugcgccaaaacgaacccgaggauaucgacuguuggugcaauuccacgucuaccugggugacguauggcaccuguacaaccacaggggagcacagacgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugacacuguaucucggggccaugguccaggccgacagcggaugugugguuucuuggaaguccaaagaacugaagugcggcagcgggaucuucauuaccgauaaugugcacacauggacggagcaguacaaguuucagccugaaucccccucuaaacuugcuagcgccauccaaaaggcucaugaggaaggcauuuguggaaucagauccgucacccgccuggagaaccucauguggaaacagaucacaccggagcugaaucacauucugucugaaaacgaggugaaacuuaccaucaugacaggcgacauuaaagggaucaugcaggccggaaagcggagccucagaccucagcccaccgaacugaaauauuccuggaagacguggggcaaggcgaaaaugcugagcaccgagucucauaaucaaacauuccucauugaugggccugaaaccgccgagugccccaacacaaaucgcgcuuggaacucccuggagguugaagacuacggauuuggcguguucaccacaaauaucuggcuuaagcugcgggagaaacaggacgucuuuugugauagcaagcucaugucugccgcuaucaaagacaacagagccgugcacgcggauaugggcuauuggauugaauccgcccugaaugacaccuggaagauggagaaggcuagcuucaucgagguuaaaucuugccacuggccuaagagccauacgcugugguccaacggggugcuugaaagcgagaugauuauccccaaaaauuucgccggaccggucucucagcacaacuaccgcccuggcuaucauacacagaccgcugggcccuggcaccucggaaagcuggaaauggauuuugacuucugugagggcaccacagugguggucaccgaagauugcgggaaccggggacccucccugagaacgacaaccgccagcggcaaacucauuacagaguggugcugucgguccugcacccugccuccgcuucgcuacagaggcgaggacggguguugguacggaauggaaauccggccccugaaggagaaggaagagaaucucguuaacucucuggugacagccggccaugggcaaauugauaauuuuagccugggagugcuuggcauggcucucuuccuggaagagaugcugagaacccgcgucgggacgaaacacgcgauccuccugguggccguuuccuuugugacccuuaucacaggaaacaugucuuuccgggaccugggcagagucauggugaugguuggcgcuaccaugacagaugacauugggaugggagugaccuaucucgcccugcuggccgcuuuuaagguccgcccuacguucgccgcgggccuucugcucagaaaacugacaagcaaggagcucaugauggcuaccaucgggauugcccugcuuucccagucuacaauccccgaaaccauucuggagcucaccgaugcccuggcucugggaaugauggugcuuaaaaucguucggaauauggaaaaguaccagcuggccgugacaaucauggcgauuagcugcgucccuaacgcugugauccuccaaaaugccuggaagguguccuguacgauucuggccgcugucagcguuucuccccuccugcuuaccuccagccagcagaaagccgacuggaucccucuggcucucacaauuaagggccugaaccccaccgccaucuuucugacaacccuuucucgcacguccaaaaagagaagcuggccgcugaaugaggcgaucauggccguggggauggugucuauucucgcuuccagccugcucaaaaacgacaucccuaugacaggaccccuggucgccggcggccuucugaccgugugcuauguucugaccgggcgguccgcugaucucgaacuggagcgcgccgccgacgugaagugggaggaucaggcugaaauuagcggaucuagcccuauccuuuccauuacaaucucugaggacggcagcauguccauuaaaaaugaagaggaggaacaaacccugacaauccucaucagaacggggcugcucgucauuucuggaguguuccccguuagcaucccgauuaccgcggccgcuugguaccugugggaggugaagaagcagcgggccggcguccuuugggaugugccuucucccccucccgucgggaaagccgaacuggaggacggagcuuaucgcaucaagcagagaggcauucugggcuacagccagaucggggccggaguguauaaagaaggcacauuucacaccauguggcauguuacaagaggggcggugcucaugcaccgcggaaagagaaucgagcccagcugggcugaugucaaaaaggaccugauuuccuacggcgggggauggaaacuugagggcgaauggaaagagggcgaagaggugcaaguucuggcccucgaaccugggaagaacccgcgggccgugcagaccaaacccggacuguucaagacgaauaccggcacaaucggggcugucagccucgauuuuucuccuggaaccuccggcagccccauuguggacagaaaagggaaggugguuggacuguacggcaacggcgucgugacacgcucuggggccuauguguccgcgaucgcucagaccgaaaagagcauugaggauaauccugaaaucgaggacgauaucuuccggaaaaagagacuuacaauuauggaccugcaucccggagccggcaaaacgaagcgcuaccugccugccaucguccgggaagcuauuaaaagagggcuccgcacccugauccuugccccgacacgggugguugcugccgagauggaagaggcgcugagaggacuccccauucgcuaucagaccccugccauccgggcugagcacaccggcagagaaauuguggaccugaugugucaugccacauucacgaugcggcuccugucccccguccgcgugccuaacuacaaccuuaucaucauggaugaggcucacuuuaccgaccccgccucuauugccgcuagaggguauaucagcacacggguugaaaugggcgaggcggccggaauuuucaugaccgcuacaccgccuggcucccgcgaucccuuuccccaaagcaaugccccuaucauggacgaggaaagagagauucccgaacggucuuggaacuccgggcacgagugggugaccgauuucaagggaaagacggucugguuugugccuagcaucaaagccggcaaugacaucgcugccugccugagaaagaacgggaaaaagguuauucagcugucucgcaaaacauucgauagcgaauacgugaagacccgggcgaaugacugggauuuugucgugaccacagacaucuccgagaugggagcuaacuucaaggccgagagagugauugauccgcgccgguguaugaaacccgucauccucaccgacggcgaagagagaguuauucuggccgggccuaugcccgugacacauucuagcgcugcccagcgccggggcagaaucggacgcaauccuaagaacgaaaaugaccaauauaucuacaugggcgagccccuugaaaacgaugaggacugcgcgcacuggaaagaggccaagaugcugcucgauaauauuaacaccccggaagggaucauuccuuccauguuugagcccgaaagagagaaaguggacgcuaucgauggagaauaccggcugcgcggcgaggccagaaagacguucgucgaccugaugcggcgcggggaucucccuguguggcuugcuuauagaguugccgcugagggaauuaauuacgccgaccggagaugguguuuugauggcaucaaaaacaaucagauucuggaagagaacguggaagucgagaucuggacaaaggagggggaacgcaagaaacugaagccccgguggcucgacgcgagaaucuauucugauccucuggcccuuaaagaguucaaggaguucgcugccggccgcaaaagccugacccucaaccugauuacagagaugggacggcugcccaccuuuaugacgcagaaggcuagagacgcccucgauaaucuugccgugcugcauaccgcugaagcgggcgggcgggccuacaaccacgcucuguccgagcucccggagacacuggaaacccuucugcuccugacacugcucgccaccguuacaggaggcaucuuccuuuuucugaugagcgggaagggaauuggcaaaaugacccugggcaugugcugcaucauuacggccucuauccuccugugguaugcucagauccaaccucacuggauugccgcguccaucauucuugaguucuuucugaucgugcuccugauucccgaacccgagaagcagcgcacaccucaggacaaucagcugaccuacgucgugaucgccauccucaccgucguggcugccacaauggcuaacgaaaugggguuccuugagaaaaccaagaaagaccugggacugggcagcauuacaacgcaagaguccgaaucuaauauccucgauauugaccugagaccggccagcgcguggacccuuuaugccguugcuacaaccuuugugacacccaugcugcggcauuccaucgagaacucuagcgugaaugucucccucaccgccauugcuaaccaggccacgguucugauggggcugggaaagggcuggccucucagcaagauggauaucggggugccccuucuggcuauuggauguuacucucaggugaauccuaucacccugacagccgcgcuccugcuucuggucgcccacuacgcuaucauuggccccggccuccaggccaaagcuacccgcgaagcccaaaagagagccgcggcugggaucaugaaaaacccuacaguggacggaauuaccguuaucgaucuggagccgauucccuaugacccuaaguucgaaaaacagcugggccaggugaugcuccuuauccugugcgucacacaggugcugaugaugcggacaaccugggcccucugugaggcucugacacuugccaccgggcccaucuccacccugugggagggaaauccuggccgcuuuuggaacacaacgauugccgucagcauggcuaauaucuucagagggucuuaccucgccggagcgggccugcuguuuuccauuaugaagaacaccacaaauacccggcgcggcacagggaacaucggagaaacccucggcgagaaguggaaaagcagacuuaaugcccuggggaagucugaguuccaaauuuauaaaaagagcggaauccaggagguggaucggacgcuggcuaaagagggcaucaagagaggggaaacagaccaucacgccguuucccgcggaucugcuaaacuccggugguuuguggagagaaacauggucacccccgaaggcaaggugguugaucugggcugcgggcgcggaggcuggagcuacuauugugggggacuuaagaacgugcgggaggucaaaggccugaccaaagggggaccgggccaugaagaaccuauucccauguccacauacggcuggaaucucgugagacugcagagcgggguggacguuuucuucacacccccugagaaaugcgauacacugcucugugacaucggagaauccucucccaacccuacgauugaggccggccgcacccuucggguccugaaucugguggaaaacuggcucaauaacaauacacaauuuugcaucaaggugcugaacccguauaugcccagcgucauugagaaaauggaaacccuucagagaaaguacgggggagcgcugguucgcaauccucucucccggaacucuacacacgagauguacugggugagcaaugccaccggcaacaucguguccucugucaauaugaucagcagaaugcugauuaaccgcuucacgaugaagcacaaaaaggcuaccuaugagcccgauguggaccugggguccggaacacggaauaucggcauugaaagcgagaucccuaaccucgacauuaucggcaaaagaauugaaaagaucaaacaggagcaugaaaccucuuggcacuacgaucaggaccaucccuauaagacaugggccuaccacggguccuaugagaccaagcaaacaggaagcgcuucuuccaugguuaacggcgugguccgccuucugaccaaaccgugggaugugguuccuauggugacgcagauggccaugacagacaccacccccuuugggcagcagagagucuucaaggagaaaguggauacacggacgcaagaaccuaaggagggaaccaaaaagcugaugaagaucacagcugaauggcucuggaaagagcugggcaagaaaaagacaccccgcauguguacaagagaggaauuuacccggaaagugagaagcaaugccgcgcuuggggccauuuucacagacgagaacaaguggaaaucugcucgggaagccgucgaggauucccgcuuuugggaacugaucgacagagagcggaaucuccaccuggagggaaagugcgaaaccuguguuuacaacaugaugggcaagcgcgagaaaaagcugggcgaguucgggaaagcuaagggaagcagagccauuugguauauguggcucggcgcccgguuucuggaguucgaagcgcuuggguuucugaaugaggaucauugguucucccgcggaaacagccucucuggcguggagggggaaggccugcacagacuuggauacauccugcgggacgugagcaaaaaggagggcggggcuauguacgccgaugacacggccggaugggacacccgcauuacacucgaagaucugaagaaugaggaaauggucaccaaccauaugaaaggcgagcacaagaaacuggcugaggccaucuuuaagcucacauaucagaauaaagugguuagagugcagcggccuacaccccgcgggacggucauggacaucauuuccagacgggaucagcgcggaucuggccaaguggggacauacggccugaacaccuucacaaauauggaagcucagcuuaucagacagauggagggagaaggcauuuucaagagcauccaacaucugaccguuacggaggagauugccgugcagaacuggcucgcgcgggucgggagagaacgccugucccggauggccaucucuggagacgauugcgugguuaagccgcuugacgauagauuugcuagcgcccugaccgcucucaaugacaugggcaaagugcgcaaggauauccagcagugggagccuucccggggguggaacgacuggacacaaguccccuucugcucucaccacuuucaugaacuggugaugaaagauggaagaguccuggugguucccugucgcaaucaggacgagcucauuggccgggccagaaucagccagggggcgggcuggucccugaaggaaaccgccugccuuggaaaaagcuaugcucagauguggacacugauguacuuccaccgccgggaucucagacuggccgcuaacgccauuuguucugcugugccuucccauugggucccgaccagccgcacaaccuggucuauccacgccaagcacgaguggaugacgacagaggacaugcuugcgguguggaaccggguguggauucaagaaaaucccuggauggaggacaagaccccuguugaauccugggaggaagugcccuaucugggcaaaagagaggaucaguggugcgggagccucaucggacugaccucccgggccacaugggcuaagaacauucagaccgccaucaaucaggucagaucucugaucggcaacgaggaauacacagacuauaugccuagcaugaaacgcuuucggagagaggaagaggaagccggggugcucugguga

SEQ ID NO: 19919 - RNA, 9876 nt, Artificial Sequence
  derived and/or modified CDS sequence (opt5) from DENV-2__EU482580__SS-prME
accgccggagugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgauggaucucggagaacugugugaggacacaaucaccuacaaaugcccgcuucugcgccaaaaugaacccgaggauauugacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauccugcgccaucccggguucacaauuauggccgcuauccucgccuacaccauuggaaccacacacuuucagagagcucugaucuucauucuucugacggccguggcgccuagcaugaccaugcggugcaucggcauuuccaaccgcgauuuugucgaaggggugucuggaggcagcuggguugacaucgugcucgagcacggguccugugucacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaagggggaaucgugacaugcgccauguuuacgugcaaaaagaauauggaaggcaaagucguucagccugagaaccuggaauacaccauugugaucacaccccacagcggggaggagcaugcggugggaaaugacaccggcaagcacggcaaagaaauuaagaucacaccucagucuuccaucaccgaggccgaacuuacgggguauggaaccgucacaauggaguguagcccccggaccggccuggauuucaacgaaauggugcuccugcaaauggaggacaaggcuuggcuuguucaccgccagugguuucuggaucucccgcugccuuggcugcccggggccgacacacagggaucuaauuggauucagaaggagacccucgugacguucaagaacccucaugcuaaaaagcaagacgucgugguucugggcucccaggaaggggccaugcacacagcccuuaccggcgcuacagagauccagaugagcuccggaaaucugcucuuuaccggccaucugaaaugcagacuucggauggauaagcugcaacucaaagggaugucuuacagcauguguaccggaaaguucaagauugugaaagaaaucgcggagacacagcacggcacgauugucaucagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucauuggcgucgagcccggacagcugaaacuuaauugguucaagaagggcuccagcaucgggcaaauguuugagaccacaaugagaggagcuaaacgcauggccauccugggcgacaccgccugggauuucgggucucucggaggcguguuuacgagcauugggaaggcucugcaccagguuuucggcgccaucuacggagcggcuuuuuccggcgugucuuggacaaugaaaauuuucaucggggucauuaucaccuggaucggaaugaacagccgguccaccagccugucugugucccuugugcucguuggcgucgugacacuguaucugggggccauggugcaggccgacagcggaugugucgugucuuggaagaauaaagaacucaagugcggcuccgggauuuuuaucaccgauaacguucacacauggacggagcaguacaaguuccaaccugaaagccccuccaaacuggcuucugccauucagaaggcucaugaggaaggcaucuguggaauuagaagcgugacccgccuugagaaucugauguggaaacagaucacaccggagcucaaccacauccuguccgaaaaugaggucaagcugaccauuaugacaggcgacaucaaagggauuaugcaggccggaaagcggucucuuagaccucaacccaccgaacucaaauauagcuggaagacguggggcaaggcgaaaaugcuguccaccgagagccauaaccagacauuucugaucgaugggccugaaaccgccgagugccccaauacaaaccgcgcuuggaacucucucgagguggaagacuacggauucggcguuuuuaccacaaacauuuggcugaaacuucgggagaaacaggacguguucugugauuccaagcugaugagcgccgcuaucaaagacaauagagccguccacgcggauaugggcuauuggaucgaaucugcccucaacgacaccuggaagauggagaaggcuuccuucauugaggugaaaagcugccacuggccuaagucucauacgcuguggagcaaugggguucuggaauccgagaugaucauucccaaaaacuuugccggaccggugagccagcacaacuaccgcccuggcuaucauacacaaaccgcugggcccuggcaccuuggaaagcucgaaauggauuucgacuuuugugagggcaccacagucguggugaccgaagauugcgggaaucggggacccucucugagaacgacaaccgccuccggcaaacugaucacagaguggugcugucggagcugcacccucccuccgcugcgcuacagaggcgaggacggguguugguacggaauggaaauucggccccuuaaggagaaggaagagaaccuggucaauucccucguuacagccggccaugggcagaucgauaacuucucucugggagugcugggcauggcucuuuuucucgaagagaugcugagaacccgcguggggacgaaacacgcgauucugcucgucgccgugagcuucguuacccugaucacaggaaauauguccuuucgggaccuuggcagagugauggucauggugggcgcuaccaugacagaugacaucgggaugggaguuaccuaucuggcccuccuggccgcuuucaaggugcgcccuacguuugccgcgggccugcuucugagaaaacucacaucuaaggagcugaugauggcuaccauugggaucgcccuccugagccaguccacaauucccgaaaccauccuugagcugaccgaugcccucgcucugggaaugaugguccugaaaauugugcggaacauggaaaaguaccaacuugccguuacaaucauggcgaucucuugcgugccuaaugcugucauucugcagaacgccuggaaggugagcuguacgauccucgccgcuguguccgucagcccccugcuccugaccucuucccagcagaaagccgacuggauuccucuugcucugacaaucaagggccucaaucccaccgccauuuuccugacaacccugagccgcacgucuaaaaagagauccuggccgcuuaacgaggcgaucauggccguugggauggugagcauccuggcuucuucccuccugaaaaaugacauuccuaugacaggaccccucguggccggcggccugcuuaccgucugcuaugugcugaccgggcggagcgcugaucuggaacucgagcgcgccgccgacguuaagugggaggaucaagcugaaaucuccggaagcucuccuauucugagcaucacaauuuccgaggacggcucuaugagcaucaaaaacgaagaggaggaacagacccuuacaauucugaucagaacggggcuccuggugaucuccggagucuuucccgugucuauuccgaucaccgcggccgcuugguaccucugggagguuaagaagcagcgggccggcgugcugugggaugucccuucucccccucccguggggaaagccgaacuugaggacggagcuuaucgcauuaagcagagaggcauccugggcuacucccaaauuggggccggagucuauaaagaaggcacauuccacaccauguggcaugugacaagaggggcgguucugaugcaccgcggaaagagaaucgagcccuccugggcugaugugaaaaaggaccucaucagcuacggcgggggauggaagcuggagggcgaauggaaagagggcgaagagguccaggugcuugcccuggaaccugggaagaauccgcgggccguucagaccaaacccggacucuuuaagacgaacaccggcacaauuggggcugugucccuggauuucagcccuggaaccucuggcucccccaucgucgacagaaaagggaagguggugggacucuacggcaauggcguugucacacgcagcggggccuaugugucugcgauugcucagaccgagaaguccaucgaggauaacccugaaauugaggacgauaucuuccggaaaaagagacugacaaucauggaccuucaucccggagccggcaaaacgaagcgcuaccugccugccauugugcgggaagcuaucaaaagagggcugcgcacccucauucuggccccgacacgggucguggcugccgagauggaagaggcgcuuagaggacugcccauccgcuaucaaaccccugccauucgggcugagcacaccggcagagaaaucguugaccucaugugucaugccacauuuacgaugcggcugcucagccccgugcgcgucccuaacuacaaucugauuaucauggaugaggcucacuucaccgaccccgccuccaucgccgcuagaggguauauuucuacacggguggaaaugggcgaggcggccggaaucuuuaugaccgcuacaccgccuggcagccgcgaucccuucccccaguccaacgccccuauuauggacgaggaaagagagauccccgaacggagcuggaacucugggcacgaguggguuaccgauuuuaagggaaagacggugugguucgucccuuccauuaaagccggcaacgacaucgcugccugccuuagaaagaaugggaaaaaggugauccagcugagccgcaaaacauuugauucugaauacguuaagacccgggcgaacgacugggauuucguggucaccacagacauuagcgagaugggagcuaauuuuaaggccgagagagugaucgauccgcgccgguguaugaaacccgugauucugaccgacggcgaagagagagucauccucgccgggccuaugcccguuacacauuccucugcugcccaacgccggggcagaauuggacgcaacccuaagaaugaaaacgaccaguauaucuacaugggcgagccccuggaaaaugaugaggacugcgcgcacuggaaagaggccaagaugcuucuggauaacaucaauaccccggaagggauuaucccuagcauguucgagcccgaaagagagaaaguggacgcuauugauggagaauaccggcuccgcggcgaggccagaaagacguuuguggaccugaugcggcgcggggaucugccugucuggcucgcuuauagaguggccgcugagggaaucaacuacgccgaccggagaugguguuucgauggcauuaaaaauaaccagauccuugaagagaacguugaaguggagauuuggacaaaggagggggaacgcaagaaacugaagccccgguggcuggacgcgagaaucuauuccgauccucucgcccugaaagaguucaaggaauuugcugccggccgcaaaucucuuacccugaaucucaucacagagaugggacggcugcccaccuucaugacgcagaaggcuagagacgcccuggauaaccucgccguccuucauaccgcugaagcgggcgggaaggccuacaaucacgcucugagcgagcugccggagacacucgaaacccugcuucugcucacacugcuggccaccgugacaggaggcauuuuucucuuccuuauguccgggaaaggaaucggcaagaugacccugggcaugugcugcauuaucacggccagcauucugcucugguaugcucaaauccagccucacuggaucgccgcgucuauuauccuggaguuuuuccuuauuguucugcucauccccgaacccgagaaacagcggacaccucaggacaaccaacugaccuacguggucauugccauccugaccguggucgcugccacaauggcuaaugaaaugggguuucucgagaagaccaaaaaggaccuuggacugggcuccaucacaacgcaggagagcgaauccaacauucuggauaucgaccuccgcccggccucugcguggacccuguaugccguggcuacaaccuucguuacacccaugcuuagacauagcauugaaaauagcucugugaacgugagccugaccgccaucgcuaaucaggccacgguccucauggggcugggaaagggcuggccucuguccaaaauggauauugggguuccccuccuugcuaucggauguuacagccaggugaacccuauuacccugacagccgcgcugcuccugcuuguggcccacuacgcuaucaucggccccggccugcaagccaaggcuacccgggaagcccagaaacgcgccgcggcugggauuaugaagaauccuacagucgacggaaucaccgugauugaucucgagccgauccccuaugacccuaaauuugaaaagcagcugggccagguuaugcugcucauucuuugcgugacgcaaguccugaugaugagaacaaccugggcccugugugaggcucucacacuggccaccgggcccaucucuacccuuugggagggaaacccuggccgguucuggaauacaacgaucgccguguccauggcuaacauuuuucgcgggagcuaccuggccggagcgggccuccuguucucuaucaugaagaauaccacaaacaccagacggggcacagggaauauuggagaaacccugggcgagaaauggaagucccgccucaacgcccuugggaaaagcgaauuucagaucuauaagaaaucuggcauucaggaggucgauagaacgcuggcuaaggagggcaucaaaagaggggaaacagaccaucacgccgugagcagaggauccgcuaagcugcgcugguucguugagcggaacauggugacccccgaaggcaaggucguggaucucggcugcgggagaggaggcuggucuuacuauugugggggacugaaaaauguucgcgaggugaagggccuuaccaaagggggaccgggccaugaggaaccuauccccaugagcacauacggcuggaaccugguccggcuccaauccgggguggacguguucuuuacacccccugagaagugcgauacccugcugugugacauuggagaaagcucccccaauccuacgaucgaggccggcagaacccuccgcguucuuaaccuggucgaaaauuggcugaacaauaacacacaguucugcauuaaagugcucaauccguauaugcccucugugaucgagaagauggaaacccugcagcggaaguacgggggagcgcuugucagaaacccucugagccgcaauuccacacacgagauguacuggguuucuaacgccaccggcaauauugugagcuccgugaacaugaucucucggaugcucaucaauagauuuacgaugaaacacaagaaagcuaccuaugagcccgaugucgaccuggggagcggaacacgcaacauuggcaucgaauccgagauuccuaaccuggacaucauuggcaagcggaucgagaagauuaagcaggagcaugaaaccagcuggcacuacgaucaagaccaucccuauaagacaugggccuaccacgggucuuaugagaccaaacagacaggauccgcuagcucuauggugaauggcguugugagacuccuuaccaagccgugggaugucgugccuaugguuacgcagauggccaugacagacaccacccccuucgggcagcaacgcguguuuaaagagaaggucgauacaagaacgcaggaaccuaaagagggaaccaagaagcugaugaaaaucacagcugaauggcuguggaaggagcucggcaaaaagaaaacaccccggauguguacacgcgaggaguucaccagaaaggugcgguccaacgccgcgcugggggccaucuuuacagacgagaauaaauggaaaagcgcuagagaagccguggaggauucucgguucugggaacuugucgaccgcgagagaaaccugcaccucgagggaaagugcgaaaccuguguuuacaauaugaugggcaaacgggagaagaaacugggcgaauuugggaaggcuaaaggaucccgcgccauuugguauauguggcugggcgccagauuccucgaguuugaagcgcugggguuccuuaacgaggaucauugguuuagccggggaaauucccugagcggcguggagggggaaggccuccaccgccugggauacauccuuagagacgugucuaagaaggagggcggggcuauguacgccgaugacacggccggaugggacacccggauuacacuggaagaucucaaaaacgaggaaauggucaccaaucauaugaagggcgagcacaaaaagcuggcugaggccaucuucaaacugacauaucagaacaaggugguucgcgugcagagaccuacaccccgggggacggucauggacauuaucagccgcagagaucaacggggauccggccagguggggacauacggccucaauaccuucacaaacauggaagcucagcugauccgccaaauggagggagaaggcauuuuuaagucuauccagcaucuuaccguuacggaggagauugccgugcagaauuggcuggcgagagucgggcgggaaagacucagccgcauggccaucuccggagacgauugcgugguuaaaccgcuggacgaucgguucgcuucugcccuuaccgcucugaacgacaugggcaaggugagaaaagauauucagcaaugggagccuagccgcggguggaaugacuggacacagguccccuuuugcucccaccacuuccaugaacucgugaugaaggauggacggguccuggugguucccuguagaaaccaggacgagcugaucggccgcgcccggaucucucagggggcgggcuggagccucaaagaaaccgccugccugggaaaguccuaugcucaaauguggacacuuauguacuuucacagacgcgaucugcggcucgccgcuaacgccauuuguagcgcugugccuucucauugggucccgaccuccagaacaaccuggagcauccacgccaagcacgaguggaugacgacagaggacaugcuggcgguguggaaucgcguguggauucaggaaaaccccuggauggaggacaaaaccccuguugaaucuugggaggaagugcccuaucuuggcaagcgggaggaucaguggugcgggucccugaucggacucaccagcagagccacaugggcuaaaaauauucagaccgccaucaaccaaguccggucccugauuggcaaugaggaauacacagacuauaugccuucuaugaagagauuccgccgggaggaagaggaagccggggugcugugguga

SEQ ID NO: 19920 - RNA, 9876 nt, Artificial Sequence
  derived and/or modified CDS sequence (opt5) from DENV-2__EU482581__SS-prME
accgcgggagugaucauuaugcugauccccaccgcuauggccuuccaccucacgaccagaaacggggaaccucauaugauugucggacggcaggaaaagggcaaaagccugcuuuuuaagaccgaagacgggguuaauaugugcacccugauggcgaucgaucucggagaacugugugaagacaccauuaccuacaaaugcccgcuucugcgccaaaacgaacccgaagauaucgacuguuggugcaauuccacgucuaccugggugacguauggcaccuguacaaccacaggggaacacagacgggaaaagcgcuccguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaaggcgggauugucacaugcgccauguuuacgugcaaaaagaauauggaagggaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagggaaggacagcccggucaacauugaagccgagcccccuuuuggcgauucuuacaucauuaucggaguggaacccggccagcugaaacuuaauugguucaagaagggguccagcaucggacagauguuugagaccacaaugagaggcgcuaaacgcauggccauucugggggacaccgccugggauuucggaucucucggcgggguuuuuacgagcaucggcaaggcucugcaccaaguguucggagccauuuacggcgcggcuuuuuccggggucucuuggacaaugaaaauccugauuggagugaucaucaccuggauuggcaugaacagccgguccaccagccuuucugugucccucguucuggucgggguggugacacuguaucucggagccaugguccaggccgacagcggcugugugguuucuuggaaguccaaagagcugaagugcgggagcggcaucuucauuaccgauaaugugcacacauggacggaacaguacaaguuucagccugagucccccucuaaacuugcuagcgccauccaaaaggcucaugaagagggaauuuguggcaucagauccgucacccgccuggaaaaccucauguggaaacagaucacaccggagcugaaucacauucugucugagaacgaagugaaacuuaccaucaugacaggggacauuaaaggaaucaugcaggccggcaagcggagccucagaccucagcccaccgagcugaaauauuccuggaagacgugggggaaggcgaaaaugcugagcaccgaaucucauaaucaaacauuccucauugauggaccugagaccgccgaaugccccaacacaaaucgcgcuuggaacucccuggagguugaggacuacggcuuuggcguguucaccacaaauaucuggcuuaagcugcgggaaaaacaggacgucuuuugugauagcaagcucaugucugccgcuaucaaagacaacagagccgugcacgcggauaugggguauuggauugaguccgcccugaaugacaccuggaagauggaaaaggcuagcuucaucgagguuaaaucuugccacuggccuaagagccauacgcugugguccaacggagugcuugagagcgaaaugauuauccccaaaaauuucgccggcccggucucucagcacaacuaccgcccuggguaucauacacagaccgcuggacccuggcaccucggcaagcuggagauggauuuugacuucugugaagggaccacagugguggucaccgaggauugcggaaaccggggccccucccugagaacgacaaccgccagcggcaaacucauuacagaauggugcugucgguccugcacccugccuccgcuucgcuacagaggggaggacggauguugguacggcauggagauccggccccugaaggaaaaggaggaaaaucucguuaacucucuggugacagccgggcauggacaaauugauaauuuuagccugggcgugcuugggauggcucucuuccuggaggaaaugcugagaacccgcgucggaacgaaacacgcgauccuccugguggccguuuccuuugugacccuuaucacaggcaacaugucuuuccgggaccugggcagagucauggugaugguuggggcuaccaugacagaugacauuggaaugggcgugaccuaucucgcccugcuggccgcuuuuaagguccgcccuacguucgccgcggggcuucugcucagaaaacugacaagcaaggagcucaugauggcuaccaucggaauugcccugcuuucccagucuacaauccccgagaccauucuggaacucaccgaugcccuggcucugggcaugauggugcuuaaaaucguucggaauauggagaaguaccagcuggccgugacaaucauggcgauuagcugcgucccuaacgcugugauccuccaaaaugccuggaagguguccuguacgauucuggccgcugucagcguuucuccccuccugcuuaccuccagccagcagaaagccgacuggaucccucuggcucucacaauuaaggggcugaaccccaccgccaucuuucugacaacccuuucucgcacguccaaaaagagaagcuggccgcugaaugaagcgaucauggccgugggaauggugucuauucucgcuuccagccugcucaaaaacgacaucccuaugacaggcccccuggucgccggcgggcuucugaccgugugcuauguucugaccggacgguccgcugaucucgagcuggaacgcgccgccgacgugaagugggaggaucaggcugagauuagcggcucuagcccuauccuuuccauuacaaucucugaagacgggagcauguccauuaaaaaugaggaagaggagcaaacccugacaauccucaucagaacgggacugcucgucauuucuggcguguuccccguuagcaucccgauuaccgcggccgcuugguaccugugggaagugaagaagcagcgggccgggguccuuugggaugugccuucucccccucccgucggaaaagccgagcuggaagacggcgcuuaucgcaucaagcagagaggcauucugggguacagccagaucggagccggcguguauaaagaggggacauuucacaccauguggcauguuacacggggagcggugcucaugcaccgcggcaagagaaucgaacccagcugggcugaugucaaaaaggaccugauuuccuacgggggaggcuggaaacuugagggcgaguggaaagaaggggaggaagugcaaguucuggcccucgagccuggaaagaacccgcgggccgugcagaccaaacccggccuguucaagacgaauaccgggacaaucggagcugucagccucgauuuuucuccuggcaccuccgggagccccauuguggacagaaaaggaaaggugguuggccuguacggcaacggggucgugacacgcucuggagccuauguguccgcgaucgcucagaccgaaaagagcauugaggauaauccugagaucgaagacgauaucuuccggaaaaagagacuuacaauuauggaccugcaucccggcgccgggaaaacgaagcgcuaccugccugccaucguccgggaggcuauuaaaagaggacuccgcacccugauccuugccccgacacgggugguugcugccgaaauggaggaagcgcugagaggccuccccauucgcuaucagaccccugccauccgggcugagcacaccgggagagagauuguggaccugaugugucaugccacauucacgaugcggcuccugucccccguccgcgugccuaacuacaaccuuaucaucauggaugaagcucacuuuaccgaccccgccucuauugccgcuagaggcuauaucagcacacggguugagaugggagaagcggccggcauuuucaugaccgcuacaccgccugggucccgcgaucccuuuccccaaagcaaugccccuaucauggacgaggagagagaaauucccgagcggucuuggaacuccggacacgaaugggugaccgauuucaagggcaagacggucugguuugugccuagcaucaaagccgggaaugacaucgcugccugccugagaaagaacggcaagaagguuauucagcugucucgcaaaacauucgauagcgaguacgugaagacccgggcgaaugacugggauuuugucgugaccacagacaucuccgaaaugggcgcuaacuucaaggccgagagagugauugauccgcgccgguguaugaaacccgucauccucaccgacggggaggaaagaguuauucuggccggcccuaugcccgugacacauucuagcgcugcccagcgccggggaagaaucggccgcaauccuaagaacgagaaugaccaauauaucuacaugggggaaccccuugagaacgaugaagacugcgcgcacuggaaagaggccaagaugcugcucgauaauauuaacaccccggagggaaucauuccuuccauguuugaacccgagagagaaaaaguggacgcuaucgauggcgaguaccggcugcgcggggaagccagaaagacguucgucgaccugaugcggcgcggagaucucccuguguggcuugcuuauagaguugccgcugagggcauuaauuacgccgaccggagaugguguuuugaugggaucaaaaacaaucagauucuggaggaaaacguggaggucgaaaucuggacaaaggagggcgagcgcaagaaacugaagccccgguggcucgacgcgagaaucuauucugauccucuggcccuuaaagaguucaaggaguucgcugccggacgcaaaagccugacccucaaccugauuacagaaaugggccggcugcccaccuuuaugacgcagaaggcuagagacgcccucgauaaucuugccgugcugcauaccgcugaggccgggggacgggccuacaaccacgcucuguccgaacucccggagacacuggagacccuucugcuccugacacugcucgccaccguuacaggcgggaucuuccuuuuucugaugagcggaaagggcauuggcaaaaugacccuggggaugugcugcaucauuacggccucuauccuccugugguaugcucagauccaaccucacuggauugccgcguccaucauucuugaguucuuucugaucgugcuccugauucccgagcccgaaaagcagcgcacaccucaggacaaucagcugaccuacgucgugaucgccauccucaccgucguggcugccacaauggcuaacgagaugggauuccuugagaagaccaagaaagaccugggccuggggagcauuacaacgcaagaguccgagucuaauauccucgauauugaccugagaccggccagcgcguggacccuuuaugccguugcuacaaccuuugugacacccaugcugcggcauuccaucgaaaacucuagcgugaaugucucccucaccgccauugcuaaccaggccacgguucugaugggacugggcaagggguggccucucagcaagauggauaucggagugccccuucuggcuauuggcuguuacucucaggugaauccuaucacccugacagccgcgcuccugcuucuggucgcccacuacgcuaucauuggccccgggcuccaggccaaagcuacccgcgaggcccaaaagagagccgcggcuggaaucaugaaaaacccuacaguggacggcauuaccguuaucgaucuggaaccgauucccuaugacccuaaguucgagaaacagcugggacaggugaugcuccuuauccugugcgucacacaggugcugaugaugcggacaaccugggcccucugugaagcucugacacuugccaccggacccaucuccacccugugggagggcaauccugggcgcuuuuggaacacaacgauugccgucagcauggcuaauaucuucagaggaucuuaccucgccggcgcgggccugcuguuuuccauuaugaagaacaccacaaauacccggcgcgggacaggaaacaucggcgagacccucggggaaaaguggaaaagcagacuuaaugcccugggaaagucugaguuccaaauuuauaaaaagagcggcauccaggaaguggaucggacgcuggcuaaagaggggaucaagagaggagagacagaccaucacgccguuucccgcggcucugcuaaacuccggugguuuguggaaagaaacauggucacccccgagggcaaggugguugaucuggggugcggacgcggcggguggagcuacuauuguggaggccuuaagaacgugcgggaagucaaagggcugaccaagggaggcccgggccaugaggaaccuauucccauguccacauacggguggaaucucgugagacugcagagcggaguggacguuuucuucacacccccugagaaaugcgauacacugcucugugacaucggcgaguccucucccaacccuacgauugaagccgggcgcacccuucggguccugaaucugguggagaacuggcucaauaacaauacacaauuuugcaucaaggugcugaacccguauaugcccagcgucauugagaaaauggagacccuucagagaaaguacggaggcgcgcugguucgcaauccucucucccggaacucuacacacgaaauguacugggugagcaaugccaccgggaacaucguguccucugucaauaugaucagcagaaugcugauuaaccgcuucacgaugaagcacaaaaaggcuaccuaugagcccgauguggaccugggauccggcacacggaauaucggcauugagagcgaaaucccuaaccucgacauuaucgggaaaagaauugagaagaucaaacaggaacaugagaccucuuggcacuacgaucaggaccaucccuauaagacaugggccuaccacggauccuaugaaaccaagcaaacaggcagcgcuucuuccaugguuaacggggugguccgccuucugaccaaaccgugggaugugguuccuauggugacgcagauggccaugacagacaccacccccuuuggacagcagagagucuucaaggagaaaguggauacacggacgcaagagccuaaggaaggcaccaaaaagcugaugaagaucacagcugaguggcucuggaaagaacuggggaagaaaaagacaccccgcauguguacaagagaggaguuuacccggaaagugagaagcaaugccgcgcuuggagccauuuucacagacgaaaacaaguggaaaucugcucgggaggccgucgaagauucccgcuuuugggagcugaucgacagagaacggaaucuccaccuggagggcaagugcgagaccuguguuuacaacaugaugggcaagcgcgagaaaaagcugggggaguucggaaaagcuaagggcagcagagccauuugguauauguggcucggggcccgguuucuggaguucgaggcgcuuggauuucugaaugaagaucauugguucucccgcggcaacagccucucugggguggagggcgagggacugcacagacuuggcuacauccugcgggacgugagcaaaaaggaagggggagcuauguacgccgaugacacggccggcugggacacccgcauuacacucgaggaucugaagaaugaagagauggucaccaaccauaugaaaggggaacacaagaaacuggcugaggccaucuuuaagcucacauaucagaauaaagugguuagagugcagcggccuacaccccgcggaacggucauggacaucauuuccagacgggaucagcgcggcucugggcaagugggcacauacggacugaacaccuucacaaauauggaggcucagcuuaucagacagauggaaggcgaggggauuuucaagagcauccaacaucugaccguuacggaagagauugccgugcagaacuggcucgcgcgggucggaagagagcgccugucccggauggccaucucuggcgacgauugcgugguuaagccgcuugacgauagauuugcuagcgcccugaccgcucucaaugacauggggaaagugcgcaaggauauccagcagugggaaccuucccggggauggaacgacuggacacaaguccccuucugcucucaccacuuucaugagcuggugaugaaagauggcagaguccuggugguucccugucgcaaucaggacgaacucauugggcgggccagaaucagccagggcgcgggauggucccugaaggagaccgccugccuuggcaaaagcuaugcucagauguggacacugauguacuuccaccgccgggaucucagacuggccgcuaacgccauuuguucugcugugccuucccauugggucccgaccagccgcacaaccuggucuauccacgccaagcacgaauggaugacgacagaggacaugcuugcgguguggaaccggguguggauucaagagaaucccuggauggaagacaagaccccuguugaguccugggaagaggugcccuaucuggggaaaagagaagaucaguggugcggaagccucaucggccugaccucccgggccacaugggcuaagaacauucagaccgccaucaaucaggucagaucucugaucgggaacgaggaguacacagacuauaugccuagcaugaaacgcuuucggagagaagaggaagaggccggagugcucugguga

SEQ ID NO: 19921 - RNA, 9876 nt, Artificial Sequence
  derived and/or modified CDS sequence (opt5) from DENV-2__EU482582__SS-prME
accgccggagugaucauuaugcugauccccacagcuauggccuuccaccucacgacccggaauggggagccucauaugauugucggacggcaggaaaagggcaagucccugcuuuuuaagaccgaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccaaccacuuucagagagcucugauuuucauccuucugacagccguggcgccuagcaugacgaugcggugcauuggcaucuccaaucgcgauuuugucgaaggggugucuggaggcagcuggguugacaucgugcucgagcacggguccugugucaccacaauggccaagaacaagcccacccuggauuucgaacuuauuaaaacagaggcuaagcagccugccacccugagaaaauauugcaucgaagcuaagcucacgaauacaaccaccgagagccgguguccgacacaaggagagcccucucugaacgaggaacaggacaaacgcuuugugugcaagcauuccaugguggauagaggcuggggcaauggguguggacuguucggcaaagggggaauugugacaugcgccauguuuacaugcaaaaagaacauggaaggcaaaguugugcucccugagaaucuggaauacacgaucgugauuacaccccacagcggggaggagcaugcggucggaaacgacacaggcaagcacggcaaagaaaucaagaucaccccucagucuuccauuacagaggccgaacuuaccggguauggaacggugaccauggaguguagcccccggacaggccuggauuucaaugaaaugguucuccugcagauggaggacaaggcuuggcuugugcaccgccaaugguuucuggaucucccgcugccuuggcugcccggggccgacacccagggaucuaacuggauccagaaggagacacucgucaccuucaagaauccucaugcuaaaaagcaggacgugguugugcugggcucccaagaaggggccaugcacacggcccuuacaggcgcuaccgagauucagaugagcuccggaaaccugcucuuuacaggccaucugaaaugcagacuucggauggauaagcugcagcucaaagggaugucuuacagcauguguaccggaaaguucaagaucgucaaagaaauugcggagacccaacacggcacaaucgugaucagaguccaguaugagggggacggaucccccugcaagauucccuucgaaaucauggaucuggagaaacgccaugugcugggccggcucauuacgguuaacccuaucgugaccgaaaaggacagcccggucaauauugaggccgaacccccuuuuggggauucuuacaucauuaucggcguggagcccggacagcugaaacuuaacugguucaagaagggcuccagcaucgggcagauguuugagacaaccaugagaggagcuaaacgcauggccauucugggcgacacagccugggauuucgggucucucggaggcguuuuuaccagcaucgggaaggcucugcaccaaguguucggcgccauuuacggagcggucuuuuccggcgugucuuggacgaugaaaauccugauuggggugaucaucacauggauuggaaugaauagccgguccaccagccuuucuguuucccucguccuggugggcguggucacccuguaucucggggcuauggugcaggccgacagcggauguguugugucuuggaaguccaaagaacugaagugcggcagcgggaucuucauuacagauaacguccacaccuggacagagcaguacaaguuucagccugaaucccccucuaaacuugccagcgcuauccaaaaggcccaugaggaaggcauuuguggaaucagauccgugacgcgccuggagaaucucauguggaaacagaucaccccggagcugaaccacauucugucugaaaaugagguuaaacuuacaaucaugaccggcgacauuaaagggaucaugcaggcuggaaagcggagccucagaccucagcccacagaacugaaauauuccuggaagaccuggggcaaggccaaaaugcugagcacggagucucauaaccaaaccuuccucauugaugggccugaaacagcggagugccccaauaccaaccgcgccuggaacucccuggagguggaagacuacggauuuggcgucuucacaaccaacaucuggcuuaagcugcgggagaaacaggacguguuuugugauagcaagcucaugucugcugccaucaaagacaauagagcuguucacgccgauaugggcuauuggauugaauccgcgcugaacgacacauggaagauggagaaggccagcuucaucgaggugaaaucuugccacuggccuaagagccauacccugugguccaaugggguccuugaaagcgagaugauuauccccaaaaacuucgcuggaccggugucucagcacaacuaccgcccuggcuaucauacgcagacagccgggcccuggcaccucggaaagcuggaaauggauuuugacuucugugagggcaccaccguggucguuacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucgucaauucucuggugaccgccggccaugggcaaauugauaacuuuagccugggaguccuuggcauggcccucuuccuggaagagaugcugagaacacgcguggggaccaaacacgcuauccuccugguugcgguguccuuugucacgcuuaucaccggaaauaugucuuuccgggaccugggcagagugaugguuauggugggcgccacaaugaccgaugacauugggaugggagucacauaucucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauucuggagcucaccgaugcccuggcccugggaaugaugguucuuaaaaucgugcggaacauggaaaaguaccagcuggcugucaccaucauggccauuagcugcgugccuaaugcggugauccuccaaaacgcuuggaaggucuccuguacaauucuggccgccguuagcgugucuccccuccugcuuacguccagccagcagaaagcugacuggaucccucuggcccucaccauuaagggccugaaucccacagcuaucuuucugaccacacuuucucgcaccuccaaaaagagaagcuggccgcugaacgaggccaucauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacaaacacugaccauccucaucagaacagggcugcucgugauuucuggaguuuuccccgugagcaucccgauuacggcugcggccugguaccugugggaggucaagaagcagcgggcuggcgugcuuugggaugucccuucucccccucccguggggaaagccgaacuggaggacggagccuaucgcaucaagcagagaggcauucugggcuacagccagaucggggcuggaguuuauaaagaaggcaccuuucacacaauguggcaugugaccagaggggccguccucaugcaccgcggaaagagaaucgagcccagcugggcggaugugaaaaaggaccugauuuccuacggcgggggauggaaacuugagggcgaauggaaagagggcgaagagguucaagugcuggcucucgaaccugggaagaauccgcgggccguccagacaaaacccggacuguucaagaccaacacgggcaccaucggggccgugagccucgauuuuucuccuggaacauccggcagccccauuguggacagaaaagggaagguugucggacuguacggcaauggcguggugacccgcucuggggcuuaugucuccgccaucgcgcagacagaaaagagcauugaggauaacccugaaaucgaggacgauaucuuccggaaaaagagacuuaccauuauggaccugcaucccggagcuggcaaaacaaagcgcuaccugccugccaucgugcgggaagccauuaaaagagggcuccgcacgcugauccuugcuccgacccggguuguggccgcugagauggaagaggcccugagaggacuccccauucgcuaucagaccccugcgauccgggccgagcacaccggcagagaaauugucgaccugaugugucaugcuaccuucacaaugcggcuccugucccccgugcgcguuccuaacuacaaucuuaucaucauggaugaggcccacuuuacggaccccgcuucuauugccgccagaggguauaucagcacccggguggaaaugggcgaggcugcgggaauuuucaugacagccaccccgccuggcucccgcgaucccuuuccccaaagcaacgcuccuaucauggacgaggaaagagagauucccgaacggucuuggaacuccgggcacgagugggucacagauuucaagggaaagaccgugugguuuguuccuagcaucaaagccggcaacgacaucgccgcuugccugagaaagaaugggaaaaaggugauucagcugucucgcaaaacguucgauagcgaauacgucaagacacgggccaacgacugggauuuuguggugaccaccgacaucuccgagaugggagcgaauuucaaggcugagagagucauugauccgcgccgguguaugaaacccguuauccucacagacggcgaagagagagugauucuggccgggccuaugcccgugacccauucuagcgccgcucagcgccggggcagaaucggacgcaacccuaagaaugaaaacgaccaauauaucuacaugggcgagccccuugaaaaugaugaggacugcgcccacuggaaagaggcgaagaugcugcucgauaacauuaauacaccggaagggaucauuccuuccauguuugagcccgaaagagagaaagucgacgccaucgauggagaauaccggcugcgcggcgaggcuagaaagaccuucguggaccugaugcggcgcggggaucucccuguuuggcuugccuauagaguggcugccgagggaauuaacuacgcugaccggagaugguguuuugauggcaucaaaaauaaccagauucuggaagagaacgucgaaguggagaucuggacgaaggagggggaacgcaagaaacugaagccccgguggcucgacgccagaaucuauucugauccucuggcgcuuaaagaguucaaggaguucgccgcuggccgcaaaagccugacacucaaucugauuaccgagaugggacggcugcccacauuuaugacccagaaggccagagacgcucucgauaaccuugccguucugcauacggccgaagcuggcgggcgggcguacaaucacgcccuguccgagcucccggagacccuggaaacacuucugcuccugacccugcucgcuacagugaccggaggcaucuuccuuuuucugaugagcgggaagggaauuggcaaaaugacacugggcaugugcugcaucauuaccgccucuauccuccugugguaugcccagauccaaccucacuggauugcugccuccaucauucuugaguucuuucugaucguccuccugauucccgaacccgagaagcagcgcacgccucaggacaaccagcugacauacguggucaucgcgauccucaccgugguugccgcuaccauggccaaugaaaugggguuccuugagaaaacaaagaaagaccugggacugggcagcaccacaacgcaagaguccgaaucuaacauucucgauaucgaccugagaccggcuagcgccuggacccuuuaugcgguggccacaaccuuugugacacccaugcugcggcauuccauugaaaauucuagcgucaacguuucccucaccgcuaucgccaaucaggcuacggugcugauggggcugggaaagggcuggccucucagcaagauggauauuggggugccccuucuggccaucggauguuacucucaggucaacccuauuacccugacagcugcccuccugcuucugguggcgcacuacgccaucaucggccccggccuccaggcuaaagccacccgcgaagcucaaaagagagccgccgcggggauuaugaaaaauccuacaguugacggaaucaccgugauugaucuggagccgauccccuaugacccuaaguucgaaaaacagcugggccaggucaugcuccuuauucugugcgugacgcagguccugaugaugcggacaaccugggcucucugugaggcccugacacuugcuaccgggcccaucuccacccugugggagggaaacccuggccgcuuuuggaauacaacgaucgccgugagcauggccaacauuuucagagggucuuaccucgcuggagccggccugcuguuuuccaucaugaagaauaccacaaacacccggcgcggcacagggaauauuggagaaacccucggcgagaaguggaaaagcagacuuaacgcgcuggggaagucugaguuccaaaucuauaaaaagagcggcauucaggagguugaucggacgcuggccaaagagggcaucaagagaggggaaacagaccaucacgcugugucccgcggaucugccaaacuccggugguuugucgagagaaacauggugacccccgaaggcaagguuguggaucugggcugcgggcgcggaggcuggagcuacuauugugggggacuuaagaauguccgggaggugaaaggccugaccaaagggggaccgggccaugaagaaccuauccccauguccacauacggcuggaaccucgugagacugcagagcgggguugacgucuucuucacacccccugagaaaugcgauacacugcucugugacauuggagaauccucucccaauccuacgaucgaggcuggccgcacccuucgggugcugaaccugguggaaaauuggcucaacaauaacacacaauuuugcauuaagguccugaauccguauaugcccagcguuaucgagaaaauggaaacccuucagagaaaguacgggggagcccuggugcgcaacccucucuccagaaauucuacacacgagauguacugggugagcaacgcgaccggcaauauugucuccacggugaacaugaucucuagaaugcugaucaaucgcuucaccaugaagcacaaaaaggccacauaugagcccgauguugaccuggggagcggaacccggaacauuggcaucgaauccgagauuccuaaccucgacaucauuggcaaaagaaucgaaaagauuaaacaggagcaugaaacaagcuggcacuacgaucaggaccaucccuauaagaccugggcuuaccacgggucuuaugagacaaagcaaaccggauccgccagcucuauggugaauggcgucgugcgccuucugacgaaaccgugggauguugugccuauggucacacagauggcuaugaccgacaccacacccuuugggcagcagagaguguucaaggagaaaguggauacgcggacccaagaaccuaaggagggaaccaagaagcugaugaagaucaccgccgaauggcucuggaaagagcugggcaagaaaaagacaccccgcauguguaccagagaggaauuuacacggaaagucagauccaacgcugcccuuggggcgaucuucaccgacgagaauaaguggaaaagcgcccgggaagcuguugaggauucucgcuuuugggaacugauugacagagagcggaaccuccaccuggagggaaagugcgaaacguguguguacaauaugaugggcaagcgcgagaaaaagcugggcgaguucgggaaagccaagggauccagagcuaucugguauauguggcucggcgcccgguuucuggaguucgaagcccuuggguuucugaacgaggaucauugguucagccgcggaaauucccucagcggcguggagggggaaggccugcacagacuuggauacauucugcgggacgucucuaaaaaggagggcggggcgauguacgcugaugacaccgccggaugggacacacgcaucacccucgaagaucugaagaacgaggaaauggugacaaaucauaugaaaggcgagcacaagaaacuggccgaggcuauuuuuaagcucaccuaucagaacaaaguugugagaguccagcggccuacgccccgcgggacagugauggacaucaucagcagacgggaucagcgcggauccggccaaguugggaccuacggccugaauacauucaccaacauggaagcccagcuuauuagacagauggagggagaaggcaucuucaagucuauucaacaucugacggugaccgaggagaucgcuguccagaauuggcucgcccggguggggagagaacgccugagccggauggcgauuuccggagacgauugcguugugaagccgcuugacgauagauuugccucugcucugacagcccucaacgacaugggcaaaguccgcaaggauauccagcagugggagccuagccggggguggaaugacuggacccaagugcccuucugcucccaccacuuucaugaacuggucaugaaagauggaagagugcugguugugcccugucgcaaccaggacgagcucaucggccgggcuagaauuucucagggggccggcuggagccugaaggaaacagcgugccuuggaaaauccuaugcccagauguggacccugauguacuuccaccgccgggaucucagacuggcugccaacgcuaucuguagcgccgucccuucucauugggugccgacaucccgcaccacguggagcauucacgcuaagcacgaguggaugacaaccgaggacaugcuugccguguggaaucggguuuggauccaagaaaaccccuggauggaggacaagaccccuguggaaucuugggaggaaguccccuaucugggcaaaagagaggaucaguggugcgggucccucauuggacugacaagccgggcgaccugggccaagaauauccagacagcuauuaaccaggugagaucccugaucggcaaugaggaauacacggacuauaugccuucuaugaaacgcuuucggagagaggaagaggaagccgggguucucugguga

SEQ ID NO: 19922 - RNA, 9876 nt, Artificial Sequence
  derived and/or modified CDS sequence (opt5) from DENV-2__EU482583__SS-prME
accgccggcgugaucauuaugcugauccccaccgcuauggccuuccaccucacgacccggaauggggaaccucauaugauugucggacggcaggaaaagggcaagagccugcuuuuuaagaccgaggacgggguuaauaugugcacccugauggcgaucgaucucggagaacugugugaggacaccauuaccuacaagugcccgcuucugcgccaaaaugaacccgaggauaucgacuguuggugcaauagcacgucuaccugggugacguauggcaccuguacaaccacaggggagcacagacgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugacacuguaucucggggccaugguccaggccgacagcggaugugugguuucuuggaagaauaaagaacugaagugcggcuccgggaucuucauuaccgauaacgugcacacauggacggagcaguacaaguuucagccugaaagccccuccaaacuugcuucugccauccaaaaggcucaugaggaaggcauuuguggaaucagaagcgucacccgccuggagaaucucauguggaaacagaucacaccggagcugaaccacauucuguccgaaaaugaggugaaacuuaccaucaugacaggcgacauuaaagggaucaugcaggccggaaagcggucucucagaccucagcccaccgaacugaaauauagcuggaagacguggggcaaggcgaaaaugcuguccaccgagagccauaaccaaacauuccucauugaugggccugaaaccgccgagugccccaauacaaaccgcgcuuggaacucucuggagguugaagacuacggauuuggcguguucaccacaaacaucuggcuuaagcugcgggagaaacaggacgucuuuugugauuccaagcucaugagcgccgcuaucaaagacaauagagccgugcacgcggauaugggcuauuggauugaaucugcccugaacgacaccuggaagauggagaaggcuuccuucaucgagguuaaaagcugccacuggccuaagucucauacgcuguggagcaauggggugcuugaauccgagaugauuauccccaaaaacuucgccggaccggucagccagcacaacuaccgcccuggcuaucauacacagaccgcugggcccuggcaccucggaaagcuggaaauggauuuugacuucugugagggcaccacagugguggucaccgaagauugcgggaaucggggacccucucugagaacgacaaccgccuccggcaaacucauuacagaguggugcugucggagcugcacccugccuccgcuucgcuacagaggcgaggacggguguugguacggaauggaaauccggccccugaaggagaaggaagagaaccucguuaauucccuggugacagccggccaugggcaaauugauaacuuuucucugggagugcuuggcauggcucucuuccuggaagagaugcugagaacccgcgucgggacgaaacacgcgauccuccugguggccguuagcuuugugacccuuaucacaggaaauauguccuuccgggaccugggcagagucauggugaugguuggcgcuaccaugacagaugacauugggaugggagugaccuaucucgcccugcuggccgcuuuuaagguccgcccuacguucgccgcgggccuucugcucagaaaacugacaucuaaggagcucaugauggcuaccaucgggauugcccugcuuagccaguccacaauccccgaaaccauucuggagcucaccgaugcccuggcucugggaaugauggugcuuaaaaucguucggaacauggaaaaguaccagcuggccgugacaaucauggcgauuucuugcgucccuaaugcugugauccuccaaaacgccuggaaggugagcuguacgauucuggccgcugucuccguuagcccccuccugcuuaccucuucccagcagaaagccgacuggaucccucuggcucucacaauuaagggccugaaucccaccgccaucuuucugacaacccuuagccgcacgucuaaaaagagauccuggccgcugaacgaggcgaucauggccguggggauggugagcauucucgcuucuucccugcucaaaaaugacaucccuaugacaggaccccuggucgccggcggccuucugaccgugugcuauguucugaccgggcggagcgcugaucucgaacuggagcgcgccgccgacgugaagugggaggaucaggcugaaauuuccggaagcucuccuauccuuagcauuacaaucuccgaggacggcucuaugagcauuaaaaacgaagaggaggaacaaacccugacaauccucaucagaacggggcugcucgucauuuccggaguguuccccguuucuaucccgauuaccgcggccgcuugguaccugugggaggugaagaagcagcgggccggcguccuuugggaugugccuucucccccucccgucgggaaagccgaacuggaggacggagcuuaucgcaucaagcagagaggcauucugggcuacucccagaucggggccggaguguauaaagaaggcacauuucacaccauguggcauguuacaagaggggcggugcucaugcaccgcggaaagagaaucgagcccuccugggcugaugucaaaaaggaccugauuagcuacggcgggggauggaaacuugagggcgaauggaaagagggcgaagaggugcaaguucuggcccucgaaccugggaagaauccgcgggccgugcagaccaaacccggacuguucaagacgaacaccggcacaaucggggcugucucccucgauuuuagcccuggaaccucuggcucccccauuguggacagaaaagggaaggugguuggacuguacggcaauggcgucgugacacgcagcggggccuaugugucugcgaucgcucagaccgagaaguccauugaggauaacccugaaaucgaggacgauaucuuccggaaaaagagacuuacaauuauggaccugcaucccggagccggcaaaacgaagcgcuaccugccugccaucguccgggaagcuauuaaaagagggcuccgcacccugauccuugccccgacacgggugguugcugccgagauggaagaggcgcugagaggacuccccauucgcuaucagaccccugccauccgggcugagcacaccggcagagaaauuguggaccugaugugucaugccacauucacgaugcggcuccugagccccguccgcgugccuaacuacaaucuuaucaucauggaugaggcucacuuuaccgaccccgccuccauugccgcuagaggguauaucucuacacggguugaaaugggcgaggcggccggaauuuucaugaccgcuacaccgccuggcagccgcgaucccuuuccccaauccaacgccccuaucauggacgaggaaagagagauucccgaacggagcuggaacucugggcacgagugggugaccgauuucaagggaaagacggucugguuugugccuuccaucaaagccggcaacgacaucgcugccugccugagaaagaaugggaaaaagguuauucagcugagccgcaaaacauucgaugcggaauacgugaagacccgggcuaacgacugggauuuugucgugaccacagacaucucugagaugggagccaauuucaaggccgagagagugauugauccgcgccgguguaugaaacccgucauccucaccgacggcgaagagagaguuauucuggcugggccuaugcccgugacacauagcuccgccgcgcagcgccggggcagaaucggacgcaacccuaagaaugaaaacgaccaauauaucuacaugggcgagccccuugaaaaugaugaggacugcgcccacuggaaagaggcuaagaugcugcucgauaacauuaauaccccggaagggaucauuccuucuauguuugagcccgaaagagagaaaguggacgccaucgauggagaauaccggcugcgcggcgaggcuagaaagacguucgucgaccugaugcggcgcggggaucucccuguguggcuugccuauagaguugcugccgagggaauuaacuacgcggaccggagaugguguuuugauggcaucaaaaauaaccagauucuggaagagaacguggaagucgagaucuggacaaaggagggggaacgcaagaaacugaagccccgguggcucgacgccagaaucuauagcgauccucuggcucuuaaagaguucaaggaguucgccgcuggccgcaaaucccugacccucaaucugauuacagagaugggacggcugcccaccuuuaugacgcagaaggccagagacgcccucgauaaccuugcugugcugcauaccgcggaagccggcgggcgggcuuacaaucacgcccugucugagcucccggagacacuggaaacccuucugcuccugacacugcucgccaccguuacaggaggcaucuuccuuuuucugaugagcgggaagggaauuggcaaaaugacccugggcaugugcugcaucauuacggcuuccauccuccugugguaugcccagauccaaccucacuggauugcggccagcaucauucuugaguucuuucugaucgugcuccugauucccgaacccgagaagcagcgcacaccucaggacaaccagcugaccuacgucgugaucgcuauccucaccgucguggccgcuacaauggccaaugaaaugggguuccuugagaaaaccaagaaagaccugggacugggcucuauuacaacgcaagaguccgaaagcaacauccucgauauugaccugagaccggcguccgccuggacccuuuaugcuguugccacaaccuuugugacacccaugcugcggcauucuaucgagaauagcuccgugaacgucucucucaccgcuauugccaaucaggcuacgguucugauggggcugggaaagggcuggccucucagcaagauggauaucggggugccccuucuggccauuggauguuacucccaggugaacccuaucacccugacagcggcccuccugcuucuggucgcucacuacgccaucauuggccccggccuccaggcuaaagccacccgcgaagcccaaaagagagcggcugccgggaucaugaaaaauccuacaguggacggaauuaccguuaucgaucuggagccgauucccuaugacccuaaguucgaaaaacagcugggccaggugaugcuccuuauccugugcgucacacaggugcugaugaugcggacaaccugggcucucugugaggcccugacacuugccaccgggcccaucagcacccugugggagggaaacccuggccgcuuuuggaauacaacgauugcugucucuauggccaacaucuucagaggguccuaccucgcgggagccggccugcuguuuagcauuaugaagaauaccacaaacacccggcgcggcacagggaauaucggagaaacccucggcgagaaguggaaaucuagacuuaacgcucuggggaaguccgaguuccaaauuuauaaaaagagcggaauccaggagguggaucggacgcuggccaaagagggcaucaagagaggggaaacagaccaucacgcuguuucucgcggaagcgccaaacuccggugguuuguggagagaaacauggucacccccgaaggcaaggugguugaucugggcugcgggcgcggaggcugguccuacuauugugggggacuuaagaaugugcgggaggucaaaggccugaccaaagggggaccgggccaugaagaaccuauucccaugucuacauacggcuggaaccucgugagacugcagagcgggguggacguuuucuucacacccccugagaaaugcgauacacugcucugugacaucggagaauccagccccaauccuacgauugaggcgggccgcacccuucggguccugaaccugguggaaaauuggcucaacaauaacacacaauuuugcaucaaggugcugaauccguauaugcccuccgucauugagaaaauggaaacccuucagagaaaguacgggggagcccugguucgcaacccucucucucggaauagcacacacgagauguacuggguguccaacgcuaccggcaauaucgugucuagcgucaacaugaucuccagaaugcugauuaaucgcuucacgaugaagcacaaaaaggccaccuaugagcccgauguggaccuggggucuggaacacggaacaucggcauugaaagcgagaucccuaaccucgacauuaucggcaaaagaauugaaaagaucaaacaggagcaugaaaccuccuggcacuacgaucaggaccaucccuauaagacaugggcuuaccacgggagcuaugagaccaagcaaacaggaucugccuccagcaugguuaauggcgugguccgccuucugaccaaaccgugggaugugguuccuauggugacgcagauggcuaugacagacaccacccccuuugggcagcagagagucuucaaggagaaaguggauacacggacgcaagaaccuaaggagggaaccaaaaagcugaugaagaucacagccgaauggcucuggaaagagcugggcaagaaaaagacaccccgcauguguacaagagaggaauuuacccggaaagugagaucuaacgcggcccuuggggcuauuuucacagacgagaauaaguggaaauccgcccgggaagcugucgaggauagccgcuuuugggaacugaucgacagagagcggaaccuccaccuggagggaaagugcgaaaccuguguuuacaauaugaugggcaagcgcgagaaaaagcugggcgaguucgggaaagccaagggaucuagagccauuugguauauguggcucggcgcgcgguuucuggaguucgaagcucuuggguuucugaacgaggaucauugguucucccgcggaaauagccucuccggcguggagggggaaggccugcacagacuuggauacauccugcgggacgugagcaaaaaggagggcggggccauguacgccgaugacacggcuggaugggacacccgcauuacacucgaagaucugaagaacgaggaaauggucaccaaucauaugaaaggcgagcacaagaaacuggccgaggcuaucuuuaagcucacauaucagaacaaagugguuagagugcagcggccuacaccccgcgggacggucauggacaucauuucuagacgggaucagcgcggaagcggccaaguggggacauacggccugaauaccuucacaaacauggaagcccagcuuaucagacagauggagggagaaggcauuuucaaguccauccaacaucugaccguuacggaggagauugcggugcagaauuggcucgcccgggucgggagagaacgccugucucggauggcuaucagcggagacgauugcgugguuaagccgcuugacgauagauuugccuccgcucugaccgcccucaacgacaugggcaaagugcgcaaggauauccagcagugggagccuucucggggguggaaugacuggacacaaguccccuucugcagccaccacuuucaugaacuggugaugaaagauggaagaguccuggugguucccugucgcaaccaggacgagcucauuggccgggcgagaaucucccagggggccggcuggucucugaaggaaaccgcuugccuuggaaaaagcuaugcccagauguggacacugauguacuuccaccgccgggaucucagacuggcugccaacgcuauuuguuccgccgugccuagccauugggucccgaccucucgcacaaccugguccauccacgcgaagcacgaguggaugacgacagaggacaugcuugccguguggaaucggguguggauucaagaaaaccccuggauggaggacaagaccccuguugaaagcugggaggaagugcccuaucugggcaaaagagaggaucaguggugcgggucucucaucggacugaccucccgggcuacaugggccaagaauauucagaccgccaucaaccaggucagaagccugaucggcaaugaggaauacacagacuauaugccuuccaugaaacgcuuucggagagaggaagaggaagcuggggugcucugguga

SEQ ID NO: 19923 - RNA, 9876 nt, Artificial Sequence
  derived and/or modified CDS sequence (opt5) from DENV-2__EU482585__SS-prME
accgcgggagugaucauuaugcugauccccaccgcuauugccuuccaccucacgaccagaaacggggagccucauaugaucgucggacggcaggaaaagggcaagucccugcuuuuuaagaccgaggacgggguuaauaugugcacccugauggcgauugaucucggagaacugugugaggacaccaucaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggauugagaccuggauccugcgccaucccggguucacaauuauggccgcuauccucgccuacaccauuggaaccacacacuuucagagagcucugaucuucauucuucugacggccguggcgccuagcaugaccaugcggugcaucggcaucuccaaccgcgauuuugucgaaggggugucuggaggcagcuggguugacauugugcucgagcacggguccugugucacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuugugugcaagcauuccaugguggauagaggcuggggcaacggguguggacuguucggcaaagggggaaucgucacaugcgccauguuuacgugcaaaaagaauauggaaggcaaaguugugcucccugagaaccuggaauacaccauugugaucacaccccacagcggggaggagcaugcggucggaaaugacaccggcaagcacggcaaagaaaucaagauuacaccucagucuuccaucaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauucagaaggagacccucgucacguucaagaacccucaugcuaaaaagcaggacgugguugugcugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugucaaagaaaucgcggagacacaacacggcacgaucgugauuagaguccaguaugagggggacggaucccccugcaagauccccuucgaaauuauggaucuggagaaacgccaugugcugggccggcucaucaccguuaacccuauugugacagaaaaggacagcccggucaacaucgaggccgaacccccuuuuggggauucuuacauuaucaucggcguggagcccggacagcugaaacuuaauugguucaagaagggcuccagcauugggcagauguuugagaccacaaugagaggagcuaaacgcauggccauccugggcgacaccgccugggauuucgggucucucggaggcguuuuuacgagcauugggaaggcucugcaccaaguguucggcgccaucuacggagcggcuuuuuccggcgucucuuggacaaugaaaauucugaucggggugaucauuaccuggaucggaaugaacagccgguccaccagccuuucugugucccucguucuggucggcguggugacacuguaucucggggccaugguccaggccgacagcggaugugugguuucuuggaaguccaaagaacugaagugcggcagcgggauuuucaucaccgauaaugugcacacauggacggagcaguacaaguuucagccugaaucccccucuaaacuugcuagcgccauucaaaaggcucaugaggaaggcaucuguggaaucagauccgucacccgccuggagaaccucauguggaaacagauuacaccggagcugaaucacauccugucugaaaacgaggugaaacuuaccauuaugacaggcgggaucaaaggaauuaugcaggccggcaagcggagccucagaccucagcccaccgaacugaaauauuccuggaagacgugggggaaggcgaaaaugcugagcaccgagucucauaaucaaacauuccucaucgacggaccugaaaccgccgagugccccaacacaaaucgcgcuuggaacucccuggagguugaagauuacggcuuuggcguguucaccacaaauaucuggcuuaagcugcgggagaaacaggacgucuuuugugacagcaagcucaugucugccgcuauuaaagauaacagagccgugcacgcggacaugggguauuggaucgaauccgcccugaaugauaccuggaagauggagaaggcuagcuucauugagguuaaaucuugccacuggccuaagagccauacgcugugguccaacggagugcuugaaagcgagauggucauccccaaaaauuucgccggcccggugucucagcacaacuaccgcccuggguaucauacacagaccgcuggacccuggcaccucggcaagcuggaaauggacuuugauuucugugaggggaccacaguggucguuaccgaagacugcggaaaccggggccccucccugagaacgacaaccgccagcggcaaacucauuacagaguggugcugucgguccugcacccugccuccgcuucgcuacagaggggaggauggauguugguacggcauggaaauccggccccugaaggagaaggaagagaaucucgugaacucucuggugacagccgggcauggacaaauugacaauuuuagccugggcguccuugggauggcucucuuccuggaagagaugcugagaacccgcgugggaacgaaacacgcgauccuccugguugccguguccuuugucacccuuaucacaggcaacaugucuuuccgggaucugggcagagugaugguuauggugggggcuaccaugacagacgauauuggaaugggcgucaccuaucucgcccugcuggccgcuuuuaaggugcgcccuacguucgccgcggggcuucugcucagaaaacugacaagcaaggagcucaugauggcuaccaucggaauugcccugcuuucccagucuacaauccccgaaaccauucuggagcucaccgacgcccuggcucugggcaugaugguucuuaaaaucgugcggaauauggaaaaguaccagcuggccgucacaaucauggcgauuagcugcgugccuaacgcugugauccuccaaaaugccuggaaggucuccuguacgauucuggccgcuguuagcgugucuccccuccugcuuaccuccagccagcagaaagccgauuggaucccucuggcucucacaauuaaggggcugaaccccaccgccaucuuucugacaacccuuucucgcacguccaaaaagagaagcuggccgcugaaugaggcgaucauggccgugggaauggucucuauucucgcuuccagccugcucaaaaacgacaucccuaugacaggcccccugguggccggcgggcuucugaccguuugcuaugugcugaccggacgguccgcugaccucgaacuggagcgcgccgccgaugucaagugggaggaccaggcugaaauuagcggcucuagcccuauccuuuccauuacaaucucugaggaugggagcauguccauuaaaaaugaagaggaggaacaaacccugacaauccucaucagaacgggacugcucgugauuucuggcguuuuccccgugagcaucccgauuaccgcggccgcuugguaccugugggaggucaagaagcagcgggccggggugcuuugggacgucccuucucccccucccgugggaaaagccgaacuggaggauggcgcuuaucgcaucaagcagagaggcauucugggguacagccagaucggagccggcguuuauaaagaagggacauuucacaccauguggcaugugacacggggagcgguccucaugcaccgcggcaagagaaucgagcccagcugggcugacgugaaaaaggaucugauuuccuacgggggaggcuggaaacuugagggcgaauggaaagagggggaagagguucaagugcuggcccucgaaccuggaaagaacccgcgggccguccagaccaaacccggccuguucaagacgaauaccgggacaaucggagcugugagccucgacuuuucuccuggcaccuccgggagccccauuguggauagaaaaggaaagguugucggccuguacggcaacgggguggugacacgcucuggagccuaugucuccgcgaucgcucagaccgaaaagagcauugaggacaauccugaaaucgaggaugacaucuuccggaaaaagagacuuacaauuauggaucugcaucccggcgccgggaaaacgaagcgcuaccugccugccaucgugcgggaagcuauuaaaagaggacuccgcacccugauccuugccccgacacggguuguggcugccgagauggaagaggcgcugagaggccuccccauucgcuaucagaccccugccauccgggcugagcacaccgggagagaaauugucgaccugaugugucaugccacauucacgaugcggcuccugucccccgugcgcguuccuaacuacaaccuuaucaucauggacgaggcucacuuuaccgaucccgccucuauugccgcuagaggcuauaucagcacacggguggaaaugggagaggcggccggcauuuucaugaccgcuacaccgccugggucccgcgaccccuuuccccaaagcaaugccccuaucauggaugaggaaagagagauucccgaacggucuuggaacuccggacacgagugggucaccgacuucaagggcaagacggugugguuuguuccuagcaucaaagccgggaaugauaucgcugccugccugagaaagaacggcaagaaggugauucagcugucucgcaaaacauucgacagcgaauacgucaagacccgggcgaaugauugggacuuuguggugaccacagauaucuccgagaugggcgcuaacuucaaggccgagagagucauugacccgcgccgguguaugaaacccguuauccucaccgauggggaagagagagugauucuggccggcccuaugcccgugacacauucuagcgcugcccagcgccggggaagaaucggccgcaauccuaagaacgaaaaugaccaauauaucuacaugggggagccccuugaaaacgacgaggauugcgcgcacuggaaagaggccaagaugcugcucgacaauauuaacaccccggaaggaaucauuccuuccauguuugagcccgaaagagagaaagucgaugcuaucgacggcgaauaccggcugcgcggggaggccagaaagacguucguggaucugaugcggcgcggagaccucccuguuuggcuugcuuauagaguggccgcugagggcauuaauuacgccgaucggagaugguguuuugacgggaucaaaaacaaucagauucuggaagagaacgucgaaguggagaucuggacaaaggagggcgaacgcaagaaacugaagccccgguggcucgaugcgagaaucuauucugacccucuggcccuuaaagaguucaaggaguucgcugccggacgcaaaagccugacccucaaccugauuacagagaugggccggcugcccaccuuuaugacgcagaaggcuagagaugcccucgacaaucuugccguucugcauaccgcugaagccgggggacgggccuacaaccacgcucuguccgagcucccggagacacuggaaacccuucugcuccugacacugcucgccaccgugacaggcgggaucuuccuuuuucugaugagcggaaagggcauuggcaaaaugacccuggggaugugcugcaucauuacggccucuauccuccugugguaugcucagauccaaccucacuggauugccgcguccaucauucuugaguucuuucugaucguccuccugauucccgaacccgagaagcagcgcacaccucaggauaaucagcugaccuacguggucaucgccauccucaccgugguugcugccacaauggcuaacgaaaugggauuccuugagaaaaccaagaaagaccugggccuggggagcauuacaacgcaagaguccgaaucuaauauccucgacauugaucugagaccggccagcgcguggacccuuuaugccguggcuacaaccuuugugacacccaugcugcggcauuccaucgagaacucuagcgucaauguuucccucaccgccauugcuaaccaggccacggugcugaugggacugggcaagggguggccucucagcaagauggacaucggagugccccuucuggcuauuggcuguuacucucaggucaauccuaucacccugacagccgcgcuccugcuucugguggcccacuacgcuaucauuggccccgggcuccaggccaaagcuacccgcgaagcccaaaagagagccgcggcuggaaucaugaaaaacccuacaguugauggcauuaccgugaucgaccuggagccgauucccuaugauccuaaguucgaaaaacagcuggggcaggucaugcuccuuauccugugcgugacgcagguccugaugaugcggacaaccugggcccucugugaggcucugacacuugccaccggacccaucuccacccugugggagggcaauccugggcgcuuuuggaacacaacgauugccgugagcauggcuaauaucuucagaggaucuuaccucgccggcgcgggccugcuguuuuccauuaugaagaacaccacaaauacccggcgcgggacaggaaacaucggcgaaacccucggggagaaguggaaaagcagacuuaaugcccugggaaagucugaguuccaaauuuauaaaaagagcggcauccaggagguugaccggacgcuggcuaaagaggggaucaagagaggagaaacagaucaucacgccgugucccgcggcucugcuaaacuccggugguuugucgagagaaacauggugacccccgaaggcaagguuguggaccuggggugcggacgcggcggguggagcuacuauuguggaggccuuaagaacguccgggaggugaaagggcugaccaagggaggcccgggccaugaagaaccuauucccauguccacauacggguggaaucucgugagacugcagagcggaguugaugucuucuucacacccccugagaaaugcgacacacugcucugugauaucggcgaauccucucccaacccuacgauugaggccgggcgcacccuucgggugcugaaucugguggaaaacuggcucaauagcaacacacaauuuugcaucaagguccugaauccguauaugcccuccguuauugagaaaauggaaacccuucagagaaaguacggaggcgcgcuggugcgcaacccucucucucggaauagcacacacgagauguacuggguguccaacgccaccgggaauaucgucucuagcgugaacaugaucuccagaaugcugauuaaucgcuucacgaugaagcacaaaaaggcuaccuaugagcccgacguugaucugggaagcggcacacggaacaucggcauugaaucugagaucccuaaucucgacauuaucgggaaaagaauugaaaagaucaaacaggagcaugaaaccuccuggcacuacgaccaggaucaucccuauaagacaugggccuaccacggaagcuaugagaccaagcaaacaggcucugcuuccagcauggugaacggggucgugcgccuucugaccaaaccgugggacguugugccuauggucacgcagauggccaugacagauaccacccccuuuggacagcagagaguguucaaggagaaaguggacacacggacgcaagaaccuaaggagggcaccaaaaagcugaugaagaucacagcugaauggcucuggaaagagcuggggaagaaaaagacaccccgcauguguacaagagaggaauuuacccggaaagucagaucuaacgccgcgcuuggagccauuuucacagaugagaauaaguggaaauccgcucgggaagccguugaggacagccgcuuuugggaacugaucgauagagagcggaaccuccaccuggagggcaagugcgaaaccuguguguacaauaugaugggcaagcgcgagaaaaagcugggggaguucggaaaagcuaagggcuccagagccauuugguauauguggcucggggcccgguuucuggaguucgaagcgcuuggauuucugaacgaggaccauugguucagccgcggcaauucucucagcgggguggagggcgaaggacugcacagacuuggcuacauccugcgggaugucuccaaaaaggaagggggagcuauguacgccgacgauacggccggcugggacacccgcauuacacucgaagaccugaagaacgaggaaauggugaccaaucauaugaaaggggagcacaagaaacuggcugaggccaucuuuaagcucacauaucagaacaaaguugugagaguccagcggccuacaccccgcggaacggugauggauaucauuucuagacgggaccagcgcggcagcgggcaaguuggcacauacggacugaauaccuucacaaacauggaagcucagcuuaucagacagauggagggcgaagggauuuucaaguccauccaacaucugaccgugacggaggagauugccguccagaauuggcucgcgcgggugggaagagaacgccugucucggauggccaucagcggcgaugacugcguugugaagccgcuugaugacagauuugcuuccgcccugaccgcucucaacgauauggggaaaguccgcaaggacauccagcagugggagccuucucggggauggaaugauuggacacaagugcccuucugcagccaccacuuucaugaacuggucaugaaagacggcagagugcugguugugcccugucgcaaccaggaugagcucauugggcgggccagaaucucccagggcgcgggauggagccugaaggaaaccgccugccuuggcaaaucuuaugcucagauguggacacugauguacuuccaccgccgggaccucagacuggccgcuaaugccauuuguuccgcugucccuagccauugggugccgaccucucgcacaaccugguccauccacgccaagcacgaguggaugacgacagaggauaugcuugcgguguggaaccggguuuggauucaagaaaaccccuggauggaggacaagaccccuguggaaagcugggaggaaauccccuaucuggggaaaagagaggaccaguggugcggaucccucauuggccugaccucucgggccacaugggcuaagaauauccagaccgccaucaaccaggucagaagccugauugggaaugaggaauacacagauuauaugccuuccaugaaacgcuuucggagagaggaagaggaagccggagugcucugguga

SEQ ID NO: 19924 - RNA, 9876 nt, Artificial Sequence
  derived and/or modified CDS sequence (opt5) from DENV-2__EU482587__SS-prME
accgccggcgugaucauuaugcugauccccaccgcuauggccuuccaccucacgacccggaacggggagccucauaugauugucggacggcaggaaaagggcaagagccugcuuuuuaagaccgaggacgggguuaauaugugcacccugauggcgaucgaucucggagaacugugugaggacaccauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgagguggaacuuacgggguauggaaccguuacaauggaguguagcccccggaccggccuggauuucaacgaaauggugcuccugcagauggaggacaaagccuggcuuguccaccgccaaugguuucuggaucucccgcugccuuggcugcccggggcugacacacagggaucuaauuggauccagaaggagacccucgugacguucaagaacccucaugccaaaaagcaggacguugugguccugggcucccaagaaggggcuaugcacacagcccuuaccggcgccacagagauucagaugagcuccggaaaucugcucuuuaccggccaucugaaaugcagacuucggauggauaagcugcagcucaaagggaugucuuacagcauguguaccggaaaguucaagaucgugaaagaaauugcugagacacaacacggcacgaucgucaucagagugcaguaugagggggacggaucccccugcaagauucccuucgaaaucauggaucuggagaaacgccauguucugggccggcucauuaccgugaacccuaucgucacagaaaaggacagcccggugaacauugaggcggaacccccuuuuggggauucuuacaucauuaucggcguugagcccggacagcugaaacuuaauugguucaagaagggcuccagcaucgggcagauguuugagaccacaaugagaggagccaaacgcauggcuauucugggcgacaccgccugggauuucgggucucucggaggcguguuuacgagcaucgggaaggcccugcaccaagucuucggcgcuauuuacggagccgcguuuuccggcgugucuuggacaaugaaaauccugauuggggugaucaucaccuggauuggaaugaacagccgguccaccagccuuucuguuucccucguccuggugggcguggucacacuguaucucggggcuauggugcaggccgacagcggauguguugugucuuggaaguccagagaacugaaaugcggcagcgggaucuucauuaccgauaauguccacacauggacggagcaguacaaguuucagccugaaucccccucuaaacuugccagcgcuauccaaaaagcccaugaggaaggcauuuguggaauccgcuccgugacccggcuggagaaccucauguggaagcagaucacaccggagcugaaucacauucugucugaaaacgagguuaaacuuaccaucaugacaggcgacauuaaggggaucaugcaggcuggaaaaagaagccuccgcccucagcccaccgaacugaaguauuccuggaaaacguggggcaaggccaagaugcugagcaccgagucucauaaucggacauuccucauugaugggccugaaaccgcggagugccccaacacaaauagagccuggaacucccuggagguggaagacuacggauuuggcgucuucaccacaaauaucuggcuuaaacugcgcgagaagcaagacguguuuugugauagcaaacucaugucugcugccaucaaggacaaccgggcuguucacgccgauaugggcuauuggauugaauccgcgcugaaugacaccuggaaaauggagaaggccagcuucaucgaggugaagucuugccacuggccuaaaagccauacgcugugguccaacgggguccuugaaagcgagaugauuauccccaagaauuucgcuggaccggugucucagcacaacuacagaccuggcuaucauacacagaccgccgggcccuggcaccucggaaaacuggaaauggauuuugacuucugugagggcaccacaguggucguuaccgaagauugcgggaaccggggacccucccugcgcacgacaaccgcuagcggcaagcucauuacagaguggugcuguagauccugcacccugccuccgcuucgguacagaggcgaggacggguguugguacggaauggaaauccgcccccugaaagagaaggaagagaaucucgugaacucucuggugacagccggccaugggcagauugauaauuuuagccugggaguccuuggcauggcccucuuccuggaagagaugcugcggaccagaguggggacgaagcacgcuauccuccugguugcgguguccuuugucacccuuaucacaggaaacaugucuuuccgcgaccugggcagagugaugguuauggugggcgccaccaugacagaugacauugggaugggagucaccuaucucgcucugcuggccgccuuuaaagugcggccuacguucgcugccggccuucugcuccgcaagcugacaagcaaagagcucaugauggcgaccaucgggauugcucugcuuucccaaucuacaauccccgaaaccauucuggagcucaccgaugcccuggcccugggaaugaugguucuuaagaucgugagaaauauggaaaaauaccagcuggcugucacaaucauggccauuagcugcgugccuaacgcggugauccuccagaaugcuuggaaggucuccuguacgauucuggccgccguuagcgugucuccccuccugcuuaccuccagccaacagaaggcugacuggaucccucuggcccucacaauuaaaggccugaaccccaccgcuaucuuucugacaacccuuucucggacguccaagaaacgcagcuggccgcugaaugaggccaucauggcgguggggauggucucuauucucgccuccagccugcucaagaacgacaucccuaugacaggaccccugguggcuggcggccuucugaccguuugcuaugugcugaccgggagauccgccgaucucgaacuggagcgggcugccgacgucaaaugggaggaucaggccgaaauuagcggaucuagcccuauccuuuccauuacaaucucugaggacggcagcauguccauuaagaaugaagaggaggaacagacccugacaauccucauccgcacggggcugcucgugauuucuggaguuuuccccgugagcaucccgauuaccgcugcggccugguaccugugggaggucaaaaagcaaagagcuggcgugcuuugggaugucccuucucccccucccguggggaaggccgaacuggaggacggagccuaucggaucaaacagcgcggcauucugggcuacagccagaucggggcuggaguuuauaaggaaggcacauuucacaccauguggcaugugacaagaggggccguccucaugcaccggggaaaaagaaucgagcccagcugggcggaugugaagaaagaccugauuuccuacggcgggggauggaaacuugagggcgaauggaaggagggcgaagagguucaggugcuggcucucgaaccugggaaaaacccgcgcgccguccaaaccaagcccggacuguucaaaacgaauaccggcacaaucggggccgugagccucgauuuuucuccuggaaccuccggcagccccauuguggaccggaaggggaaaguugucggacuguacggcaacggcguggugacaagaucuggggcuuaugucuccgccaucgcgcagaccgaaaagagcauugaggauaauccugaaaucgaggacgauaucuuccgcaagaaacggcuuacaauuauggaccugcaucccggagcuggcaagacgaaaagauaccugccugccaucgugcgcgaagccauuaagcgggggcucagaacccugauccuugcuccgacacgcguuguggccgcugagauggaagaggcccugcggggacuccccauuagauaucagaccccugcgauccgggccgagcacaccggccgcgaaauugucgaccugaugugucaugcuacauucacgaugagacuccugucccccgugcggguuccuaacuacaaccuuaucaucauggaugaggcccacuuuaccgaccccgcuucuauugccgcccgcggguauaucagcacaagaguggaaaugggcgaggcugcgggaauuuucaugaccgccacaccgccuggcucccgggaucccuuuccccagagcaaugcuccuaucauggacgaggaaagagagauucccgaacgcucuuggaacuccgggcacgagugggucaccgauuucaaaggaaagacggugugguuuguuccuagcaucaaggccggcaaugacaucgccgcuugccugcggaaaaacgggaagaaagugauucaacugucuagaaagacauucgauagcgaauacgucaaaacccgcgccaaugacugggauuuuguggugaccacagacaucuccgagaugggagcgaacuucaaggcugagcgggucauugauccgagacgcuguaugaagcccguuauccucaccgacggcgaagaacgggugauucuggccgggccuaugcccgugacacauucuagcgccgcucagagacgcggcagaaucggacggaauccuaaaaacgaaaaugaccaguauaucuacaugggcgagccccuugaaaacgaugaggacugcgcccacuggaaggaggcgaaaaugcugcucgauaauauuaacaccccggaagggaucauuccuuccauguuugagcccgaacgcgagaaggucgacgccaucgauggagaauacagacugcggggcgaggcucgcaaaacguucguggaccugaugagaagaggggaucucccuguuuggcuugccuauagaguggcugccgagggaauuaauuacgcugaccgccggugguguuuugauggcaucaagaacaaucaaauucuggaagagaacgucgaaguggagaucuggacaaaagagggggaaagaaagaagcugaaaccccgcuggcucgacgcccggaucuauucugauccucuggcgcuuaaggaguucaaagaguucgccgcuggcagaaagagccugacccucaaccugauuacagagaugggacggcugcccaccuuuaugacgcagaaagcccgcgacgcucucgauaaucuugccguucugcauaccgccgaagcuggcgggagagcguacaaccacgcccuguccgagcucccggagacacuggaaacccuucugcuccugacacugcucgcuaccgugacaggaggcaucuuccuuuuucugaugagcgggaagggaauuggcaagaugacccugggcaugugcugcaucauuacggccucuauccuccugugguaugcccagauccagccucacuggauugcugccuccaucauucuugaguucuuucugaucguccuccugauucccgaacccgagaaacaacggacaccucaggacaaucagcugaccuacguggucaucgcgauccucaccgugguugccgcuacaauggccaacgaaaugggguuccuugagaagaccaaaaaggaccugggacugggcagcauuacaacgcaggaguccgaaucuaauauccucgauauugaccugcgcccggcuagcgccuggacccuuuaugcgguggccacaaccuuugugacacccaugcugagacauuccaucgagaacucuagcgucaauguuucccucaccgcuauugccaaccaagcuacggugcugauggggcugggaaaaggcuggccucucagcaagauggauaucggggugccccuucuggccauuggauguuacucucaggucaauccuaucacccugacagcugcccuccugcuucugguggcgcacuacgccaucauuggccccggccuccaggcuaaggccacccgggaagcucagaaacgcgccgccgcggggaucaugaagaacccuacaguugacggaauuaccgugaucgaucuggagccgauucccuaugacccuaaauucgaaaagcaacugggccaggucaugcuccuuauccugugcgugacgcagguccugaugaugagaacaaccugggcucucugugaggcccugacacuugcuaccgggcccaucuccacccugugggagggaaauccuggccgguuuuggaacacaacgauugccgugagcauggccaauaucuuccgcgggucuuaccucgcuggagccggccugcuguuuuccauuaugaaaaacaccacaaauaccagacggggcacagggaacaucggagaaacccucggcgagaaguggaaguccagacuuaaugcgcuggggaaaucugaguuccagauuuauaagaaaagcggaauccaagagguugaucgcacgcuggccaaggagggcaucaaaagaggggaaacagaccaucacgcuguguccagaggaucugccaagcuccgcugguuugucgagcggaacauggugacccccgaaggcaaaguuguggaucugggcugcgggagaggaggcuggagcuacuauugugggggacuuaagaacguccgcgaggugaagggccugaccaaagggggaccgggccaugaagaaccuauucccauguccacauacggcuggaaucucgugcggcugcagagcgggguugacgucuucuucacacccccugagaagugcgauacacugcucugugacaucggagaauccucucccaacccuacgauugaggcuggcagaacccuucgcgugcugaaucugguggaaaacuggcucaauaacaauacacaguuuugcaucaaaguccugaacccguauaugcccagcguuauugagaagauggaaacccuucaacggaaauacgggggagcccuggugagaaauccucucucccgcaacucuacacacgagauguacugggugagcaaugcgaccggcaacaucgucuccucugugaauaugaucagccggaugcugauuaacagauucacgaugaagcacaagaaagccaccuaugagcccgauguugaccugggguccggaacacgcaauaucggcauugaaagcgagaucccuaaccucgacauuaucggcaagagaauugagaagaucaagcaggagcaugaaaccucuuggcacuacgaucaggaccaucccuauaaaacaugggcuuaccacggguccuaugagaccaagcagacaggaagcgccucuuccauggugaacggcgucgugcggcuucugaccaagccgugggauguugugccuauggucacgcaaauggcuaugacagacaccacccccuuugggcagcagcgcguguucaaagagaagguggauacaagaacgcaggaaccuaaagagggaaccaagaaacugaugaagaucacagccgaauggcucuggaaggagcugggcaaaaagaaaacaccccggauguguacaagagaggaauuuacccggaagguccgcagcaaugcugcccuuggggcgauuuucacagacgagaacaaauggaagucugccagagaagcuguugaggauucccgguuuugggaacugaucgaccgcgagagaaaucuccaccuggagggaaaaugcgaaaccuguguguacaacaugaugggcaagcgggagaagaaacugggcgaguucgggaaggccaaaggaagccgcgcuauuugguauauguggcucggcgccagauuucuggaguucgaagcccuuggguuucugaaugaggaucauugguucucccggggaaacagccucucuggcguggagggggaaggccugcaccgccuuggauacauccugagagacgucagcaagaaagagggcggggcgauguacgcugaugacacggccggaugggacacccggauuacacucgaagaucugaagaaugaggaaauggugaccaaccauaugaagggcgagcacaaaaagcuggccgaggcuaucuuuaaacucacauaucaaaauaagguugugcgcguccagagaccuacaccccgggggacggugauggacaucauuucccgcagagaucagcggggaucuggccagguugggacauacggccugaacaccuucacaaauauggaagcccaacuuaucagacagauggagggagaaggcauuuucaaaagcauccagcaucugaccgugacggaggagauugcuguccaaaacuggcucgcccgcguggggcgggaaagacugucccgcauggcgaucucuggagacgauugcguugugaagccgcuugacgaucgguuugccagcgcucugaccgcccucaaugacaugggcaaggucagaaaagauauccagcagugggagccuucccgcggguggaacgacuggacacaggugcccuucugcucucaccacuuucaugaaauugucaugaaggauggacgggugcugguugugcccuguagaaaucaagacgagcugaucggccgcgcucggauuagccagggggccggcuggucccucaaagaaaccgcgugccugggaaagagcuaugcccagauguggacacuuauguacuuccacagacgcgaucugcggcucgcugccaacgcuaucuguucugccgucccuucccauugggugccgaccagcagaacaaccuggucuauucacgcuaaacacgaguggaugacgacagaggacaugcuggccguguggaaccggguuuggauccaggaaaaucccuggauggaggacaagaccccuguggaauccugggaggaaguccccuaucuuggcaagagagaggaucaauggugcgggagccugauuggacucaccucccgcgcgacaugggccaaaaacauccagaccgcuaucaaucaggugcggucucugauuggcaacgaggaauacacagacuauaugccuagcaugaagagauuucgcagagaggaagaggaagccgggguucugugguga

SEQ ID NO: 19925 - RNA, 9876 nt, Artificial Sequence
  derived and/or modified CDS sequence (opt5) from DENV-2__EU482588__SS-prME
accgccggcgugaucauuaugcugauccccaccgcuauggccuuccaccucacgacccggaacggggagccucauaugauuguuggacggcaggaaaagggcaagucccugcuuuuuaagaccgaggacgggguuaauaugugcacccugauggcgaucgaucucggagaacugugugaggacaccauuaccuacaagugcccgcuucugcgccaaaacgaacccgaggauaucgacuguuggugcaauuccacgucuaccugggugacguauggcaccuguacaaccacaggggagcacagacgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaaggugcccuucgaaauuauggaucuggagaaacgccauguucugggccggcucaucaccgugaacccuauugucacagaaaaggacagcccggugaacaucgaggccgaacccccuuuuggggauucuuacauuaucauuggcguugagcccggacagcugaaacuuaauugguucaagaagggcuccagcaucgggcagauguuugagaccacaaugagaggagcuaaacgcauggccauccugggcgacaccgccugggauuucgggucucucggaggcguguuuacgagcauugggaaggcucugcaccaagucuucggcgccaucuacggagcggcuuuuuccggcgugucuuggacaaugaaaauucugaucggggugauuaucaccuggaucggaaugaacagccgguccaccagccuuucuguuucccucguccuggugggcguggucacacuguaucucggggccauggugcaggccgacagcggauguguugugucuuggaaguccaaagaacugaagugcggcagcgggauuuucgucaccgauaaugugcacacauggacggagcaguacaaguuucagccugaaucccccucuaaacuugcuagcgccauccaaaaggcucaugaggaaggcauuuguggaaucagauccguuacccgccuggagaaccucauguggaaacagauuacaccggagcugaaucacauccugucugaaaacgaggugaaacuuaccaucaugacaggcgacauuaaagggaucaugcaggccggaaagcggagccucagaccucagcccaccgaacugaaauauuccuggaagacguggggcaaggcgaaaaugcugagcaccgagucucauaaucaaacauuccucauugaugggccugaaaccgccgagugccccaacacaaaucgcgcuuggaacucccuggaggucgaagacuacggauuuggcguguucaccacaaauaucuggcuuaagcugcgggagaaacaggacgucuuuugugauagcaagcucaugucugccgcuauuaaagacaacagagccgugcacgcggauaugggcuauuggaucgaauccgcccugaaugacaccuggaagauggagaaggcuagcuucaucgaggucaaaucuugccacuggccuaagagccauacgcugugguccaacggggugcuugaaagcgagaugauuauccccaaaaauuucgccggaccggugucucagcacaacuaccgcccuggcuaucauacacagaccgcugggcccuggcaccucggaaagcuggaaauggauuuugacuucugugagggcaccacagucguugugaccgaagauugcgggaaccggggacccucccugagaacgacaaccgccagcggcaaacucauuacagaguggugcugucgguccugcacccugccuccgcuucgcuacagaggcgaggacggguguugguacggaauggaaauccggccccugaaggagaaggaagagaaucucgugaacucucuggucacagccggccaugggcaaauugauaauuuuagccugggagugcuuggcauggcucucuuccuggaagagaugcugagaacccgcguugggacgaaacacgcgauccuccugguggccgucuccuuugugacccuuauuacaggaaacaugucuuuccgggaccugggcagaguuauggugauggucggcgcuaccaugacagaugacaucgggaugggagugaccuaucucgcccugcuggccgcuuuuaagguucgcccuacguucgccgcgggccuucugcucagaaaacugacaagcaaggagcucaugauggcuaccaucgggauugcccugcuuucccagucuacaauccccgaaaccauucuggagcucaccgaugcccuggcucugggaaugauggugcuuaaaaucguccggaauauggaaaaguaccagcuggccgugacaauuauggcgaucagcugcgugccuaacgcugucauccuccaaaaugccuggaagguuuccuguacgauucuggccgcugugagcgugucuccccuccugcuuaccuccagccagcagaaagccgacuggaucccucuggcucucacaauuaagggccugaaccccaccgccaucuuucugacaacccuuucucgcacguccaaaaagagaagcuggccgcugaaugaggcgauuauggccgucgggauggugucuauccucgcuuccagccugcucaaaaacgacaucccuaugacaggaccccugguugccggcggccuucugaccgugugcuauguccugaccgggcgguccgcugaucucgaacuggagcgcgccgccgacgugaagugggaggaucaggcugaaauuagcggaucuagcccuauccuuuccauuacaaucucugaggacggcagcauguccauuaaaaaugaagaggaggaacaaacccugacaauccucauuagaacggggcugcucguuaucucuggaguguuccccgucagcaucccgauuaccgcggccgcuugguaccugugggaggugaagaagcagcgggccggcguccuuugggaugugccuucucccccucccguugggaaagccgaacuggaggacggagcuuaucgcaucaagcagagaggcauucugggcuacagccagaucggggccggaguguauaaagaaggcacauuucacaccauguggcaugucacaagaggggcggugcucaugcaccgcggaaagagaauugagcccagcugggcugauguuaaaaaggaccugaucuccuacggcgggggauggaaacuugagggcgaauggaaagagggcgaagaggugcaaguccuggcccucgaaccugggaagaacccgcgggccgugcagaccaaacccggacuguucaagacgaauaccggcacaaucggggcugugagccucgauuuuucuccuggaaccuccggcagccccauuguugacagaaaagggaaggucgugggacuguacggcaacggcguggucacacgcucuggggccuauguguccgcgaucgcucagaccgaaaagagcauugaggauaauccugaaaucgaggacgauauuuuccggaaaaagagacuuacaaucauggaccugcaucccggagccggcaaaacgaagcgcuaccugccugccaucguucgggaagcuauuaaaagagggcuccgcacccugauccuugccccgacacggguggucgcugccgagauggaagaggcgcugagaggacuccccauucgcuaucagaccccugccauccgggcugagcacaccggcagagaaauuguggaccugaugugucaugccacauucacgaugcggcuccugucccccguucgcgugccuaacuacaaccuuaucauuauggaugaggcucacuuuaccgaccccgccucuaucgccgcuagaggguauaucagcacacgggucgaaaugggcgaggcggccggaauuuucaugaccgcuacaccgccuggcucccgcgaucccuuuccccaaagcaaugccccuaucauggacgaggaaagagagauucccgaacggucuuggaacuccgggcacgagugggugaccgauuucaagggaaagacgguuugguuugugccuagcaucaaagccggcaaugacauugcugccugccugagaaagaacgggaaaaaggucauccagcugucucgcaaaacauucgauagcgaauacgugaagacccgggcgaaugacugggauuuuguggucaccacagacaucuccgagaugggagcuaacuucaaggccgagagaguuauugauccgcgccgguguaugaaacccgugauccucaccgacggcgaagagagagugauucuggccgggccuaugcccgucacacauucuagcgcugcccagcgccggggcagaaucggacgcaauccuaagaacgaaaaugaccaauauauuuacaugggcgagccccuugaaaacgaugaggacugcgcgcacuggaaagaggccaagaugcugcucgauaauaucaacaccccggaagggaucauuccuuccauguuugagcccgaaagagagaaaguggacgcuaucgauggagaauaccggcugcgcggcgaggccagaaagacguucguugaccugaugcggcgcggggaucucccuguguggcuugcuuauagagucgccgcugagggaauuaauuacgccgaccggagaugguguuuugauggcaucaaaaacaaucagauucuggaagagaacguggaaguugagaucuggacaaaggagggggaacgcaagaaacugaagccccgguggcucgacgcgagaauuuauucugauccucuggcccuuaaagaguucaaggaguucgcugccggccgcaaaagccugacccucaaccugaucacagagaugggacggcugcccaccuuuaugacgcagaaggcuagagacgcccucgauaaucuugccgugcugcauaccgcugaagcgggcgggcgggccuacaaccacgcucuguccgagcucccggagacacuggaaacccuucugcuccugacacugcucgccaccgucacaggaggcaucuuccuuuuucugaugagcgggaagggaauuggcaaaaugacccugggcaugugcugcaucauuacggccucuauccuccugugguaugcucagauucaaccucacuggaucgccgcguccaucauucuugaguucuuucugaucgugcuccugauucccgaacccgagaagcagcgcacaccucaggacaaucagcugaccuacgucgugaucgccauucucaccguuguggcugccacaauggcuaacgaaaugggguuccuugagaaaaccaagaaagaccugggacugggcagcaucacaacgcaagaguccgaaucuaauauccucgauauugaccugagaccggccagcgcguggacccuuuaugccguggcuacaaccuuugucacacccaugcugcggcauuccaucgagaacucuagcguuaaugugucccucaccgccauugcuaaccaggccacggugcugauggggcugggaaagggcuggccucucagcaagauggauaucggggucccccuucuggcuauuggauguuacucucaggugaauccuaucacccugacagccgcgcuccugcuucugguugcccacuacgcuauuaucggccccggccuccaggccaaagcuacccgcgaagcccaaaagagagccgcggcugggaucaugaaaaacccuacaguggacggaauuaccgucaucgaucuggagccgauucccuaugacccuaaguucgaaaaacagcugggccaggugaugcuccuuauccugugcgucacacaggugcugaugaugcggacaaccugggcccucugugaggcucugacacuugccaccgggcccauuuccacccugugggagggaaauccuggccgcuuuuggaacacaacgaucgccguuagcauggcuaauaucuucagagggucuuaccucgccggagcgggccugcuguuuuccauuaugaagaacaccacaaauacccggcgcggcacagggaacaucggagaaacccucggcgagaaguggaaaagcagacuuaaugcccuggggaagucugaguuccaaauuuauaaaaagagcggaauccaggagguggaucggacgcuggcuaaagagggcauuaagagaggggaaacagaccaucacgccgucucccgcggaucugcuaaacuccggugguuuguggagagaaacaugguuacccccgaaggcaagguggucgaucugggcugcgggcgcggaggcuggagcuacuauugugggggacuuaagaacgugcgggaggugaaaggccugaccaaagggggaccgggccaugaagaaccuauccccauguccacauacggcuggaaucucguuagacugcagagcggggucgacguguucuucacacccccugagaaaugcgauacacugcucugugacaucggagaauccucucccaacccuacgauugaggccggccgcacccuucgggugcugaaucuggucgaaaacuggcucaauaacaauacacaauuuugcaucaagguucugaacccguauaugcccagcgugauugagaaaauggaaacccuucagagaaaguacgggggagcgcuggugcgcaauccucucucccggaacucuacacacgagauguacugggucagcaaugccaccggcaacaucguguccucuguuaauaugauuagcagaaugcugaucaaccgcuucacgaugaagcacaaaaaggcuaccuaugagcccgauguggaccugggguccggaacacggaauaucggcauugaaagcgagaucccuaaccucgacauuaucggcaaaagaauugaaaagaucaaacaggagcaugaaaccucuuggcacuacgaucaggaccaucccuauaagacaugggccuaccacggguccuaugagaccaagcaaacaggaagcgcuucuuccauggucaacggcgugguucgccuucugaccaaaccgugggauguggucccuauggugacgcagauggccaugacagacaccacccccuuugggcagcagagaguguucaaggagaaagucgauacacggacgcaagaaccuaaggagggaaccaaaaagcugaugaagauuacagcugaauggcucuggaaagagcugggcaagaaaaagacaccccgcauguguacaagagaggaauuuacccggaaaguuagaagcaaugccgcgcuuggggccaucuucacagacgagaacaaguggaaaucugcucgggaagccguggaggauucccgcuuuugggaacugaucgacagagagcggaaucuccaccuggagggaaagugcgaaaccuguguguacaacaugaugggcaagcgcgagaaaaagcugggcgaguucgggaaagcuaagggaagcagagccauuugguauauguggcucggcgcccgguuucuggaguucgaagcgcuuggguuucugaaugaggaucauugguucucccgcggaaacagccucucuggcgucgagggggaaggccugcacagacuuggauacauccugcgggacgugagcaaaaaggagggcggggcuauguacgccgaugacacggccggaugggacacccgcauuacacucgaagaucugaagaaugaggaaaugguuaccaaccauaugaaaggcgagcacaagaaacuggcugaggccaucuuuaagcucacauaucagaauaaaguggucagagugcagcggccuacaccccgcgggacgguuauggacauuaucuccagacgggaucagcgcggaucuggccaaguggggacauacggccugaacaccuucacaaauauggaagcucagcuuaucagacagauggagggagaaggcauuuucaagagcauccaacaucugaccgucacggaggagauugccgugcagaacuggcucgcgcggguugggagagaacgccugucccggauggccaucucuggagacgauugcguggucaagccgcuugacgauagauuugcuagcgcccugaccgcucucaaugacaugggcaaagugcgcaaggauauucagcagugggagccuucccggggguggaacgacuggacacaaguccccuucugcucucaccacuuucaugaacuggugaugaaagauggaagaguucuggugguccccugucgcaaucaggacgagcucaucggccgggccagaaucagccagggggcgggcuggucccugaaggaaaccgccugccuuggaaaaagcuaugcucagauguggacacugauguacuuccaccgccgggaucucagacuggccgcuaacgccauuuguucugcugugccuucccauugggugccgaccagccgcacaaccuggucuauccacgccaagcacgaguggaugacgacagaggacaugcuugcgguuuggaaccggguguggauucaagaaaaucccuggauggaggacaagaccccugucgaauccugggaggaagugcccuaucugggcaaaagagaggaucaguggugcgggagccucaucggacugaccucccgggccacaugggcuaagaacauucagaccgccaucaaucagguuagaucucugauuggcaacgaggaauacacagacuauaugccuagcaugaaacgcuuucggagagaggaagaggaagccggggugcucugguga

SEQ ID NO: 19926 - RNA, 9876 nt, Artificial Sequence
  derived and/or modified CDS sequence (opt5) from DENV-2__EU569705__SS-prME
accgcgggcgugaucauuaugcugauccccaccgcuauggccuuccaccucacgacccggaacggggagccucauaugauugucggacggcaggaaaagggcaagucccugcuuuuuaagaccgaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggagugcuuggcauggcccucuuccuggaagagaugcugagaacacgcgucgggaccaaacacgccaugcuccugguggcuguuuccuuugugacgcuuaucaccggaaacaugucuuuccgggaccugggcagagucauggugaugguuggcgccacaaugaccgaugacaucgggaugggaauuacauaucucgcccugcuggcugccuuuaaggugcgcccuaccuucgcggcuggccuucugcucagaaaacugacgagcaaggagcucaugauggccacaaucgggauugcccugcuuucccagucuaccauccccgaaacaauucuggagcucaccgaugcucuggcccugggaaugaugguccuuaaaaucgugcggaauauggaaaaguaccagcuggcgguuaccaucauggcuauuagcugcgugccuaacgccgucauccuccaaaaugccuggaagguguccuguacaauucuggcugccgugagcgucucuccccuccugcuuacguccagccagcagaaagcugacuggaucccucuggcccucaccauuaagggccugaaccccacagcgaucuuucugaccacacuuucucgcaccuccaaaaagagaagcuggccgcugaaugaggccaucauggcuguugggauggugucuauucucgccuccagccugcucaaaaacgacaucccuaugacgggaccccugguggcuggcggccuucugacagucugcuaugugcugaccgggcgguccgccgaucucgaacuggagcgcgccgcugacguuaagugggaggaucaggcggaaauuagcggaucuagcccuauccuuuccauuaccaucucugaggacggcagcauguccauuaaaaaugaagaggaggaacaaacacugaccauccucaucagaacagggcugcucgugauuucuggagucuuccccgugagcaucccgauuacggccgcugccugguaccugugggagguuaagaagcagcgggccggcgugcuuugggaugucccuucucccccucccguggggaaagcugaacuggaggacggagccuaucgcaucaagcagagaggcauucugggcuacagccagaucggggcgggagucuauaaagaaggcaccuuucacacaauguggcaugugaccagaggggcuguucucaugcaccgcggaaagagaaucgagcccagcugggccgaugugaaaaaggaccugauuuccuacggcgggggauggaaacuugagggcgaauggaaagagggcgaagagguccaagugcuggcccucgaaccugggaagaacccgcgggcuguucagacaaaacccggacuguucaagaccaauacgggcaccaucggggccgugagccucgauuuuucuccuggaacauccggcagccccauugucgacagaaaagggaagguggugggacuguacggcaacggcguugucacccgcucuggggcguauguguccgcuaucgcccagacagaaaagagcauugaggauaauccugaaaucgaggacgauaucuuccggaaaaagagacuuaccauuauggaccugcaucccggagccggcaaaacaaagcgcuaccugccugcuaucgugcgggaagccauuaaaagagggcuccgcacgcugauccuugcuccgacccgggucguggccgcggagauggaagaggcccugagaggacuccccauucgcuaucagaccccugcuauccgggccgagcacaccggcagagaaauuguugaccugaugugucaugcuaccuucacaaugcggcuccugucccccgugcgcgucccuaacuacaaccuuaucaucauggaugaggcccacuuuacggaccccgccucuauugcugcgagaggguauaucagcacccggguggaaaugggcgaggccgcuggaauuuucaugacagccaccccgccuggcucccgcgaucccuuuccccaaagcaaugccccuaucauggacgaggaaagagagauucccgaacggucuuggaacuccgggcacgaguggguuacagauuucaagggaaagaccgugugguuugucccuagcaucaaagcuggcaaugacaucgccgcgugccugagaaagaacgggaaaaaggugauucagcugucucgcaaaacguucgauagcgaauacguuaagacacgggcuaaugacugggauuuuguggucaccaccgacaucuccgagaugggagccaacuucaaggccgagagagugauugauccgcgccgguguaugaaacccgugauccucacagacggcgaagagagagucauucuggcugggccuaugcccguuacccauucuagcgccgcgcagcgccggggcagaaucggacgcaauccuaagaacgaaaaugaccaauauaucuacaugggcgagccccuugaaaacgaugaggacugcgcccacuggaaagaggcuaagaugcugcucgauaauauuaacacaccggaagggaucauuccuuccauguuugagcccgaaagagagaaaguggacgccaucgauggagaauaccggcugcgcggcgaggcuagaaagaccuucguggaccugaugcggcgcggggaucucccugucuggcuugccuauagaguggcugccgagggaauuaauuacgcggaccggagaugguguuuugauggcaucaaaaacaaucagauucuggaagagaacguugaaguggagaucuggacgaaggagggggaacgcaagaaacugaagccccgguggcucgacgccagaaucuauucugauccucuggcucuuaaagaguucaaggaguucgccgcuggccgcaaaagccugacacucaaccugauuaccgagaugggacggcugcccacauuuaugacccagaaggccagagacgcccucgauaaucuugcuguccugcauacggcggaagccggcgggcgggcuuacaaccacgcccuguccgagcucccggagacccuggaaacacuucugcuccugacccugcucgccacagugaccggaggcaucuuccuuuuucugaugagcgggaagggaauuggcaaaaugacacugggcaugugcugcaucauuaccgcuucuauccuccugugguaugcccagauccaaccucacuggauugcggccuccaucauucuugaguucuuucugaucguucuccugauucccgaacccgagaagcagcgcacgccucaggacaaucagcugacauacguggucaucgcuauccucaccguggucgccgcuaccauggccaacgaaaugggguuccuugagaaaacaaagaaagaccugggacugggcagcauugcgacccaagaguccgaaucuaauauccucgauauugaccugagaccggccagcgcuuggacacuuuaugccguggcuacgaccuuuguuacacccaugcugcggcauuccaucgagaacucuagcgugaaugugucccucaccgccauugcuaaccaggccacaguccugauggggcugggaaagggcuggccucucagcaagauggauaucgggguuccccuucuggcgauuggauguuacucucaggugaauccuaucacccugacggccgcucuccugcuucugguggcccacuacgcuaucauuggccccggccuccaggccaaagccacccgcgaagcgcaaaagagagcugccgcugggaucaugaaaaacccuacagucgacggaauuaccgugaucgaucuggagccgauucccuaugacccuaaguucgaaaaacagcugggccagguuaugcuccuuauccugugcgugacacagguccugaugaugcggaccacgugggcccucugugaggcccugacacuugcuaccgggcccaucuccacacugugggagggaaauccuggccgcuuuuggaacaccaccauugccgugagcauggcgaauaucuucagagggucuuaccucgccggagcuggccugcuguuuuccauuaugaagaacacaacgaauacccggcgcggcacagggaacaucggagaaacccucggcgagaaguggaaaagcagacuuaaugcccuggggaagucugaguuccaaauuuauaaaaagagcggaauccaggaggucgaucggacacuggcuaaagagggcaucaagagaggggaaaccgaccaucacgccgugucccgcggaucugcgaaacuccggugguuuguugagagaaacauggugacgcccgaaggcaaggucguggaucugggcugcgggcgcggaggcuggagcuacuauugugggggacuuaagaacguucgggaggugaaaggccugacaaaagggggaccgggccaugaagaaccuauucccauguccaccuacggcuggaaucucgucagacugcagagcgggguggacguguucuucacacccccugagaaaugcgauacacugcucugugacaucggagaauccucucccaacccuaccauugaggccggccgcacacuucggguucugaaucuggucgaaaacuggcucaauaacaauacgcaauuuugcaucaaggugcugaacccguauaugcccagcgugauugagaaaauggaaacccuucagagaaaguacgggggagcucugguccgcaauccucucucccggaacucuacacacgagauguacuggguuagcaaugccaccggcaacaucguguccucugugaauaugaucagcagaaugcugauuaaccgcuucacaaugaagcacaaaaaggcuaccuaugagcccgaugucgaccugggguccggaacgcggaauaucgugauugaaagcgagaucccuaaccucgacauuaucggcaaaagaauugaaaagaucaaacaggagcaugaaaccucuuggcacuacgaucaggaccaucccuauaagacaugggccuaccacggcuccuaugagaccaagcaaacagggagcgcuucuuccaugguuaacggagugguccgccuucugaccaaaccgugggaugugguuccuauggugacacagauggccaugaccgacacgacacccuuuggccagcagagagucuucaaggagaaaguggauacccggacccaagaaccuaaggaggggaccaagaagcugaugaagaucacggcggaauggcucuggaaagagcugggaaagaaaaagacaccccgcauguguacaagagaggaauuuacccggaaagugagaagcaaugccgcucuuggcgccauuuucacagacgagaacaaguggaaaucugcucgggaagccgucgaggauucccgcuuuugggaacugaucgacagagagcggaaucuccaccuggaggggaagugcgaaaccuguguuuacaacaugaugggaaagcgcgagaaaaagcugggcgaguucggcaaagccaaggggagcagagcgauuugguauauguggcucggagcucgguuucuggaguucgaagcccuuggcuuucugaaugaggaucauugguucucccgcgggaacagccucucuggaguggagggcgaagggcugcacagacuuggcuacauccugcgggacgugagcaaaaaggagggaggcgccauguacgcugaugacacagccgggugggacacccgcauuacgcucgaagaucugaagaaugaggaaauggucaccaaccauaugaaaggagagcacaagaaacuggcugaggccaucuuuaagcucacauaucagaauaaagugguuagagugcagcggccuacaccccgcggcacagucauggacaucauuuccagacgggaucagcgcgggucuggacaagugggcaccuacgggcugaacacguucacaaauauggaagcgcagcuuaucagacagauggagggcgaaggaauuuucaagagcauccaacaucugaccguuacagaggagauugccgugcagaacuggcucgcucgggucggcagagaacgccugucccggauggccaucucuggggacgauugcgugguuaagccgcuugacgauagauuugcuagcgcccugaccgcgcucaaugacaugggaaaagugcgcaaggauauccagcagugggagccuucccggggcuggaacgacuggacgcaaguccccuucugcucucaccacuuucaugaacuggugaugaaagaugggagaguccuggugguucccugucgcaaucaggacgagcucauuggacgggccagaaucagccagggcgcuggguggucccugaaggaaaccgccugccuuggcaaaagcuaugcucagauguggacacugauguacuuccaccgccgggaucucagacuggccgcuaacgccauuuguucugcggugccuucccauugggucccgaccagccgcacaaccuggucuauccacgccaagcacgaguggaugacaaccgaggacaugcuugcuguguggaaccggguguggauucaagaaaaucccuggauggaggacaagacgccuguugaauccugggaggaagugcccuaucugggaaaaagagaggaucaguggugcggcagccucaucgggcugacaucccgggccaccugggccaagaacauucagaccgcuaucaaucaggucagaucucugaucggaaacgaggaauacacagacuauaugccuagcaugaaacgcuuucggagagaggaagaggaagccggcgugcucugguga

SEQ ID NO: 19927 - RNA, 9876 nt, Artificial Sequence
  derived and/or modified CDS sequence (opt5) from DENV-2__EU482589__SS-prME
acagccggagugaucauuaugcugauccccacagcuauggccuuccaccucacgacccggaacggggagccucauaugauugucggacggcaggaaaagggcaagucccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaugggccuggauuucaacgaaaugguucuccugcagauggaggacaaggcuuggcuugugcaccgccaaugguuucuggaucucccgcugccuuggcugcccggggccgacacccagggaucuaauuggauccagaaggagacacucgucaccuucaagaacccucaugcuaaaaagcaggacgugguugugcugggcucccaagaaggggccaugcacacggcccuuacaggcgcuaccgagauucagaugagcuccggaaaucugcucuuuacaggccaucugaaaugcagacuucggauggauaagcugcagcucaaagggaugucuuacagcauguguaccggaaaguucaagaucgucaaagaaauugcggagacccaacacggcacaaucgugaucagaguccaguaugagggggacggaucccccugcaagauucccuucgaaaucauggaucuggagaaacgccaugugcugggccggcucauuacgguuaacccuaucgugaccgaaaaggacagcccggucaacauugaggccgaacccccuuuuggggauucuuacaucauuaucggcguggagcccggacagcugaaacuuaauugguucaagaagggcuccagcaucgggcagauguuugagacaaccaugagaggagcuaaacgcauggccauucugggcgacacagccugggauuucgggucucucggaggcguuuuuaccagcaucgggaaggcucugcaccaaguguucggcgccauuuacggagcggcuuuuuccggcgucucuuggacgaugaaaauccugauuggggugaucaucacauggauuggaaugaacagccgguccaccagccuuucugugucccucguucuggucggcguggugacccuguaucucggggccaugguccaggccgacagcggaugugugguuucuuggaaguccaaagaacugaagugcggcagcgggaucuucauuacagauaaugugcacaccuggacagagcaguacaaguuucagccugaaucccccucuaaacuugcuagcgccauccaaaaggcucaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggccggaaagcggagccucagaccucagcccacagaacugaaauauuccuggaagaccuggggcaaggcgaaaaugcugagcacggagucucauaaucaaaccuuccucauugaugggccugaaacagccgagugccccaacaccaaucgcgcuuggaacucccuggagguugaagacuacggauuuggcguguucacaaccaauaucuggcuuaagcugcgggagaaacaggacgucuuuugugauagcaagcucaugucugccgcuaucaaagacaacagagccgugcacgcggauaugggcuauuggauugaauccgcccugaaugacacauggaagauggagaaggcuagcuucaucgagguuaaaucuugccacuggccuaagagccauacccugugguccaacggggugcuugaaagcgagaugauuauccccaaaaaucucgccggaccggucucucagcacaacuaccgcccuggcuaucauacgcagacagcugggcccuggcaccugggaaagcuggaaauggauuucgacuuuugugagggcaccaccgugguggucacagaagauugcgggaaccggggacccucccucagaaccacgacagccagcggcaaacugguuaccgaguggugcugucgguccugcacacuuccuccgcugcgcuacagaggcgaggacggguguugguacggaauggaaauucggccccucaaggagaaggaagagaaucuggugaacucucuggugaccgccggccaugggcaaaucgauaauuucagccuuggaguccucggcauggcucuguuucuggaagagaugcucagaacacgcguggggaccaaacacgcgauucugcuuguugccguguccuucgucacgcugaucaccggaaacaugucuuuucgggaccucggcagagugaugguuauggugggcgcuacaaugaccgaugacaucgggaugggagucacauaucuggcccugcuugccgcuuucaaggugcgcccuaccuuugccgcgggccugcuccugagaaaacucacgagcaaggagcugaugauggcuacaauugggaucgcccuucugucccagucuaccauucccgaaacaauccucgagcugaccgaugcccuggcucuuggaaugaugguucugaaaauugugcggaauauggaaaaguaccagcucgccgucaccaucauggcgaucagcugcgugccuaacgcugugauucugcaaaaugccuggaaggucuccuguacaauccucgccgcuguuagcgugucuccccugcuucugacguccagccagcagaaagccgacuggauuccucucgcucugaccaucaagggccugaaccccacagccauuuuccuuaccacacugucucgcaccuccaaaaagagaagcuggccgcucaaugaggcgaucauggccguggggauggucucuauccuggcuuccagccuccugaaaaacgacauuccuaugacgggaccccuuguggccggcggccugcugacaguuugcuaugugcucaccgggcgguccgcugaucuggaacuugagcgcgccgccgacgucaagugggaggaucaggcugaaaucagcggaucuagcccuauucuguccaucaccauuucugaggacggcagcauguccaucaaaaaugaagaggaggaacaaacacucaccauucugaucagaacagggcuccuggugaucucuggaguuuuucccgugagcauuccgaucacggcggccgcuugguaccuuugggaggucaagaagcagcgggccggcgugcugugggaugucccuucucccccucccguggggaaagccgaacuggaggacggagcuuaucgcauuaagcagagaggcauccucggcuacagccagauuggggccggaguuuauaaagaaggcaccuuccacacaauguggcaugugaccagaggggcgguccugaugcaccgcggaaagagaaucgagcccagcugggcugaugugaaaaaggaccuuaucuccuacggcgggggauggaagcuggagggcgaauggaaagagggcgaagagguucaagugcucgcccuggaaccugggaagaacccgcgggccguccagacaaaacccggacucuuuaagaccaauacgggcaccauuggggcugugagccuggauuucucuccuggaacauccggcagccccaucguggacagaaaagggaagguugucggacuuuacggcaacggcguggugacccgcucuggggccuaugucuccgcgauugcucagacagaaaagagcaucgaggauaauccugaaauugaggacgauaucuuucggaaaaagagacugaccaucauggaccugcaucccggagccggcaaaacaaagcgcuaccucccugccauugugcgggaagcuaucaaaagagggcugcgcacgcuuauucuggccccgacccggguuguggcugccgagauggaagaggcgcucagaggacugcccauccgcuaucagaccccugccauucgggcugagcacaccggcagagaaaucgucgaccucaugugucaugccaccuucacaaugcggcugcuuucccccgugcgcguuccuaacuacaaccugauuaucauggaugaggcucacuucacggaccccgccucuaucgccgcuagaggguauauuagcacccggguggaaaugggcgaggcggccggaaucuuuaugacagcuaccccgccuggcucccgcgaucccuucccccaaagcaaugccccuauuauggacgaggaaagagagauccccgaacggucuuggaacuccgggcacgagugggucacagauuuuaagggaaagaccgugugguucguuccuagcauuaaagccggcaaugacaucgcugccugccugagaaagaacgggaaaaaggugauccagcucucucgcaaaacguuugauagcgaauacgucaagacacgggcgaaugacugggauuucguggugaccaccgacauuuccgagaugggagcuaacuuuaaggccgagagagucaucgauccgcgccgguguaugaaacccguuauucugacagacggcgaagagagagugauccuugccgggccuaugcccgugacccauucuagcgcugcccagcgccggggcagaauuggacgcaauccuaagaacgaaaaugaccaauauaucuacaugggcgagccccuggaaaacgaugaggacugcgcgcacuggaaagaggccaagaugcuccuggauaauaucaacacaccggaagggauuaucccuuccauguucgagcccgaaagagagaaagucgacgcuauugauggagaauaccggcugcgcggcgaggccagaaagaccuuuguggaccucaugcggcgcggggaucuuccuguuuggcuggcuuauagaguggccgcugagggaaucaauuacgccgaccggagaugguguuucgauggcauuaaaaacaaucagauccuggaagagaacgucgaaguggagauuuggacgaaggagggggaacgcaagaaacucaagccccgguggcuggacgcgagaaucuauucugauccucuugcccugaaagaguuuaaggaguucgcugccggccgcaaaagccucacacugaaccugaucaccgagaugggacggcuccccacauucaugacccagaaggcuagaaaugcccuugacaaccuggccguucugcauacggcugaagcgggcgggcgggccuacaaucacgcucucuccgagcugccggagacccuugaaacacugcuccugcugacccuccuugccacagugaccggaggcauuuuucuguuccugaugagcgggaagggaaucggcaaaaugacacucggcaugugcugcauuaucaccgccucuauucugcuuugguaugcucagauccaaccucacuggaucgccgcguccauuauccuggaguuuuuccucauuguccugcugauccccgaacccgagaagcagcgcacgccucaggauaaccagcucacauacguggucauugccauccuuaccgugguugcugccaccauggcuaaugaaaugggguuucuggagaaaacaaagaaagaccugggacucggcagcaucaccacacaagaguccgaaucuaacauucuggacaucgaucuuagaccggccagcgcguggacgcuguaugccguggcuaccacauucgugacccccaugcuccggcauuccauugaaaauucuagcgucaacguuucccugacagccaucgcuaaucaggccaccgugcugauggggcucggaaagggcuggccucuuagcaagauggacauuggggugccccugcuggcuaucggauguuacucucaggucaacccuauuacgcucaccgccgcgcugcuucugcucguggcccacuacgcuaucaucggccccggccugcaggccaaagcuacacgcgaagcccaaaagagagccgcggcugggauuaugaaaaauccuaccguugauggaaucacagugauugaccuggagccgauccccuaugauccuaaguuugaaaaacagcucggccaggucaugcuucugauucugugcgugacccagguccucaugaugcggacgacaugggcccugugugaggcucuuacccuggccacagggcccaucuccacccucugggagggaaacccuggccgcuucuggaauaccacaaucgccgugagcauggcuaacauuuuuagagggucuuaccuggccggagcgggccuccuguucuccaucaugaagaauacgaccaacacacggcgcggcaccgggaauauuggagaaacacuuggcgagaaguggaaaagcagacugaacgcccuggggaagucugaauuucaaaucuauaaaaagagcggcauucaggagguugaccggacccucgcuaaagagggcaucaagagaggggaaacggaucaucacgccgugucccgcggaucugcuaaacugcggugguucgucgagagaaacauggugacacccgaaggcaagguuguggaccuuggcugcgggcgcggaggcuggagcuacuauugugggggacugaagaauguccgggaggugaaaggccucaccaaagggggaccgggccaugaggagccuauccccauguccaccuacggcuggaaccuggugagacugcagagcgggguugaugucuuuuucacacccccugagaaaugcgacacccuccuuugugauauuggagaauccucucccaauccuacaaucgaggccggccgcacgcugcgggugcugaaccucguggaaaauuggcugaacaauaacacccaauucugcauuaagguccuuaauccguauaugcccagcguuaucgagaaaauggaaacacugcagagaaaguacgggggagcgcucgugcgcaacccucuguccagaaauucuacccacgagauguacugggugagcaacgccacaggcaauauugucuccucugugaacaugaucagcagaaugcugaucaaucgcuuuaccaugaagcacaaaaaggcuacguaugagcccgacguugaucucggguccggaacccggaacauuggcaucgaaagcgagauuccuaaccuugacaucauuggcaaaagaaucgaaaagauuaaacaggagcaugaaacaucuuggcacuacgaccaggaucaucccuauaagaccugggccuaccacggguccuaugagacaaagcaaaccggaagcgcuucuuccauggugaauggcgucgugcgccugcugacaaaaccgugggacguugugccuauggucacccagauggccaugacggauacaacccccuucgggcagcagagaguguuuaaggagaaaguggacacccggacacaagaaccuaaggagggaacgaaaaagcucaugaagaucaccgcugaauggcuguggaaagagcuuggcaaggagaaaacaccccgcauguguaccagagaagaguucacacggaaggucagaagcaacgccgcgcugggggccaucuuuaccgaugaaaauaaauggaagucugcucgggaggccguugaagacucccgcuucugggagcucauugauagagagcggaaccugcaccuggaaggaaaaugcgagacauguguguacaauaugaugggcaagcgcgaaaagaaacucggcgaguuugggaaggcuaaaggaagcagagccaucugguauauguggcugggcgcccgguuccuugaauuugaggcgcugggguuccucaacgaggaccauugguuuucccgcgaaaauagccugucuggaguggagggcgaagggcuucacagacugggcuacauucuccgggaugucagcaagaaagagggaggcgcuauguacgccgacgauaccgccgggugggacacgcgcaucacccuggaagaccugaagaacgaggagauggugacaaaucauaugaagggagaacacaaaaagcucgcugaggccauuuucaaacugaccuaucagaacaagguugugagaguccagcggccuacaccccgcggcaccgugauggauaucaucuccagacgggaccagcgcgggucuggacaaguuggcacguacgggcuuaauacauuuaccaacauggaagcucagcugauuagacagauggagggcgagggaaucuucaaaagcauucaacaucucacagccaccgaagagaucgcggugcagaauuggcuggcccgggucggcagagaacgccuuucccggauggcuauuucuggggaugacugcgugguuaagccgcuggaugacagauucgccagcgcucucacggcccugaacgauaugggaaaggugcgcaaagacauccagcagugggagccuucccggggcuggaaugauuggacccaaguccccuuuugcucucaccacuuccaugaacuggugaugaaggacgggagaguccucgugguucccugucgcaaccaggaugagcugaucggacgggcgagaauuagccagggcgccggguggucccuuaaagagacagcuugccugggcaagagcuaugcccagauguggacccucauguacuuucaccgccgggaccugagacuugcugccaacgcuaucuguucugccgugccuucccauugggucccgacaagccgcaccacauggucuauucacgcgaaacacgaauggaugaccacggaggauaugcuggccguguggaaucggguguggauccaagaaaaccccuggauggaggacaagacaccuguugaauccugggaggaggugcccuaucucggaaagagagaagaccaguggugcggcagccugauugggcugaccucccgggcuaccugggccaaaaauauccagacagccauuaaccaggucagaucucucaucggaaaugaggaauacaccgauuauaugccuagcaugaagcgcuuccggagagaggaagaggaggcuggcgugcugugguga

SEQ ID NO: 19928 - RNA, 9876 nt, Artificial Sequence
  derived and/or modified CDS sequence (opt5) from DENV-2__EU569706__SS-prME
accgccggagugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaguauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguugccgaaaaggacagcccggugaacaucgaggcugaacccccuuuuggggauucuuacauuaucaucggcgucgagcccggacagcugaaacuuaauugguucaagaagggcuccagcauugggcagauguuugagacaaccaugagaggagccaaacgcauggccauccugggcgacacagcuugggauuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggugaugguccaggccgacagcggaugugugguuucuuggaagaauaaagaacugaagugcggcuccgggauuuucaucacagauaacgugcacaccuggacagagcaguacaaguuucagccugaaagccccuccaaacuugcuucugccauucaaaaggcucaugaggaaggcaucuguggaaucagaagcgucacgcgccuggagaaucucauguggaaacagauuaccccggagcugaaccacauccuguccgaaaaugaggugaaacuuacaauuaugaccggcgacaucaaagggauuaugcaggccggaaagcggucucucagaccucagcccacagaacugaaauauagcuggaagaccuggggcaaggcgaaaaugcuguccacggagagccauaaccaaaccuuccucaucgaugggccugaaacagccgagugccccaauaccaaccgcgcuuggaacucucuggagguugaagacuacggauuuggcguguucuccacaaacaucuggcuuaagcugcgggagaaacaggacgucuuuugugauagcaagcucaugucugccgcuauuaaagacaauagagccgugcacgcggauaugggcuauuggaucgaauccgcccugaacgacaccuggaagauggagaaggcuagcuucauugagguuaaaucuugccacuggccuaagagccauacacugugguccaauggggugcuugaaagcgagaugaucauucccaaaaacuucgccggaccggucucucagcacaacuaccgcccuggcuaucauacccagacggcugggcccuggcaccucggaaagcuggaaauggauuuugacuucugugagggcacaaccgugguggucaccgaagauugcgggaaucggggacccucccugagaacaaccacggccagcggcaaacucaucacagaguggugcugucgguccugcacccugccuccgcuucgcuacagaggcgaggacggguguugguacggaauggaaauucggccccugaaggagaaggaagagaaccucguuaauucucuggugacagccggccaugggcaaaucgauaacuuuagccugggagugcuuggcauggcucucuuccuggaagagaugcugagaacccgcgucgggacaaaacacgcgauccuccugguggccguuuccuuugugacccuuauuacgggaaauaugucuuuccgggaccugggcagagucauggugaugguuggcgcuaccaugacagaugacaucgggaugggagugaccuaucucgcccugcuggccgcuuuuaagguccgcccuacauucgccgcgggccuucugcucagaaaacugaccagcaaggagcucaugauggcuacgauugggaucgcccugcuuucccagucuacaauucccgaaaccauccuggagcucacagaugcccuggcucugggaaugauggugcuuaaaaucguucggaaccuggaaaaguaccagcucgccgugaccauuauggcgaucagcugcgucccuaaugcugugauucugcaaaacgccuggaagguguccuguaccauccucgccgcugucagcguuucuccccugcuucugacauccagccagcagaaagccgacuggauuccucucgcucugacgaucaagggccugaaucccaccgccaucuuucuuacaacccugucucgcacauccaaaaagagaagcuggccgcucaacgaggcggugauggccguggggauggucucuauucuggcuuccagccuccugaaaaaugacaucccuaugaccggaccccuuguggccggcggccugcugacgguuugcuaugugcucacagggcgguccgcugaucuggaacuugagcgcgccgccgacgucaagugggaggaucaggcugaaauuagcggaucuagcccuauccuguccauuaccaucucugaggacggcagcauguccauuaaaaacgaagaggaggaacaaacccucacaauccugaucagaaccgggcuccuggugauuucuggaguuuuccccgugagcaucccgauuacagcggccgcuugguaccuuugggaggucaagaagcagcgggccggcgugcugugggaugucccuucucccccucccguggggaaagccgaacuggaggacggagcuuaucgcaucaagcagagaggcauuuuuggcuacagccagaucggggccggaguuuauaaagaaggcacguuccacaccauguggcaugugacaagaggggcgguccucaugcaccgcggaaagagaaucgagcccagcugggcugaugugaaaaaggaccugauuuccuacggcgggggauggaaacuugagggcgaauggaaagagggcgaagagguucaagugcuggcccucgaaccugggaagaauccgcgggccguccagaccaaacccggacuguuuaagacaaacaccggcacgaucggggcugugagccucgauuucucuccuggaaccuccggcagccccauuguggacagaaaagggaagguugucggacuguacggcaauggcguggugacacgcucuggggccuaugucuccgcgaucgcucagaccgaaaagagcauugaggauaacccugaaaucgaggacgauaucuuccggaaaaagagacuuacaauuauggaccugcaucccggagccggcaaaaccaagcgcuaccugccugccaucgugcgggaagcuauuaaaagagggcuccgcacacugauccuugccccgacgcggguuguggcugccgagauggaagaggcgcugagaggacuccccauucgcuaucagaccccugccauccgggcugagcacacaggcagagaaauugucgaccugaugugucaugccaccuuuaccaugcggcuccugucccccgugcgcguuccuaacuacaaucuuaucaucauggaugaggcucacuucacagaccccgccucuauugccgcuagaggguauaucagcacgcggguggaaaugggcgaggcggccggaauuuuuaugaccgcuacaccgccuggcucccgcgaucccuucccccaaagcaacgccccuaucauggacgaggaaagagagauucccgaacggucuuggaacuccgggcacgagugggucaccgauuuuaagggaaagacagugugguucguuccuagcaucaaagccggcaacgacaucgcugccugccugagaaagaaugggaaaaaggugauucagcugucucgcaaaaccuuugauagcgaauacgucaagacgcgggcgaacgacugggauuucguggugacaaccgacaucuccgagaugggagcuaauuuuagagccgagcgcgucauugauccgcggagauguaugaagcccguuauccucaccgacggcgaggaacgcgugauucuggccgggccuaugcccgugacacauucuagcgcugcccagcggagaggccgcaucggaagaaacccuaaaaaugaaaacgaccaauauaucuacaugggcgagccccuugaaaaugaugaggacugcgcgcacuggaaggaggccaaaaugcugcucgauaacauuaauaccccggaagggaucauuccuuccauguucgagcccgaacgggagaaggucgacgcuaucgauggagaauaccgccugagaggcgaggcccggaaaacauuuguggaccugaugcgcagaggggaucucccuguuuggcuugcuuaucggguggccgcugagggaauuaacuacgccgacagacgcugguguuucgauggcaucaagaauaaccagauucuggaagagaacgucgaaguggagaucuggaccaaagagggggaacggaagaagcugaaacccagauggcucgacgcgcgcaucuauucugauccucuggcccuuaaggaguucaaagaauuugcugccggccggaagucccugacgcucaaucugauuacagagaugggaagacugcccaccuucaugacacagaaagcucgggacgcccucgauaaccuugccguucugcauaccgcugaagugggcgggcgcgcguacaaucacgcccuguccgagcucccggagacgcuggaaacccuucugcuccugacacugcucgcuaccgucacaggaggcaucuuucuuuuccugaugagcgggaagggaauuggcaagaugacccugggcaugugcugcaucauuacagccucuauccuccugugguaugcccagauccaaccucacuggauugcugccuccaucauucuugaguuuuuccugaucgugcuccugauucccgaacccgagaaacagagaaccccucaggacaaccagcugacguacgucgugaucgcgauccucacaguuguggccgcuaccauggccaaugaaaugggguuucuugagaagaccaaaaaggaccugggacugggcagcauuacaacccaagaguccgaaucuaacauccucgauauugaccugcggccggcuagcgccuggacacuuuaugcgguggccacgaccuucgucacacccaugcugcgccauuccaucgaaaauucuagcguuaacgugucccucaccgcuauugccaaucaggcuacagugcugauggggcugggaagaggcuggccucucagcaaaauggauaucggggucccccuucuggccauuggauguuacucucaggugaacccuaucacccugacggcugcccuccugcuucugguugcgcacuacgccaucauuggccccggccuccaggcuaaggccacccgggaagcucaaaagcgcgccgccgcggggaucaugaaaaauccuacaguggacggaauuaccgucaucgaucuggagccgauucccuaugacccuaaguuugaaaaacagcugggccaggugaugcuccuuguccugugcgugacacagguucugaugaugagaaccacgugggcucucugugaggcccugacacuugcuaccgggcccaucuccacacugugggagggaaacccuggccgguucuggaauaccaccaucgccgugagcauggccaacauuuuucgcgggucuuaccucgcuggagccggccugcuguucuccaucaugaagaauacaacgaacaccagacggggcacagggaauauuggagaaacccucggcgagaaauggaaaagcagacuuaacgcgcuggggaagucugaauuucaaaucuauaaaaagagcggcauucaggaggucgaucgcacacuggccaaagagggcaucaagagaggggaaaccgaccaucacgcuguguccagaggaucugccaaacuccgcugguucguugagcggaacauggugacgcccgaaggcaaggucguggaucugggcugcgggagaggaggcuggagcuacuauugugggggacuuaaaaaugugcgcgagguuaagggccugacaaaagggggaccgggccaugaggagccuauccccauguccaccuacggcuggaaccucguccggcugcagagcgggguggacguguucuuuacacccccugagaaaugcgauacacugcucugugacauuggagaauccucucccaauccuaccaucgaggcuggcagaacacuucgcguccugaaccugguugaaaauuggcucaacaauaacacgcaauucugcauuaaggugcugaauccguauaugcccagcgugaucgagaaaauggaaacccuucagcggaaguacgggggagcccuggucagaaacccucucucccgcaauucuacacacgagauguacugggugagcaacgcgaccggcaauauuguuuccucugugaacaugaucagccggaugcugaucaauagauuuacaaugaaacacaagaaggccaccuaugagcccgaugucgaccugggguccggaacgcgcaacauuggcaucgaaaacgagauuccuaaucucgacaucauuggcaaaagaaucgaaaagauuaaacaggagcaugaaaccagcuggcacuacgaucaggaccaucccuauaagacaugggcuuaccacgggucuuaugagaccaaacaaacaggauccgccagcucuauggugaacggcguugugcggcuucugaccaagccgugggaugucgugccuauggugacacagauggcuaugaccgacacgacacccuucgggcagcagcgcgucuuuaaggagaaaguugauaccagaacccaagaaccuaaggagggaaccaagaagcugaugcggaucacggccgaauggcucuggaaagagcugggcaagaagaaaacccccagaauguguacacgggaggaguucacccgcaaggugagauccaaugcugcccuuggggcgaucuuuacagacgagaacaaauggaaaagcgcccgggaagcuguggaggauucucgcuucugggaacuggucgacagagagcggaaucuccaccuggagggaaaaugcgaaaccuguguguacaacaugaugggcaagcgcgagaaaaagcugggcgaauuugggaaggccaaaggauccagagcuauuugguauauguggcucggcgcccgguuccuggaguuugaagcccuuggguuccugaaugaggaucauugguuuagccgcggaaacucccucagcggcguugagggggaaggccugcacaaacuuggauacauccugagagacgugucuaaaaaggagggcggggcgauguacgcugaugacacagccggaugggacacccggauuacgcucgaagaucugaaaaaugaggaaauggucaccaaccauaugaagggcgagcacaagaaacuggccgaggcuaucuucaagcucacauaucagaauaaagugguucgcgugcagagaccuacaccccgggggacagucauggacauuaucagccgcaaggaucagagaggauccggccaaguggggaccuacggccugaacacguucacaaauauggaagcccagcuuauccggcagauggagggagaaggcauuuuuaaaucuauccaacaucugaccguuacagaggagauugcugugcagaacuggcucgccagagucgggcgcgaacggcugagcagaauggcgaucuccggagacgauugcguggucaagccgcuugacgaucgcuucgccucugcucugaccgcccucaaugacaugggcaaggugcggaaagauauucagcagugggagccuagcagaggguggaacgacuggacgcaaguucccuuuugcucccaccacuuccaugaacuggugaugaaggauggacgcguccugguggugcccugucggaaccaggacgagcucaucggcagagcucgcaucucucagggggccggcuggagccugaaagaaaccgcgugccuuggaaaguccuaugcccagauguggacacugauguacuuucaccggagagaucuccgccuggcugccaaugcuauuuguagcgccguuccuucucauugggugccgaccucccggacaaccuggagcauccacgcuaaacacgaguggaugacaaccgaggacaugcuugccgucuggaacagaguguggauucaagaaaaucccuggauggaggacaagacgccuguugaaucuugggaggaagugcccuaucugggcaagcgggaggaucaguggugcgggucccucaucggacugacaagcagagcgaccugggccaaaaacauucagaccgcuaucaaucagguccgcucccugauuggcaacgaggaauacacagacuauaugccuucuaugaagcgguucagaaaagaggaagaggaagccggggugcucugguga

SEQ ID NO: 19929 - RNA, 9876 nt, Artificial Sequence
  derived and/or modified CDS sequence (opt5) from DENV-2__EU569707__SS-prME
accgcgggagugaucauuaugcugauccccacagcuauggccuuccaccucacgaccagaaacggggagccucauaugauugucggacggcaggaaaagggcaagucccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcguggaagcuaagcucacaaacaccaccacagagagccgguguccgacccaaggagagcccucucugaaugaagaacaggacaaacgcuuugugugcaagcauuccauggucgauagaggcuggggcaacggguguggacuguucggcaaagggggaaucguuacaugcgccauguuuacgugcaaaaagaauauggaaggcaaaguggugcucccugagaaccuggaauacaccauugucaucacaccccacagcggggaggagcaugcggugggaaaugacaccggcaagcacggcaaagaaauuaagaucacaccucagucuuccaucaccgaggccgaacuuacgggguauggaaccguuacaauggaguguagcccccggaccggccuggauuucaacgaaauggugcuccugcgcauggaggacaaggcuuggcuuguccacagacagugguuucuggaucucccgcugccuuggcugcccggggccgacacacaaggaucuaauuggauucagaaggagacccucgugacguucaagaacccucaugcuaaaaagcaggacguugugguccugggcucccaggaaggggccaugcacacagcccuuaccggcgcuacagagauccaaaugagcuccggaaaucugcucuuuaccggccaucugaaaugccggcuuagaauggauaagcugcagcucaaagggaugucuuacagcauguguaccggaaaguucaagauugugaaagaaaucgcggagacacagcacggcacgauugucauccgcgugcaauaugagggggacggaucccccugcaagauccccuucgaaauuauggaucuggagaaacggcauguucugggcagacucaucaccgugaacccuauugucgccgaaaaggacagcccggugaacaucgaggcugaacccccuuuuggggauucuuacauuaucauuggcguugagcccggacagcugaaacuuaauugguucaagaagggcuccagcaucgggcagauguuugagacaaccaugcgcggagccaaacggauggccauccugggcgacacagcuugggauuucgggucucucggaggcguguuuaccagcauugggaaggcccugcaccaggucuucggcgcgaucuacggagcugccuuuuccggcgugucuuggacgaugaaaauucugaucggggugauuaucacauggaucggaaugaacagcagauccaccagccuuucuguuucccucguccuggugggcguggucacccuguaucucggggccauggugcaagcugacagcggauguguugugucuuggaaguccaaagaacugaagugcggcagcgggauuuucaucacagauaauguccacaccuggacagagcaguacaaguuucagccugaaucccccucuaaacuugccagcgcuauucagaaggcccaugaggaaggcaucuguggaauuagauccgugacgcggcuggagaaccucauguggaaacaaaucaccccggagcugaaucacauccugucugaaaacgagguuaaacuuacaauuaugaccggcgacaucaaagggauuaugcaggcgggaaagagaagccuccgcccucagcccacagaacugaaauauuccuggaagaccuggggcaaggccaaaaugcugagcacggagucucauaaucagaccuuccucaucgaugggccugaaacagcugagugccccaacaccaaucgggccuggaacucccuggagguggaagacuacggauuuggcgucuucacaaccaauauuuggcuuaagcugagagagaaacaagacguguuuugugauagcaagcucaugucugcugccaucaaagacaaccgcgcgguucacgccgauaugggcuauuggaucgaauccgcucugaaugacacauggaagauggagaaggccagcuucauugaggugaaaucuugccacuggccuaagagccauacccugugguccaacgggguccuugaaagcgagaugaucauucccaaaaauuucgcuggaccggugucucagcacaacuaccggccuggcuaucauacgcagacagccgggcccuggcaccucggaaagcuggaaauggauuuugacuucugugagggcaccaccguggucguuacagaagauugcgggaacagaggacccucccugcggaccacgacagccagcggcaaacucaucaccgaguggugcugucgcuccugcacacugccuccgcuuagauaccggggcgaggacggguguugguacggaauggaaauuagaccccugaaggagaaggaagagaaucucgugaacucucuggugaccgcuggccaugggcagaucgauaauuuuagccugggaguccuuggcauggcccucuuccuggaagagaugcugcgcacacggguggggaccaaacacgccaugcuccugguugcuguguccuuugucacgcuuauuaccggaaacaugucuuucagagaccugggccgcgugaugguuauggugggcgccacaaugaccgaugacaucgggaugggaaucacauaucucgcccugcuggcugccuuuaaggucagaccuaccuucgcggcuggccuucugcuccggaaacugacgagcaaggagcucaugauggccacaauugggaucgcccugcuuucccaaucuaccauucccgaaacaauccuggagcucaccgaugcucuggcccugggaaugauggugcuuaaaauuguucgcaauauggaaaaguaccagcuggcggugaccaucauggcuaucagcugcgucccuaacgccgugauucuccagaaugccuggaagguguccuguacaauccuggcugccgucagcguuucuccccuccugcuuacguccagccaacagaaagcugacuggauuccucuggcccucaccaucaagggccugaaccccacagcgauuuuucugaccacacuuucuagaaccuccaaaaagcggagcuggccgcugaaugaggccaucauggcuguggggauggugucuauccucgccuccagccugcucaaaaacgacauuccuaugacgggaccccuggucgcuggcggccuucugacagugugcuauguucugaccgggcgcuccgccgaucucgaacuggagagagccgcugacgugaagugggaggaucaggcggaaaucagcggaucuagcccuauucuuuccaucaccauuucugaggacggcagcauguccaucaaaaaugaagaggaggaacagacacugaccauucucauccggacagggcugcucgucaucucuggaguguuccccguuagcauuccgaucacggccgcugccugguaccugugggaggugaagaagcaacgcgccggcguccuuugggaugugccuucucccccucccgucgggaaagcugaacuggaggacggagccuauagaauuaagcagcggggcauccugggcuacagccagauuggggcgggaguguauaaagaaggcaccuuucacacaauguggcauguuacccgcggggcugugcucaugcacagaggaaagcggaucgagcccagcugggccgaugucaaaaaggaccugaucuccuacggcgggggauggaaacuugagggcgaauggaaagagggcgaagaggugcagguucuggcccucgaaccugggaagaacccgagagcugugcaaacaaaacccggacuguucaagaccaauacgggcaccauuggggccgucagccucgauuuuucuccuggaacauccggcagccccaucguggaccgcaaagggaaggugguuggacuguacggcaacggcgucgugacccggucuggggcguauguguccgcuauugcccagacagaaaagagcaucgaggauaauccugaaauugaggacgauaucuuccgcaagaagcgccuuaccaucauggaccugcaucccggagccggcaaaacaaagcgguaccugccugcuauugucagagaagccaucaaacgcgggcuccggacgcugauucuugcuccgaccagagugguugccgcggagauggaagaggcccugcgcggacuccccauccgguaucagaccccugcuauuagagccgagcacaccggccgggaaaucguggaccugaugugucaugcuaccuucacaaugcgccuccugucccccgucagagugccuaacuacaaccuuauuaucauggaugaggcccacuuuacggaccccgccucuaucgcugcgcggggguauauuagcacccgcguugaaaugggcgaggccgcuggaaucuucaugacagccaccccgccuggcuccagagaucccuuuccccagagcaaugccccuauuauggacgaggaacgggagauccccgaaagaucuuggaacuccgggcacgagugggugacagauuucaagggaaagaccgucugguuugugccuagcauuaaagcuggcaaugacaucgccgcgugccugcgcaagaacgggaaaaagguuauccaacugucucggaaaacguucgauagcgaauacgugaagacaagagcuaaugacugggauuuugucgugaccaccgacauuuccgagaugggagccaacuucaaggccgagcgcgugaucgauccgcggagauguaugaaacccgucauucucacagacggcgaagaacgcguuauccuggcugggccuaugcccgugacccauucuagcgccgcgcagcggagaggccgcauuggaagaaauccuaagaacgaaaaugaccaguauaucuacaugggcgagccccuugaaaacgaugaggacugcgcccacuggaaagaggcuaagaugcugcucgauaauaucaacacaccggaagggauuaucccuuccauguuugagcccgaacgggagaaaguggacgccauugauggagaauaccgccugagaggcgaggcucggaagaccuucgucgaccugaugcgcagaggggaucucccuguguggcuugccuaucggguugcugccgagggaaucaauuacgcggacagacgcugguguuuugauggcauuaaaaacaaucaaauccuggaagagaacguggaagucgagauuuggacgaaggagggggaacggaagaaacugaagcccagauggcucgacgcccgcaucuauucugauccucuggcucuuaaagaguucaaggaguucgccgcuggccggaaaagccugacacucaaccugaucaccgagaugggaagacugcccacauuuaugacccagaaggcccgggacgcccucgauaaucuugcugugcugcauacggcggaagccggcgggcgcgcuuacaaccacgcccuguccgagcucccggagacccuggaaacacuucugcuccugacccugcucgccacaguuaccggaggcauuuuccuuuuucugaugagcgggaagggaaucggcaaaaugacacugggcaugugcugcauuaucaccgcuucuauucuccugugguaugcccagauccagccucacuggaucgcggccuccauuauccuugaguucuuucugauugugcuccugauccccgaacccgagaagcaaagaacgccucaggacaaucagcugacauacgucgugauugcuauccucaccgucguggccgcuaccauggccaacgaaaugggguuccuugagaaaacaaagaaagaccugggacugggcagcaucgcgacccaggaguccgaaucuaauauucucgauaucgaccugcggccggccagcgcuuggacacuuuaugccguugcuacgaccuuugugacacccaugcugcgccauuccauugagaacucuagcgugaaugucucccucaccgccaucgcuaaccaagccacaguucugauggggcugggaaagggcuggccucucagcaagauggauauuggggugccccuucuggcgaucggauguuacucucaggugaauccuauuacccugacggccgcucuccugcuucuggucgcccacuacgcuaucaucggccccggccuccaggccaaagccaccagagaagcgcagaagcgggcugccgcugggauuaugaaaaacccuacaguggacggaaucaccguuauugaucuggagccgauccccuaugacccuaaguucgaaaaacaacugggccaggugaugcuccuuauucugugcgucacacaggugcugaugaugcgcaccacgugggcccucugugaggcccugacacuugcuaccgggcccaucuccacacugugggagggaaauccuggcagauuuuggaacaccaccaucgccgucagcauggcgaauauuuuccgggggucuuaccucgccggagcuggccugcuguuuuccaucaugaagaacacaacgaauacccgcagaggcacagggaacauuggagaaacccucggcgagaaguggaaaagccggcuuaaugcccuggggaagucugaguuccagaucuauaaaaagagcggcauucaagagguggauagaacacuggcuaaagagggcaucaagcgcggggaaaccgaccaucacgccguuucccggggaucugcgaaacucagaugguuuguggagcgcaacauggucacgcccgaaggcaaggugguugaucugggcugcgggcggggaggcuggagcuacuauugugggggacuuaagaacgugagagaggucaaaggccugacaaaagggggaccgggccaugaggaaccuauccccauguccaccuacggcuggaaucucgugcgccugcagagcgggguggacguuuucuucacacccccugagaaaugcgauacacugcucugugacauuggagaauccucucccaacccuaccaucgaggccggccggacacuuagaguccugaaucugguggaaaacuggcucaauaacaauacgcaguuuugcauuaaggugcugaacccguauaugcccagcgucaucgagaaaauggaaacccuucaacgcaaguacgggggagcucugguucggaauccucucuccagaaacucuacacacgagauguacugggugagcaaugccaccggcaacauuguguccucugucaauaugaucagccgcaugcugaucaaccgguucacaaugaagcacaaaaaggcuaccuaugagcccgauguggaccugggguccggaacgagaaauauuggcaucgaaagcgagauuccuaaccucgacaucauuggcaaacgcaucgaaaagauuaaacaggagcaugaaaccucuuggcacuacgaucaggaccaucccuauaagacaugggccuaccacggguccuaugagaccaagcagacaggaagcgcuucuuccaugguuaacggcguggucagacuucugaccaaaccgugggaugugguuccuauggugacacaaauggccaugaccgacacgacacccuuugggcagcagcgggucuucaaggagaaaguggauacccgcacccaggaaccuaaggagggaaccaagaagcugaugaagaucacggcggaauggcucuggaaagagcugggcaagaaaaagacccccagaauguguacacgggaggaauuuaccagaaaagugcggagcaaugccgcucuuggggccaucuucacagacgagaacaaguggaaaucugcucgcgaagccgucgaggauuccagauuuugggaacugauugaccgggagcgcaaucuccaccuggagggaaagugcgaaaccuguguuuacaacaugaugggcaagagagagaaaaagcugggcgaguucgggaaagccaagggaagccgggcgaucugguauauguggcucggcgcucgcuuucuggaguucgaagcccuuggguuucugaaugaggaucauugguucuccagaggaaacagccucucuggcguggagggggaaggccugcaccggcuuggauacauucugcgcgacgugagcaaaaaggagggcggggccauguacgcugaugacacagccggaugggacaccagaaucacgcucgaagaucugaagaaugaggaaauggucaccaaccauaugaaaggcgagcacaagaaacuggcugaggccauuuuuaagcucacauaucaaaauaaagugguucgggugcagcgcccuacccccagagggacagucauggacaucaucucccggcgcgaucagagaggaucuggccagguggggaccuacggccugaacacguucacaaauauggaagcgcaacuuauucggcagauggagggagaaggcaucuucaagagcauucagcaucugaccguuacagaggagaucgccgugcaaaacuggcucgcuagagucgggcgcgaacggcuguccagaauggccauuucuggagacgauugcgugguuaagccgcuugacgaucgcuuugcuagcgcccugaccgcgcucaaugacaugggcaaagugcggaaggauauccagcagugggagccuuccagaggguggaacgacuggacgcagguccccuucugcucucaccacuuucaugaacuggugaugaaagauggacgcguccuggugguucccugucggaaucaagacgagcucaucggcagagcccgcauuagccagggggcuggcuggucccugaaggaaaccgccugccuuggaaaaagcuaugcucagauguggacacugauguacuuccaccggagagaucuccgccuggccgcuaacgccaucuguucugcggugccuucccauugggucccgaccagccggacaaccuggucuauucacgccaagcacgaguggaugacaaccgaggacaugcuugcuguguggaacagaguguggauccaggaaaaucccuggauggaggacaagacgccuguugaauccugggaggaagugcccuaucugggcaaacgggaggaucaauggugcgggagccucauuggacugacauccagagccaccugggccaagaacauccagaccgcuauuaaucagguccgcucucugaucggcaacgaggaauacacagacuauaugccuagcaugaaacgguuuagacgcgaggaagaggaagccggggugcucugguga

SEQ ID NO: 19930 - RNA, 9876 nt, Artificial Sequence
  derived and/or modified CDS sequence (opt5) from DENV-2__EU660399__SS-prME
accgcgggagugaucauuaugcugauccccaccgcuauggccuuccaccucacgacccggaacggggagccucauaugauugucggacggcaggaaaagggcaagucccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagacccggacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggagugcuuggcauggcccucuuccuggaagagaugcugagaacacgcgucgggaccaaacacgccaugcuccugguggcuguuuccuuugugacgcuuaucaccggaaacaugucuuuccgggaccugggcagagucauggugaugguuggcgccacaaugaccgaugacaucgggaugggaauuacauaucucgcccugcuggcugccuuuaaggugcgcccuaccuucgcggcuggccuucugcucagaaaacugacgagcaaggagcucaugauggccacaaucgggauugcccugcuuucccagucuaccauccccgaaacaauucuggagcucaccgaugcucuggcccugggaaugaugguccuuaaaaucgugcggaauauggaaaaguaccagcuggcgguuaccaucauggcuauuagcugcgugccuaacgccgucauccuccaaaaugccuggaagguguccuguacaauucuggcugccgugagcgucucuccccuccugcuuacguccagccagcagaaagcugacuggaucccucuggcccucaccauuaagggccugaaccccacagcgaucuuucugaccacacuuucucgcaccuccaaaaagagaagcuggccgcugaaugaggccguuauggcuguggggauggugucuauccucgccuccagccugcucaaaaacgacauuccuaugacgggaccccuggucgcuggcggccuucugacagugugcuauguucugaccgggcgguccgccgaucucgaacuggagcgcgccgcugacgugaagugggaggaucaggcggaaaucagcggaucuagcccuauucuuuccaucaccauuucugaggacggcagcauguccaucaaaaaugaagaggaggaacaaacacugaccauucucaucagaacagggcugcucgucaucucuggaguguuccccguuagcauuccgaucacggccgcugccugguaccugugggaggugaagaagcagcgggccggcguccuuugggaugugccuucucccccucccgucgggaaagcugaacuggaggacggagccuaucgcauuaagcagagaggcauccugggcuacagccagauuggggcgggaguguauaaagaaggcaccuuucacacaauguggcauguuaccagaggggcugugcucaugcaccgcggaaagagaaucgagcccagcugggccgaugucaaaaaggaccugaucuccuacggcgggggauggaaacuugagggcgaauggaaagagggcgaagaggugcaaguucuggcccucgaaccugggaagaacccgcgggcugugcagacaaaacccggacuguucaagaccaauacgggcaccauuggggccgucagccucgauuuuucuccuggaacauccggcagccccaucguggacagacaggggaaagugguuggacuguacggcaacggcgucgugacccgcucuggggcguauguguccgcuauugcccagacagaaaagagcaucgaggauaauccugaaauugaggacgauaucuuccggaagaaaagacuuaccaucauggaccugcaucccggagccggcaagaccaagaaguaccugccugcuauuguccgcgaagccaucaaacgggggcucagaacgcugauucuugcuccgacccgcgugguugccgcggagauggaagaggcccugcggggacuccccaucagauaucaaaccccugcuauucgcgccgagcacaccggccgggaaaucguggaccugaugugucaugcuaccuucacaaugagacuccugucccccguccgggugccuaacuacaaccuuauuaucauggaugaggcccacuuuacggaccccgccucuaucgcugcgcgcggguauauuagcaccagaguugaaaugggcgaggccgcuggaaucuucaugacagccaccccgccuggcucccgggaucccuuuccccagagcaaugccccuauuauggacgaggaacgcgagauccccgaaagaucuuggaacuccgggcacgagugggugacagauuucaagggaaagaccgucugguuugugccuagcauuaaagcuggcaaugacaucgccgcgugccugcggaagaacgggaaaaagguuauccagcugucuagaaaaacguucgauagcgaauacgugaagacacgcgcuaaugacugggauuuugucgugaccaccgacauuuccgagaugggagccaacuucaaggccgagcgggugaucgauccgagacgcuguaugaaacccgucauucucacagacggcgaagaacggguuauccuggcugggccuaugcccgugacccauucuagcgccgcgcaaagacgcggccggauuggaagaaauccuaagaacgaaaaugaccaguauaucuacaugggcgagccccuugaaaacgaugaggacugcgcccacuggaaagaggcuaagaugcugcucgauaauaucaacacaccggaagggauuaucccuuccauguuugagcccgaacgcgagaaaguggacgccauugauggagaauacagacugcggggcgaggcucgcaagaccuucgucgaccugaugagaagaggggaucucccuguguggcuugccuaucgcguugcugccgagggaaucaauuacgcggacagacggugguguuuugauggcauuaaaaacaaucagauccuggaagagaacguggaagucgagauuuggacgaaggagggggaaagaaagaaacugaagccccgcuggcucgacgcccggaucuauucugauccucuggcucuuaaagaguucaaggaguucgccgcuggcagaaaaagccugacacucaaccugaucaccgagaugggacgccugcccacauuuaugacccagaaggcccgggacgcccucgauaaucuugcugugcugcauacggcggaagccggcgggagagcuuacaaccacgcccuguccgagcucccggagacccuggaaacacuucugcuccugacccugcucgccacaguuaccggaggcauuuuccuuuuucugaugagcgggaagggaaucggcaaaaugacacugggcaugugcugcauuaucaccgcuucuauucuccugugguaugcccaaauccagccucacuggaucgcggccuccauuauccuugaguucuuucugauugugcuccugauccccgaacccgagaagcagcggacgccucaggacaaucaacugacauacgucgugauugcuauccucaccgucguggccgcuaccauggccaacgaaaugggguuccuugagaaaacaaagaaagaccugggacugggcagcaucgcgacccaggaguccgaaucuaauauucucgauaucgaccugcgcccggccagcgcuuggacacuuuaugccguugcuacgaccuuugugacacccaugcugagacauuccauugagaacucuagcgugaaugucucccucaccgccaucgcuaaccaggccacaguucugauggggcugggaaagggcuggccucucagcaagauggauauuggggugccccuucuggcgaucggauguuacucucaggugaauccuauuacccugacggccgcucuccugcuucuggucgcccacuacgcuaucaucggccccggccuccaagccaaagccacccgggaagcgcagaagcgcgcugccgcugggauuaugaaaaacccuacaguggacggaaucaccguuauugaucuggagccgauccccuaugacccuaaguucgaaaaacagcugggccaggugaugcuccuuauucugugcgucacacaagugcugaugaugagaaccacgugggcccucugugaggcccugacacuugcuaccgggcccaucuccacacugugggagggaaauccuggccgguuuuggaacaccaccaucgccgucagcauggcgaauauuuuccgcgggucuuaccucgccggagcuggccugcuguuuuccaucaugaagaacacaacgaauaccagacggggcacagggaacauuggagaaacccucggcgagaaguggaaaagccgccuuaaugcccuggggaagucugaguuccagaucuauaaaaagagcggcauucaggagguggauagaacacuggcuaaagagggcaucaagagaggggaaaccgaccaucacgccguuuccagaggaucugcgaaacuccgcugguuuguggagcggaacauggucacgcccgaaggcaaggugguugaucugggcugcgggagaggaggcuggagcuacuauugugggggacuuaagaacgugcgcgaggucaaaggccugacaaaagggggaccgggccaugaggaaccuauccccauguccaccuacggcuggaaucucgugcggcugcaaagcgggguggacguuuucuucacacccccugagaaaugcgauacacugcucugugacauuggagaauccucucccaacccuaccaucgaggccggcagaacacuucgcguccugaaucugguggaaaacuggcucaauaacaauacgcaguuuugcauuaaggugcugaacccguauaugcccagcgucaucgagaaaauggaaacccuucagcggaaguacgggggagcucugguuagaaauccucucucccgcaacucuacacacgagauguacugggugagcaaugccaccggcaacauuguguccucugucaauaugaucagccggaugcugaucaacagauucacaaugaagcacaaaaaggcuaccuaugagcccgauguggaccugggguccggaacgcgcaauauuggcaucgaaagcgagauuccuaaccucgacaucauuggcaaacggaucgaaaagauuaaacaggagcaugaaaccucuuggcacuacgaucaagaccaucccuauaagacaugggccuaccacggguccuaugagaccaagcagacaggaagcgcuucuuccaugguuaacggcguggucagacuucugaccaaaccgugggaugugguuccuauggugacacagauggccaugaccgacacgacacccuuugggcagcaacgcgucuucaaggagaaaguggauaccagaacccaggaaccuaaggagggaaccaagaagcugaugaagaucacggcggaauggcucuggaaagagcugggcaagaaaaagacaccccggauguguacacgcgaggaauuuaccagaaaagugcggagcaaugccgcucuuggggccaucuucacagacgagaacaaguggaaaucugcuagagaagccgucgaggauucccgguuuugggaacugauugaccgcgagagaaaucuccaccuggagggaaagugcgaaaccuguguuuacaacaugaugggcaagcgggagaaaaagcugggcgaguucgggaaagccaagggaagccgcgcgaucugguauauguggcucggcgcuagauuucuggaguucgaagcccuuggguuucugaaugaggaucauugguucucccggggaaacagccucucuggcguggagggggaaggccugcaccgccuuggauacauucugagagacgugagcaaaaaggagggcggggccauguacgcugaugacacagccggaugggacacccggaucacgcucgaagaucugaagaaugaggaaauggucaccaaccauaugaaaggcgagcacaagaaacuggcugaggccauuuuuaagcucacauaucagaauaaagugguucgcgugcagagaccuacaccccgggggacagucauggacaucaucucccgcagagaucaacggggaucuggccagguggggaccuacggccugaacacguucacaaauauggaagcgcagcuuauucgccaaauggagggagaaggcaucuucaagagcauucagcaucugaccguuacagaggagaucgccgugcagaacuggcucgcuagagucgggcgggaaagacugucccgcauggccauuucuggagacgauugcgugguuaagccgcuugacgaucgguuugcuagcgcccugaccgcgcucaaugacaugggcaaagugagaaaggauauccagcaaugggagccuucccgcggguggaacgacuggacgcagguccccuucugcucucaccacuuucaugaacuggugaugaaagauggacggguccuggugguucccuguagaaaucaggacgagcucaucggccgcgcccggauuagccagggggcuggcuggucccugaaggaaaccgccugccuuggaaaaagcuaugcucaaauguggacacugauguacuuccacagacgcgaucuccggcuggccgcuaacgccaucuguucugcggugccuucccauugggucccgaccagcagaacaaccuggucuauucacgccaagcacgaguggaugacaaccgaggacaugcuugcuguguggaaccgcguguggauccaggaaaaucccuggauggaggacaagacgccuguugaauccugggaggaagugcccuaucugggcaaacgggaggaucaguggugcgggagccucauuggacugacauccagagccaccugggccaagaacauccagaccgcuauuaaucaaguccggucucugaucggcaacgaggaauacacagacuauaugccuagcaugaaaagauuucgccgggaggaagaggaagccggggugcucugguga

SEQ ID NO: 19931 - RNA, 9876 nt, Artificial Sequence
  derived and/or modified CDS sequence (opt5) from DENV-2__EU569708__SS-prME
accgcgggcgugaucauuaugcugauccccaccgcuauggccuuccaccucacgacccggaauggggaaccucauaugauugucggacggcaggaaaagggcaagagccugcuuuuuaagacagaagacgggguuaauaugugcacccugauggcgaucgaucucggagaacugugugaggacaccauuaccuacaagugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaagggggaaucgugaccugcgcgauguuuacaugcaaaaagaauauggaaggcaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggagaaagccuggcuuguucaccgccaaugguuucuggaccucccgcugccuuggcugcccggggcugauacccagggaucuaauuggauucagaaggaaacacucgugaccuucaagaacccucaugccaaaaagcaggacgucgugguucugggcucccaagagggggccaugcacacggcucuuacaggcgcgaccgaaauccagaugagcuccggaaaucugcucuuuacaggccaucugaaaugcagacuucggauggacaagcugcagcucaaagggaugucuuacagcauguguaccggaaaguucaagauugugaaagagaucgccgagacccaacacggcacaaucgucauuagagugcaguaugaaggggauggaucccccugcaagauccccuucgagauuauggaccuggaaaaacgccauguccugggccggcucaucacggugaacccuauuguuaccgagaaggauagcccggugaacaucgaagcugagcccccuuuuggggacucuuacauuaucaucggcgucgagcccggacagcugaaacuuaauugguucaagaagggcuccagcauugggcagauguuugaaacaaccaugagaggagccaaacgcauggccauccugggcgauacagcuugggacuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggccauggugcaggcugauagcggaugugucgugucuuggaagaauaaagagcugaagugcggcuccgggauuuucaucacagacaacguucacaccuggacagaacaguacaaguuucagccugagagccccuccaaacuugccucugcuauucaaaaggcccaugaagagggcaucuguggaaucagaagcgugacgcgccuggagaaucucauguggaaacagauuaccccggaacugaaccacauccuguccgagaaugaagucaaacuuacaauuaucaccggcgauauuaaagggaucaugcaggcgggaaagcggucucucagaccucagcccacagagcugaaauauagcuggaagaccuggggcaaggccaaaaugcuguccacggaaagccauaaccaaaccuuccucaucgacgggccugagacagcugagugccccaauaccaaccgcgccuggaacucucuggaaguggaggauuacggauuuggcguuuucacaaccaacauuuggcuuaagcugcgggaaaaacaggacguguuuugugacuccaagcucaugagcgcugccaucaaagauaauagagcgguccacgccgacaugggcuauuggauugagucugcucugaacgauacauggaagauggagaaggccuccuucaucgaagugaaaagcugccacuggccuaagucucauacccuguggagcaaugggguucuugaguccgaaaugauuauccccaaaaacuucgcuggaccggugagccagcacaacuaccgcccuggcuaucauacgcagacagccgggcccuggcaccucggaaagcuggagauggacuuugauuucugugaaggcaccaccgucguggugacagaggacugcgggaaucggggacccucucugagaaccacgacagccuccggcaaacucauuaccgaguggugcugucggagcugcacacugccuccgcuucgcuacagaggcgaagauggguguugguacggaauggagauccggccccugaaggaaaaggaggaaaaccucgucaauucccugguuaccgcuggccaugggcaaaucgacaacuuuucucugggagugcuuggcauggcccucuuccuggaggagaugcugagaacacgcguggggaccaaacacgccauucuccuggucgcugugagcuuuguuacgcuuaucaccggaaauauguccuuccgggaucugggcagagugauggucauggugggcgccacaaugaccgacgauauugggaugggaguuacauaucucgcccugcuggcugccuuuaaggugcgcccuaccuucgcggcuggccuucugcucagaaaacugacgucuaaggaacucaugauggccacaaucgggauugcccugcuuagccaguccaccauccccgagacaauccuggaacucaccgacgcucuggcccugggaaugaugguccuuaaaauugugcggaacauggagaaguaccagcuggcgguuaccaucauggcuauuucuugcgugccuaaugccgucauccuccugaacgccuggaaggugagcuguacaauucucgcugccguguccgucagcccccugcuucugacgucuucccaacagaaaaccgauuggaucccucucgcucugacaaucaagggccugaaucccaccgccauuuuucuuacaacccugagccgcacgucuaaaaagagauccuggccgcucaacgaagcgguuauggccguggggauggugagcauccuggcuucuucccuccugaaaaaugacauuccuaugacaggaccccuugucgccggcggccugcugaccgugugcuauguucucaccgggcggagcgcugaccuggagcuugagcgcgccgccgaugugaagugggaagaccaggcugagaucuccggaagcucuccuauucugagcgucacaaucuccgaagauggcucuaugagcauuaaaaacgaggaggaagaacagacccucacaauccugaucagaacggggcuccuggugauuuccggaguuuuccccgugucuaucccgauuaccgcggccgcuugguaccuuugggaagucaagaagcaacgggccggcgugcugugggacgucccuucucccccucccguggggaaagccgagcuggaagauggagcuuaucgcaucaagcagagaggcauucucggcuacucccagaucggggccggaguuuauaaagagggcacauuucacaccauguggcaugugacaagaggggcgguccugaugcaccgcggaaagagaaucgagcccuccugggcugacgugaaaaaggaucuuauuagcuacggcgggggauggaagcuggaaggcgaguggaaagaaggcgaggaaguucaggugcucgcccuggagccugggaagaauccgcgggccguccaaaccaaacccggacucuucaagacgaacaccggcacaaucggggcugugucccuggacuuuagcccuggaaccucuggcucccccauuguggauagaaaagggaagguugucggacuuuacggcaauggcguggugacacgcagcggggccuaugucucugcgaucgcucagaccgagaaguccauugaagacaacccugagaucgaagaugacaucuuccggaaaaagagacugacaauuauggaucugcaucccggagccggcaaaacgaagcgcuaccucccugccaucgugcgggaggcuauuaaaagagggcugcgcacccuuauccuggccccgacacggguuguggcugccgaaauggaggaggcgcucagaggacugcccauucgcuaucagaccccugccauccgggcugaacacaccggcagagagauugucgaccucaugugucaugccacauucacgaugcggcugcuuagccccgugcgcguuccuaacuacaaucugaucaucauggacgaagcucacuuuaccgaucccgccuccauugccgcuagaggguauaucucuacacggguggagaugggcgaggcggccggaauuuucaugaccgcuacaccgccuggcagccgcgaccccuuuccccaguccaacgccccuaucauggaugaagagagagaaauucccgagcggagcuggaacucugggcacgaaugggucaccgacuucaagggaaagacggugugguuuguuccuuccaucaaagccggcaacgauaucgcugccugccugagaaagaaugggaaaaaggugauucaacucagccgcaaaacauucgacucugaguacgucaagacccgggcgaacgauugggacuuuguggugaccacagauaucagcgagaugggagcuaauuucagagccgaacgcgucauugacccgcggagauguaugaagcccguuauccugaccgauggcgaggaacgcgugauucuugccgggccuaugcccgugacacauuccucugcugcccagcggagaggccgcaucggaagaaacccuaaaaaugagaacgaccaguauaucuacaugggcgaaccccuggagaaugacgaggauugcgcgcacuggaaggaagccaaaaugcuccuggacaacauuaauaccccggaggggaucauuccuagcauguuugaacccgagcgggaaaaggucgaugcuaucgacggagaguaccgccugagaggcgaggcccggaaaacguucguggaucucaugcgcagaggggaccuuccuguuuggcuggcuuaucggguggccgcugaaggaauuaacuacgccgauagacgcugguguuuugacggcaucaagaauaaccaaauucuggaggaaaacgucgagguggagaucuggacaaaagaaggggagcggaagaagcucaaacccagauggcuggaugcgcgcaucuauuccgacccucuugcccugaaggaguucaaagaguucgcugccggccggaagucucucacccugaaucugauuacagaaaugggaagacuccccaccuuuaugacgcagaaagcucgggaugcccuugacaaccuggccguucugcauaccgcugaggcgggcgggcgcgccuacaaucacgcucucagcgagcugccggaaacacuugagacccugcuccugcugacacuccuugccaccgugacaggaggcaucuuccuguuucugauguccgggaagggaauuggcaagaugacccucggcaugugcugcaucauuacggccagcauccugcuuugguaugcucagauccagccucacuggauugccgcgucuaucauucuggaguucuuucucaucguccugcugauucccgagcccgaaaaacaaagaacaccucaggauaaccagcucaccuacguggucaucgccauccuuaccgugguugcugccacaauggcuaaugagaugggguuccuggagaagaccaaaaaggaccugggacucggcuccauuacaacgcaggaaagcgaguccaacauccuggacauugaucuucggccggccucugcguggacccuguaugccguggcuacaaccuuugugacacccaugcuccgccauagcaucgaaaauuccucugucaacguuagccugaccgccauugcuaaucaagccacggugcugauggggcucggaaaaggcuggccucuuuccaagauggacaucggggugccccugcuggcuauuggauguuacagccaggucaacccuaucacccucacagccgcgcugcuucugcucguggcccacuacgcuaucauuggccccggccugcaggccaaggcuaccagagaggcccagaaacgggccgcggcugggaucaugaagaauccuacaguugauggaauuaccgugaucgaccuggaaccgauucccuaugauccuaaauucgagaagcaacucggccaggucaugcuucugauccugugcgugacgcagguccucaugaugcgcacaaccugggcccugugugaggcucuuacacuggccaccgggcccaucucuacccucugggaaggaaacccuggcagauuuuggaauacaacgauugccguguccauggcuaacaucuuccgggggagcuaccuggccggagcgggccugcucuuuucuauuaugaaaaauaccacaaacacccgcagaggcacagggaauaucggagagacccuuggcgaaaaguggaagucccggcugaacgcccuggggaaaagcgaguuccagauuuauaagaaaucuggaauccaagagguugacagaacgcucgcuaaggaaggcaucaaacgcggggagacagaucaucacgccgugagccggggauccgcuaagcugagaugguuugucgaacgcaacauggugacccccgagggcaaaguuguggaccuuggcugcgggcggggaggcuggucuuacuauugugggggacugaagaaugucagagaagugaagggccucaccaaagggggaccgggccaugaggagccuauucccaugagcacauacggcuggaaccuggugcgccugcaguccgggguugaugucuucuucacacccccugaaaagugcgacacacuccuuugugauaucggagagagcucccccaauccuacgauugaagccggccggacccugagagugcugaaccucguggagaauuggcugaacaauaacacacaguuuugcaucaaaguccuuaauccguauaugcccucuguuauugaaaagauggagacccugcaacgcaaauacgggggagcgcucgugcggaacccucugagcagaaauuccacacacgagauguacugggugucuaacgccaccggcaauaucgucagcuccgugaacaugaucucucgcaugcugauuaaucgguucacgaugaagcacaagaaagcuaccuaugaacccgacguugaucucgggagcggaacaagaaacaucggcauugaguccgaaaucccuaaccuugacauuaucggcaagcgcauugagagaaucaaacaggaacaugagaccagcuggcacuacgaccaggaucaucccuauaagacaugggccuaccacgggucuuaugagaccaaacagacaggauccgcuagcucuauggugaauggcgucgugcggcugcugaccaagccgugggacguugugccuauggucacgcaaauggccaugacagauaccacccccuuugggcagcagcgcguguucaaggaaaaaguggacacaagaacgcaggagccuaaggaaggaaccaaaaagcucaugcggaucacagcugaguggcuguggaaagagcuuggcaagaagaaaacccccagaauguguacacgggaagaguuuacccgcaaggucagauccaacgccgcgcugggggccguuuucacagaugaaaauaaauggaaaagcgcucgggaggccguggaagacucucgcuuuugggagcucguggauagagagcggaaccugcaccuggaaggaaaaugcgagaccugugucuacaauaugaugggcaagcgcgagaagaagcucggcgaguucgggaaggcuaaaggauccagagccauuugguauauguggcugggcgcccgguuucuugaguucgaggcgcugggguuucucaacgaggaccauugguucagccgcagaaauucccugagcggaguggaaggcgaggggcuucaccggcugggcuacauccuccgcgauguuucuaagaaagaaggaggcgcuauguacgccgacgauacggccgggugggacaccagaauuacacuggaggaccugaagaacgaagagauggugaccaaucauaugaaaggagagcacaagaagcucgcugaagccaucuuuaaacugacauaucaaaacaaggucgugcggguucagcgcccuacccccagaggcacggugauggauauuaucagccggagagaccagcgcggguccggacaggucggcacauacgggcuuaauaccuucacaaacauggaggcucaacugauccggcagauggaaggcgagggaauuuucaaaucuauccagcaucucaccgugacggaggaaauugccguucaaaauuggcuggcgagagugggccgcgagcggcuuagcagaauggccaucuccggggaugacugcgucgugaagccgcuggaugaccgcuuugcuucugcccucaccgcucugaacgauaugggaaaaguccggaaggacauucagcagugggaaccuagcagaggcuggaaugauuggacacaggugcccuucugcucccaccacuuucaugagcugguuaugaaggacgggcgcgugcucgucgugcccugucggaaccaagaugaacugaucggcagagcccgcaucucucagggagcgggguggagccuuaaagagaccgccugccugggcaaguccuaugcucagauguggacacucauguacuuccaccggagagaccugcggcuugccgcuaacgccauuuguagcgcugugccuucucauuggguuccgaccuccagaacaaccuggagcauccacgccaaacacgaguggaugacgacagaagauaugcuggcgguguggaaucgcgucuggauucaggagaaccccuggauggaagacaagaccccuguggagucuugggaagagguucccuaucucggaaaacgggaggaccaauggugcggcucccugaucgggcugaccagcagagccacaugggcuaagaauauucagaccgccaucaaccaggugcgcucccucauuggaaaugaagaguacacagauuauaugccuucuaugaagagauuucggcgcgaagaggaagaggccggcguccugugguga

SEQ ID NO: 19932 - RNA, 9876 nt, Artificial Sequence
  derived and/or modified CDS sequence (opt5) from DENV-2__EU569709__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgcuacguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaucaaguuuucggcgccaucuauggagcggcuuuuuccggcgugucuuggacaaugaaaauucugaucggggucaucauuaccuggaucggaaugaacagccgguccaccagccuuucugugucccucgugcugguuggcgucgugacacuguaccucggggugaugguccaggccgacagcggaugugugguuucuuggaagaauaaagaacugaagugcggcuccgggauuuucaucaccgauaacgugcacacauggacggagcaguauaaguuucagccugaaagccccuccaaacuugccucugcuauucaaaaggcccacgaggaaggcaucuguggaaucagaagcgucacccgccuggagaaucucauguggaaacagauuacaccggagcugaaccauauccuguccgaaaaugaggugaaacuuaccauuaugacaggcgacaucaaagggauuaugcaggcuggaaagcggucucucagaccucagcccaccgaacugaaauacagcuggaagacguggggcaaggccaaaaugcuguccaccgagagccacaaccaaacauuccucaucgaugggccugaaaccgcggagugccccaauacaaaccgcgccuggaacucucuggagguugaagacuauggauuuggcguguucuccaccaacaucuggcuuaagcugcgggagaaacaggacgucuuuugugauagcaagcucaugucugcugccauuaaagacaauagagcugugcaugccgauaugggcuacuggaucgaauccgcgcugaacgacacauggaagauggagaaggccagcuucauugagguuaaaucuugccacuggccuaagagccacacccugugguccaauggggugcuugaaagcgagaugaucauucccaaaaacuucgcuggaccggucucucagcauaacuaucgcccuggcuaccacacgcagacagccgggcccuggcaucucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguauggaauggaaauucggccccugaaggagaaggaagagaaccucguuaauucucuggugaccgccggccacgggcaaaucgauaacuuuagccugggagugcuuggcauggcccucuuccuggaagagaugcugagaacacgcgucgggaccaaacaugcuauccuccugguggcgguuuccuuugugacgcuuauuaccggaaauaugucuuuccgggaccugggcagagucauggugaugguuggcgccacaaugaccgaugacaucgggaugggagugacauaccucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaucagcuggcugugaccauuauggccauccucugcgucccuaaugcggugauucugcaaaacgcuuggaaggugagcuguacaauccucgccgccgucuccguuagcccccugcuucugacgucuucccagcagaaagcugacuggauuccucucgcccugaccaucaagggccugaaucccacagcuaucuuucuuaccacacugagccgcaccucuaaaaagagauccuggccgcucaacgaggccgugauggcgguggggauggucagcauucuggccucuucccuccugaaaaaugacaucccuaugacgggaccccuuguggcuggcggccugcugacaguuugcuacgugcucaccgggcggagcgccgaucuggaacuugagcgcgcugccgacgucaagugggaggaucaggccgaaauuuccggaagcucuccuauccugagcauuaccaucuccgaggacggcucuaugagcauuaaaaacgaagaggaggaacaaacacucaccauccugaucagaacagggcuccuggugauuuccggaguuuuccccgugucuaucccgauuacggcugcggccugguaucuuugggaggucaagaagcagcgggcuggcgugcugugggaugucccuucucccccucccguggggaaagccgaacuggaggacggagccuaccgcaucaagcagagaggcauuuuuggcuauucccagaucggggcuggaguuuacaaagaaggcaccuuccacacaauguggcacgugaccagaggggccguccucaugcaucgcggaaagagaaucgagcccuccugggcggaugugaaaaaggaccugauuagcuacggcgggggauggaaacuugagggcgaauggaaagagggcgaagagguucaagugcuggcucucgaaccugggaagaauccgcgggccguccagacaaaacccggacuguuuaagaccaacacgggcaccaucggggccgugucccucgauuucagcccuggaacaucuggcucccccauuguggacagaaaagggaagguugucggacuguauggcaauggcguggugacccgcagcggggcuuacgucucugccaucgcgcagacagagaaguccauugaggauaacccugaaaucgaggacgauaucuuccggaaaaagagacuuaccauuauggaccugcaccccggagcuggcaaaacaaagcgcuaucugccugccaucgugcgggaagccauuaaaagagggcuccgcacgcugauccuugcuccgacccggguuguggccgcugagauggaagaggcccugagaggacuccccauucgcuaccagaccccugcgauccgggccgagcauaccggcagagaaauugucgaccugaugugucacgcuaccuuuacaaugcggcuccugagccccgugcgcguuccuaacuauaaucuuaucaucauggaugaggcccauuucacggaccccgcuuccauugccgccagaggguacaucucuacccggguggaaaugggcgaggcugcgggaauuuuuaugacagccaccccgccuggcagccgcgaucccuucccccaauccaacgcuccuaucauggacgaggaaagagagauucccgaacggagcuggaacucugggcacgagugggucacagauuuuaagggaaagaccgugugguucguuccuuccaucaaagccggcaacgacaucgccgcuugccugagaaagaaugggaaaaaggugauucagcugagccgcaaaacguuugauucugaauaugucaagacacgggccaacgacugggauuucguggugaccaccgacaucagcgagaugggagcgaauuuuagagcugagcgcgucauugauccgcggagauguaugaagcccguuauccucacagacggcgaggaacgcgugauucuggccgggccuaugcccgugacccacuccucugccgcucagcggagaggccgcaucggaagaaacccuaaaaaugaaaacgaccaauacaucuacaugggcgagccccuugaaaaugaugaggacugcgcccauuggaaggaggcgaaaaugcugcucgauaacauuaauacaccggaagggaucauuccuagcauguucgagcccgaacgggagaaggucgacgccaucgauggagaauaucgccugagaggcgaggcucggaaaaccuuuguggaccugaugcgcagaggggaucucccuguuuggcuugccuaccggguggcugccgagggaauuaacuaugcugacagacgcugguguuucgauggcaucaagaauaaccagauucuggaagagaacgucgaaguggagaucuggacgaaagagggggaacggaagaagcugaaacccagauggcucgacgcccgcaucuacuccgauccucuggcgcuuaaggaguucaaagaauuugccgcuggccggaagucucugacacucaaucugauuaccgagaugggaagacugcccacauucaugacccagaaagcccgggacgcucucgauaaccuugccguucugcacacggccgaagugggcgggcgcgcuuauaaucaugcgcugagcgagcucccggagacccuggaaacacuucugcuccugacccugcucgccacagucaccggaggcaucuuucuuuuccugauguccgggaagggaauuggcaagaugacacugggcaugugcugcaucauuaccgcuagcauccuccugugguacgcccagauccaaccucacuggauugccgcuucuaucauucuugaguuuuuccugaucgugcuccugauucccgaacccgagaaacagagaacgccucaggacaaccagcugacauaugucgugaucgccauccucaccguuguggcggccaccauggcuaaugaaaugggguuucuugagaagaccaagaaggaccugggacugggcuccauuaucacccaagagagcgaauccaacauucucgauaucgaccugcggccggccucugcuuggacacuuuacgccguggcgacgaccuucgucacacccaugcugcgccacagcauugaaaauagcucuguuaacgugagccucaccgccaucgcuaaucaggccacagugcugauggggcugggaagaggcuggccucucuccaaaauggauauuggggucccccuucuggcuaucggauguuacagccaggugaacccuaucacccugacggccgcucuccugcuucugguugcccauuaugcgauuaucggccccggccuccaggccaaggcuacccgggaagcccaaaagcgcgcugccgccgggauuaugaaaaauccuacaguggacggaaucaccgucauugaucuggagccgauccccuacgacccuaaguuugaaaaacagcugggccaggugaugcuccuuguccugugcgugacacagguucugaugaugagaaccacgugggcgcucugugaggcucugacacuugccaccgggcccaucucuacacugugggagggaaacccuggccgguucuggaauaccaccauugcuguguccauggccaacaucuuucgcgggagcuaucucgccggagcuggccugcuguucucuauuaugaagaauacaacgaacaccagacggggcacagggaauaucggagaaacccucggcgagaaauggaaguccagacuuaacgcccugggaaagagcgaauuucaaauuuacaaaaagucuggaauccaggaggucgaucgcacacuggcgaaagagggcaucaagagaggggaaaccgaccaccaugccgugagcagaggauccgcuaaacuccgcugguucguugagcggaacauggugacgcccgaaggcaaggucguggaucugggcugcgggagaggaggcuggucuuauuacugugggggacuuaaaaaugugcgcgagguuaagggccugacaaaagggggaccgggccacgaggagccuauucccaugagcaccuauggcuggaaccucguccggcugcaguccgggguggacguguucuuuacacccccugagaaaugcgauacacugcucugugacaucggagaaagcucccccaauccuaccauugaggccggcagaacacuucgcguccugaaccugguugaaaauuggcucaacaauaacacgcaauucugcaucaaggugcugaauccguacaugcccucugugauugagaaaauggaaacccuucagcggaaguacgggggagcucuggucagaaacccucucagccgcaauuccacacaugagauguauugggugucuaacgccaccggcaauaucguuagcuccgugaacaugaucucucggaugcugauuaauagauuuacaaugaaacacaagaaggcgaccuacgagcccgaugucgaccuggggagcggaacgcgcaacaucggcauugaaaacgagaucccuaaucucgacauuaucggcaaaagaauugaaaagaucaaacaggagcacgaaaccuccuggcauuaugaucaggaccaccccuacaagacaugggccuaucaugggagcuacgagaccaaacaaacaggaucugcuuccagcauggugaacggcguugugcggcuucugaccaagccgugggaugucgugccuauggugacacagauggccaugaccgacacgacacccuucgggcagcagcgcgucuuuaaggagaaaguugauaccagaacccaagaaccuaaggagggaaccaagaagcugaugcggaucacggcugaauggcucuggaaagagcugggcaagaagaaaacccccagaauguguacacgggaggaguucacccgcaaggugagaucuaaugccgcucuuggggccauuuuuacagacgagaacaaauggaaguccgcgcgggaagccguggaggauagccgcuucugggaacuggucgacagagagcggaaucuccaccuggagggaaaaugcgaaaccuguguguauaacaugaugggcaagcgcgagaaaaagcugggcgaauuugggaaggcuaaaggaucuagagccaucugguacauguggcucggcgcucgguuccuggaguuugaagcccuuggguuccugaaugaggaucacugguuuucccgcggaaacagccucuccggcguugagggggaaggccugcauaaacuuggauacauucugagagacgugagcaaaaaggagggcggggccauguaugcggaugacacagcuggaugggacacccggaucacgcucgaagaucugaaaaaugaggaaauggucaccaaccacaugaagggcgagcauaagaaacuggccgaggccauuuucaagcucacauaccagaauaaagugguucgcgugcagagaccuacaccccgggggacagucauggacaucaucucucgcaaggaucagagaggaagcggccaaguggggaccuauggccugaacacguucacaaauauggaagcucagcuuauucggcagauggagggagaaggcaucuuuaaauccauucaacaccugaccguuacagaggagaucgccgugcagaacuggcucgcuagagucgggcgcgaacggcugucuagaauggccauuagcggagacgauugcguggucaagccgcuugacgaucgcuucgcguccgcccugaccgcucucaaugacaugggcaaggugcggaaagauauccagcagugggagccuucuagaggguggaacgacuggacgcaaguucccuuuugcagccaucacuuccacgaacuggugaugaaggauggacgcguccugguggugcccugucggaaccaggacgagcucaucggcagagcccgcauuucccagggggcuggcuggucucugaaagaaaccgccugccuuggaaagagcuacgcgcagauguggacacugauguauuuucaucggagagaucuccgccuggccgcuaaugccaucuguuccgcuguuccuagccacugggugccgaccucucggacaaccugguccauucaugccaaacacgaguggaugacaaccgaggacaugcuugcugucuggaacagaguguggauccaagaaaaucccuggauggaggacaagacgccuguugaaagcugggaggaagugcccuaccugggcaagcgggaggaucaguggugcgggucucucauuggacugacauccagagccaccugggcgaaaaacauccagaccgccauuaaucagguccgcagccugaucggcaacgaggaauauacagacuacaugccuuccaugaagcgguucagaaaagaggaagaggaagcuggggugcucugguga

SEQ ID NO: 19933 - RNA, 9876 nt, Artificial Sequence
  derived and/or modified CDS sequence (opt5) from DENV-2__EU596485__SS-prME
accgccggcgugaucauuaugcugauccccaccgcuauggccuuccaccucacgacccggaauggggaaccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgauagccauaaccaaacauuccucaucgacgggccugagaccgcggaaugccccaauacaaaccgcgccuggaacucucuggagguugaggacuacggauuuggcguguucuccaccaacaucuggcuuaagcugcgggaaaaacaggaugucuuuugugacagcaagcucaugucugcugccauuaaagauaauagagcugugcacgccgacaugggcuauuggaucgaguccgcgcugaacgauacauggaagauggaaaaggccagcuucauugagguuaaaucuugccacuggccuaagagccauacccugugguccaauggggugcuugagagcgaaaugaucauucccaaaaacuucgcuggaccggucucucagcacaacuaccgcccuggcuaucauacgcagacagccgggcccuggcaccucggaaagcuggagauggacuuugauuucugugaaggcaccaccgugguggucacagaggacugcgggaaucggggacccucccugagaaccacgacagcuagcggcaaacucaucaccgaauggugcugucgguccugcacacugccuccgcuucgcuacagaggcgaggauggguguugguacggaauggagauucggccccugaaggaaaaggaggaaaaccucguuaauucucuggugaccgccggccaugggcaaaucgacaacuuuagccugggagugcuuggcauggcccucuuccuggaggaaaugcugagaacacgcgucgggaccaaacacgcuauccuccugguggcgguuuccuuugugacgcuuauuaccggaaauaugucuuuccgggaucugggcagagucauggugaugguuggcgccacaaugaccgacgauaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgagacaauccuggaacucaccgacgcccuggcccugggaaugauggugcuuaaaaucguucggaacauggagaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaagccgugauggcgguggggauggucucuauucucgccuccagccugcucaaaaaugauaucccuaugacgggaccccugguggcuggcggccuucugacaguuugcuaugugcugaccgggcgguccgccgaccucgagcuggaacgcgcugccgaugucaagugggaggaccaggccgagauuagcggaucuagcccuauccuuuccauuaccaucucugaagauggcagcauguccauuaaaaacgaggaagaggagcaaacacugaccauccucaucagaacagggcugcucgugauuucuggaguuuuccccgugagcaucccgauuacggcugcggccugguaccugugggaagucaagaagcagcgggcuggcgugcuuugggacgucccuucucccccucccguggggaaagccgagcuggaagauggagccuaucgcaucaagcagagaggcauuuuuggcuacagccagaucggggcuggaguuuauaaagagggcaccuuccacacaauguggcaugugaccagaggggccguccugaugcaccgcggaaagagaaucgaacccagcugggcggacgugaaaaaggaucucauuuccuacggcgggggauggaagcuggagggcgaguggaaagaaggcgaggaaguucaagugcuugcucuggagccugggaagaauccgcgggccguccagacaaaacccggacucuuuaagaccaacacgggcaccaucggggccgugagccuggacuucucuccuggaacauccggcagccccauuguggauagaaaagggaagguugucggacucuacggcaauggcguggugacccgcucuggggcuuaugucuccgccaucgcgcagacagaaaagagcauugaggacaacccugagaucgaagaugacaucuuccggaaaaagagacugaccauuauggaccuucaucccggagcuggcaaaacaaagcgcuaccugccugccaucgugcgggaggccauuaaaagagggcugcgcacgcucauccuggcuccgacccggguuguggccgcugaaauggaggaagcccuuagaggacugcccauucgcuaucagaccccugcgauccgggccgagcacaccggcagagagauugucgaucucaugugucaugcuaccuuuacaaugcggcugcucucccccgugcgcguuccuaacuacaaucugaucaucauggacgaagcccacuucacggaucccgcuucuauugccgccagaggguauaucagcacccggguggagaugggcgaagcugcgggaauuuuuaugacagccaccccgccuggcucccgcgaccccuucccccaaagcaacgcuccuaucauggaugaggagagagaaauucccgagcggucuuggaacuccgggcacgaaugggucacagacuuuaagggaaagaccgugugguucguuccuagcaucaaagccggcaacgauaucgccgcuugccuuagaaagaaugggaaaaaggugauucagcugucucgcaaaacguuugacagcgaguacgucaagacacgggccaacgauugggacuucguggugaccaccgauaucuccgaaaugggagcgaauuuuagagcugagcgcgucauugacccgcggagauguaugaagcccguuauccugacagacggcgaggaacgcgugauucucgccgggccuaugcccgugacccauucuagcgccgcucagcggagaggccgcaucggaagaaacccuaaaaaugagaacgaucaauauaucuacaugggcgaaccccuggagaaugacgaagauugcgcccacuggaaggaggcgaaaaugcuucuggacaacauuaauacaccggaggggaucauuccuuccauguucgaacccgagcgggaaaaggucgaugccaucgacggagaguaccgccucagaggcgaagcucggaaaaccuuuguggaucugaugcgcagaggggaccugccuguuuggcucgccuaucggguggcugccgagggaauuaacuacgcugauagacgcugguguuucgacggcaucaagaauaaccagauucuugaggaaaacgucgagguggaaaucuggacgaaagagggggagcggaagaagcugaaacccagauggcuggaugcccgcaucuauucugacccucucgcgcugaaggaguucaaagaguuugccgcuggcagaaagagccuuacacugaaucucauuaccgaaaugggacggcugcccacauucaugacccagaaagcccgggaugcucuggacaaccucgccguucuucauacggccgaggugggcgggcgcgcuuacaaucacgcgcuguccgaacugccggagacccucgagacacugcuucugcucacccugcuggccgcugucacaggaggcaucuuucucuuccuuaugagcgggaagggaauuggcaagaugacccugggcaugugcugcaucauuacagccucuauccugcucugguaugcccagauccaaccucacuggauugcugccuccaucauucuggaauuuuuccuuaucgugcugcucauucccgagcccgaaaaacagagaaccccucaggacaaccagcugacguacgucgugaucgcgauccugacaguuguggccgcuaccauggccaaugagaugggguuucucgaaaagaccaaaaaggaucuuggacugggcagcauuaucacacaagaguccgagucuaacauucuggacaucgaucuccggccggcuagcgccuggacccuguaugcgguggccacaacguucgucacccccaugcuucgccauuccauugaaaauucuagcguuaacgugucccugacagcuaucgccaaucaggcuaccgugcucauggggcugggaagaggcuggccucugagcaaaauggacauuggggucccccuccuugccaucggauguuacucucaggugaacccuaucacacugaccgcugcccugcuccugcuuguugcgcacuacgccauuaucggccccggccugcaggcuaaggccacgcgggaggcucaaaagcgcgccgccgcggggauuaugaaaaauccuaccguggauggaaucacagucauugaccucgaaccgauccccuaugauccuaaguuugagaaacagcugggccaggugaugcugcucguccuuugcgugacccagguucugaugaugagaacaaccugggcucugugugaagcccucacgcuggcuacagggcccaucuccacccuuugggagggaaacccuggccgguucuggaauacaaccauugccgugagcauggccaacaucuuucgcgggucuuaccuggcuggagccggccuccuguucuccauuaugaagaauaccacaaacacgagacggggcaccgggaauaucggagagacacugggcgaaaaauggaaguccagacucaacgcgcuugggaagucugaguuucaaauuuauaaaaagagcggaauccaggaagucgaccgcacccuggccaaagagggcaucaagagaggggaaacagaucaucacgcugugucccggggaucugccaaacugcgcugguucguugaacggaacauggugacccccgagggcaaggucguggaccucggcugcgggagaggaggcuggagcuacuauugugggggacugaaaaaugugcgcgaaguuaagggccuuacgaaagggggaccgggccaugaggaaccuauucccauguccacauacggcuggaaccugguccggcuccagagcgggguggauguguucuuuacacccccugagaaaugcgacacccugcugugugauaucggagaguccucucccaauccuacaauugaagcuggcagaacccuccgcguccuuaaccugguugagaauuggcugaacaauaacacacaauucugcaucaaggugcucaauccguauaugcccagcgugauugagaagauggagacgcugcagcggaaguacgggggagcccuugucagaaacccucugucccgcaauucuacccacgaaauguacugggugagcaacgcgacaggcaauaucguuuccucugugaacaugaucagccggaugcucauuaauagauuuaccaugaaacacaagaaggccacauaugagcccgacgucgaccugggguccggaacccgcaacaucggcauugagaacgaaaucccuaaucuggauauuaucggcaaaagaauugagaagaucaaacaggaacaugagacgagcuggcacuacgaccaggaucaucccuauaagaccugggcuuaccacgggucuuaugaaacaaaacaaaccggauccgccagcucuauggugaacggcguugugcggcuccuuacaaagccgugggacgucgugccuauggugacccagauggcuaugacagauaccacgcccuucgggcagcagcgcgucuuuaaggagaaaguugacacaagaacccaagagccuaaggaaggaaccaaaaagcugaugcggaucacagccgaguggcuguggaaagaacucggcaagaagaaaacgcccagaauguguacccgggaggaguucgcucgcaaggugagauccaaugccgcgcugggggccauuuuuacagaugaaaacaaauggaaaagcgcucgggaggccguggaagacucucgcuucugggagcuugucgauagagaacggaaucugcaccucgagggaaaaugcgagaccuguguguacaacaugaugggcaagcgcgagaagaagcugggcgaguuugggaaggcuaaaggauccagagccaucugguauauguggcugggcgcccgguuccucgaauuugaggcgcugggguuccuuaaugaagaccauugguuuagccgcggaaacucccugagcggcguugagggggagggccuccacaagcugggauacauucuuagagaugugucuaaaaaggaaggcggggcuauguacgccgacgacacagccggaugggauacccggaucacacuggaggaccucaaaaaugaagagauggucaccaaccauaugaagggcgaacacaagaaacuggcugaggccauuuucaagcugacguaucagaauaaagugguucgcgugcagagaccuacaccccgggggacagucauggauaucaucagccgcaaggaccagagaggauccggccaaguggggaccuacggccucaacacauucaccaauauggaggcucagcugauucggcagauggaaggagagggcaucuuuaaaucuauucaacaucuuacgguuacagaagagaucgccgugcagaacuggcuggcgagagucgggcgcgagcggcucagcagaauggccauuuccggagaugacugcguggucaagccgcuggaugaccgcuucgcuucugcccuuaccgcucugaaugauaugggcaaggugcggaaagacauccagcagugggaaccuagcagaggguggaacgauuggacacaaguucccuuuugcucccaccacuuccaugagcucgugaugaaggacggacgcguccugguggugcccugucggaaccaggaugaacugaucggcagagcccgcauuucucagggggcgggcuggagccucaaagagaccgccugccugggaaaguccuaugcucagauguggacgcuuauguacuuucaccggagagaccugcgccucgccgcuaaugccaucuguagcgcuguuccuucucauugggugccgaccucccggacaaccuggagcauucacgccaaacacgaauggaugacaaccgaggacaugcuggcggucuggaacagaguguggauccaagagaaucccuggauggaagauaagacaccuguugagucuugggaagaggugcccuaucuuggcaagcgggaagaccaguggugcgggucccugauuggacucaccagcagagccacgugggcuaaaaacauccagacagccauuaaucagguccgcucccugaucggcaacgaggaguacaccgauuauaugccuucuaugaagcgguucagaaaagaagaggaagaggccggggugcugugguga

SEQ ID NO: 19934 - RNA, 9876 nt, Artificial Sequence
  derived and/or modified CDS sequence (opt5) from DENV-2__EU569710__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugacguucauucuucugaccgccguggcgccuagcaugacaaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacggaggcuaagcagccugccauucugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgcuacguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaucaaguuuucggcgccaucuauggagcggcuuuuuccggcgugucuuggacaaugaaaauucugaucggggucaucauuaccuggaucggaaugaacagccgguccaccagccuuucugugucccucgugcugguuggcgucgugacacuguaccucggggugaugguccaggccgacagcggaugugugguuucuuggaagaauaaagaacugaagugcggcuccgggauuuucaucaccgauaacgugcacacauggacggagcaguauaaguuucagccugaaagccccuccaaacuugccucugcuauucaaaaggcccacgaggaaggcaucuguggaaucagaagcgucacccgccuggagaaucucauguggaaacagauuacaccggagcugaaccauauccuguccgaaaaugaggugaaacuuaccauuaugacaggcgacaucaaagggauuaugcaggcuggaaagcggucucucagaccucagcccaccgaacugaaauacagcuggaagacguggggcaaggccaaaaugcuguccaccgagagccacaaccaaacauuccucaucgaugggccugaaaccgcggagugccccaauacaaaccgcgccuggaacucucuggagguugaagacuauggauuuggcguguucuccaccaacaucuggcuuaagcugcgggagaaacaggacgucuuuugugauagcaagcucaugucugcugccauuaaagacaauagagcugugcaugccgauaugggcuacuggaucgaauccgcgcugaacgacacauggaagauggagaaggccagcuucauugagguuaaaucuugccacuggccuaagagccacacccugugguccaauggggugcuugaaagcgagaugaucauucccaaaaacuucgcuggaccggucucucagcauaacuaucgcccuggcuaccacacgcagacagccgggcccuggcaucucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguauggaauggaaauucggccccugaaggagaaggaagagaaccucguuaauucucuggugaccgccggccacgggcaaaucgauaacuuuagccugggagugcuuggcauggcccucuuccuggaagagaugcugagaacacgcgucgggaccaaacaugcuauccuccugguggcgguuuccuuugugacgcuuauuaccggaaauaugucuuuccgggaccugggcagagucauggugaugguuggcgccacaaugaccgaugacaucgggaugggagugacauaccucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaucagcuggcugugaccauuauggccauccucugcgucccuaaugcggugauucugcaaaacgcuuggaaggugagcuguacaauccucgccgccgucuccguuagcccccugcuucugacgucuucccagcagaaagcugacuggauuccucucgcccugaccaucaagggccugaaucccacagcuaucuuucuuaccacacugagccgcaccucuaaaaagagauccuggccgcucaacgaggccgugauggcgguggggauggucagcauucuggccucuucccuccugaaaaaugacaucccuaugacgggaccccuuguggcuggcggccugcugacaguuugcuacgugcucaccgggcggagcgccgaucuggaacuugagcgcgcugccgacgucaagugggaggaucaggccgaaauuuccggaagcucuccuauccugagcauuaccaucuccgaggacggcucuaugagcauuaaaaacgaagaggaggaacaaacacucaccauccugaucagaacagggcuccuggugauuuccggaguuuuccccgugucuaucccgauuacggcugcggccugguaucuuugggaggucaagaagcagcgggcuggcgugcugugggaugucccuucucccccucccguggggaaagccgaacuggaggacggagccuaccgcaucaagcagagaggcauuuuuggcuauucccagaucggggcuggaguuuacaaagaaggcaccuuccacacaauguggcacgugaccagaggggccguccucaugcaucgcggaaagagaaucgagcccuccugggcggaugugaaaaaggaccugauuagcuacggcgggggauggaaacuugagggcgaauggaaagagggcgaagagguucaagugcuggcucucgaaccugggaagaauccgcgggccguccagacaaaacccggacuguuuaagaccaacacgggcaccaucggggccgugucccucgauuucagcccuggaacaucuggcucccccauuguggacagaaaagggaagguugucggacuguauggcaauggcguggugacccgcagcggggcuuacgucucugccaucgcgcagacagagaaguccauugaggauaacccugaaaucgaggacgauaucuuccggaaaaagagacuuaccauuauggaccugcaccccggagcuggcaaaacaaagcgcuaucugccugccaucgugcgggaagccauuaaaagagggcuccgcacgcugauccuugcuccgacccggguuguggccgcugagauggaagaggcccugagaggacuccccauucgcuaccagaccccugcgauccgggccgagcauaccggcagagaaauugucgaccugaugugucacgcuaccuuuacaaugcggcuccugagccccgugcgcguuccuaacuauaaucuuaucaucauggaugaggcccauuucacggaccccgcuuccauugccgccagaggguacaucucuacccggguggaaaugggcgaggcugcgggaauuuuuaugacagccaccccgccuggcagccgcgaucccuucccccaauccaacgcuccuaucauggacgaggaaagagagauucccgaacggagcuggaacucugggcacgagugggucacagauuuuaagggaaagaccgugugguucguuccuuccaucaaagccggcaacgacaucgccgcuugccugagaaagaaugggaaaaaggugauucagcugagccgcaaaacguuugauucugaauaugucaagacacgggccaacgacugggauuucguggugaccaccgacaucagcgagaugggagcgaauuuuagagcugagcgcgucauugauccgcggagauguaugaagcccguuauccucacagacggcgaggaacgcgugauucuggccgggccuaugcccgugacccacuccucugccgcucagcggagaggccgcaucggaagaaacccuaaaaaugaaaacgaccaauacaucuacaugggcgagccccuugaaaaugaugaggacugcgcccauuggaaggaggcgaaaaugcugcucgauaacauuaauacaccggaagggaucauuccuagcauguucgagcccgaacgggagaaggucgacgccaucgauggagaauaucgccugagaggcgaggcucggaaaaccuuuguggaccugaugcgcagaggggaucucccuguuuggcuugccuaccggguggcugccgagggaauuaacuaugcugacagacgcugguguuucgauggcaucaagaauaaccagauucuggaagagaacgucgaaguggagaucuggacgaaagagggggaacggaagaagcugaaacccagauggcucgacgcccgcaucuacuccgauccucuggcgcuuaaggaguucaaagaauuugccgcuggccggaagucucugacacucaaucugauuaccgagaugggaagacugcccacauucaugacccagaaagcccgggacgcucucgauaaccuugccguucugcacacggccgaagugggcgggcgcgcuuauaaucaugcgcugagcgagcucccggagacccuggaaacacuucugcuccugacccugcucgccacagucaccggaggcaucuuucuuuuccugauguccgggaagggaauuggcaagaugacacugggcaugugcugcaucauuaccgcuagcauccuccugugguacgcccagauccaaccucacuggauugccgcuucuaucauucuugaguuuuuccugaucgugcuccugauucccgaacccgagaaacagagaacgccucaggacaaccagcugacauaugucgugaucgccauccucaccguuguggcggccaccauggcuaaugaaaugggguuucuugagaagaccaagaaggaccugggacugggcuccauuaucacccaagagagcgaauccaacauucucgauaucgaccugcggccggccucugcuuggacacuuuacgccguggcgacgaccuucgucacacccaugcugcgccacagcauugaaaauagcucuguuaacgugagccucaccgccaucgcuaaucaggccacagugcugauggggcugggaagaggcuggccucucuccaaaauggauauuggggucccccuucuggcuaucggauguuacagccaggugaacccuaucacccugacggccgcucuccugcuucugguugcccauuaugcgauuaucggccccggccuccaggccaaggcuacccgggaagcccaaaagcgcgcugccgccgggauuaugaaaaauccuacaguggacggaaucaccgucauugaucuggagccgauccccuacgacccuaaguuugaaaaacagcugggccaggugaugcuccuuguccugugcgugacacagguucugaugaugagaaccacgugggcgcucugugaggcucugacacuugccaccgggcccaucucuacacugugggagggaaacccuggccgguucuggaauaccaccauugcuguguccauggccaacaucuuucgcgggagcuaucucgccggagcuggccugcuguucucuauuaugaagaauacaacgaacaccagacggggcacagggaauaucggagaaacccucggcgagaaauggaaguccagacuuaacgcccugggaaagagcgaauuucaaauuuacaaaaagucuggaauccaggaggucgaucgcacacuggcgaaagagggcaucaagagaggggaaaccgaccaccaugccgugagcagaggauccgcuaaacuccgcugguucguugagcggaacauggugacgcccgaaggcaaggucguggaucugggcugcgggagaggaggcuggucuuauuacugugggggacuuaaaaaugugcgcgagguuaagggccugacaaaagggggaccgggccacgaggagccuauucccaugagcaccuauggcuggaaccucguccggcugcaguccgggguggacguguucuuuacacccccugagaaaugcgauacacugcucugugacaucggagaaagcucccccaauccuaccauugaggccggcagaacacuucgcguccugaaccugguugaaaauuggcucaacaauaacacgcaauucugcaucaaggugcugaauccguacaugcccucugugauugagaaaauggaaacccuucagcggaaguacgggggagcucuggucagaaacccucucagccgcaauuccacacaugagauguauugggugucuaacgccaccggcaauaucguuagcuccgugaacaugaucucucggaugcugauuaauagauuuacaaugaaacacaagaaggcgaccuacgagcccgaugucgaccuggggagcggaacgcgcaacaucggcauugaaaacgagaucccuaaucucgacauuaucggcaaaagaauugaaaagaucaaacaggagcacgaaaccuccuggcauuaugaucaggaccaccccuacaagacaugggccuaucaugggagcuacgagaccaaacaaacaggaucugcuuccagcauggugaacggcguugugcggcuucugaccaagccgugggaugucgugccuauggugacacagauggccaugaccgacacgacacccuucgggcagcagcgcgucuuuaaggagaaaguugauaccagaacccaagaaccuaaggagggaaccaagaagcugaugcggaucacggcugaauggcucuggaaagagcugggcaagaagaaaacccccagaauguguacacgggaggaguucacccgcaaggugagaucuaaugccgcucuuggggccauuuuuacagacgagaacaaauggaaguccgcgcgggaagccguggaggauagccgcuucugggaacuggucgacagagagcggaaucuccaccuggagggaaaaugcgaaaccuguguguauaacaugaugggcaagcgcgagaaaaagcugggcgaauuugggaaggcuaaaggaucuagagccaucugguacauguggcucggcgcucgguuccuggaguuugaagcccuuggguuccugaaugaggaucacugguuuucccgcggaaacagccucuccggcguugagggggaaggccugcauaaacuuggauacauucugagagacgugagcaaaaaggagggcggggccauguaugcggaugacacagcuggaugggacacccggaucacgcucgaagaucugaaaaaugaggaaauggucaccaaccacaugaagggcgagcauaagaaacuggccgaggccauuuucaagcucacauaccagaauaaagugguucgcgugcagagaccuacaccccgggggacagucauggacaucaucucucgcaaggaucagagaggaagcggccaaguggggaccuauggccugaacacguucacaaauauggaagcucagcuuauucggcagauggagggagaaggcaucuuuaaauccauucaacaccugaccguuacagaggagaucgccgugcagaacuggcucgcuagagucgggcgcgaacggcugucuagaauggccauuagcggagacgauugcguggucaagccgcuugacgaucgcuucgcguccgcccugaccgcucucaaugacaugggcaaggugcggaaagauauccagcagugggagccuucuagaggguggaacgacuggacgcaaguucccuuuugcagccaucacuuccacgaacuggugaugaaggauggacgcguccugguggugcccugucggaaccaggacgagcucaucggcagagcccgcauuucccagggggcuggcuggucucugaaagaaaccgccugccuuggaaagagcuacgcgcagauguggacacugauguauuuucaucggagagaucuccgccuggccgcuaaugccaucuguuccgcuguuccuagccacugggugccgaccucucggacaaccugguccauucaugccaaacacgaguggaugacaaccgaggacaugcuugcugucuggaacagaguguggauccaagaaaaucccuggauggaggacaagacgccuguugaaagcugggaggaagugcccuaccugggcaagcgggaggaucaguggugcgggucucucauuggacugacauccagagccaccugggcgaaaaacauccagaccgccauuaaucagguccgcagccugaucggcaacgaggaauauacagacuacaugccuuccaugaagcgguucagaaaagaggaagaggaagcuggggugcucugguga

SEQ ID NO: 19935 - RNA, 9876 nt, Artificial Sequence
  derived and/or modified CDS sequence (opt5) from DENV-2__EU596486__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgcuacguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaucaaguuuucggcgccaucuauggagcggcuuuuuccggcgugucuuggacaaugaaaauucugaucggggucaucauuaccuggaucggaaugaacagccgguccaccagccuuucugugucccucgugcugguuggcgucgugacacuguaccucggggugaugguccaggccgacagcggaugugugguuucuuggaagaauaaagaacugaagugcggcuccgggauuuucaucaccgauaacgugcacacauggacggagcaguauaaguuucagccugaaagccccuccaaacuugccucugcuauucaaaaggcccacgaggaaggcaucuguggaaucagaagcgucacccgccuggagaaucucauguggaaacagauuacaccggagcugaaccauauccuguccgaaaaugaggugaaacuuaccauuaugacaggcgacaucaaagggauuaugcaggcuggaaagcggucucucagaccucagcccaccgaacugaaauacagcuggaagacguggggcaaggccaaaaugcuguccaccgagagccacaaccaaacauuccucaucgaugggccugaaaccgcggagugccccaauacaaaccgcgccuggaacucucuggagguugaagacuauggauuuggcguguucuccaccaacaucuggcuuaagcugcgggagaaacaggacgucuuuugugauagcaagcucaugucugcugccauuaaagacaauagagcugugcaugccgauaugggcuacuggaucgaauccgcgcugaacgacacauggaagauggagaaggccagcuucauugagguuaaaucuugccacuggccuaagagccacacccugugguccaauggggugcuugaaagcgagaugaucauucccaaaaacuucgcuggaccggucucucagcauaacuaucgcccuggcuaccacacgcagacagccgggcccuggcaucucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguauggaauggaaauucggccccugaaggagaaggaagagaaccucguuaauucucuggugaccgccggccacgggcaaaucgauaacuuuagccugggagugcuuggcauggcccucuuccuggaagagaugcugagaacacgcgucgggaccaaacaugcuauccuccugguggcgguuuccuuugugacgcuuauuaccggaaauaugucuuuccgggaccugggcagagucauggugaugguuggcgccacaaugaccgaugacaucgggaugggagugacauaccucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaucagcuggcugugaccauuauggccauccucugcgucccuaaugcggugauucugcaaaacgcuuggaaggugagcuguacaauccucgccgccgucuccguuagcccccugcuucugacgucuucccagcagaaagcugacuggauuccucucgcccugaccaucaagggccugaaucccacagcuaucuuucuuaccacacugagccgcaccucuaaaaagagauccuggccgcucaacgaggccgugauggcgguggggauggucagcauucuggccucuucccuccugaaaaaugacaucccuaugacgggaccccuuguggcuggcggccugcugacaguuugcuacgugcucaccgggcggagcgccgaucuggaacuugagcgcgcugccgacgucaagugggaggaucaggccgaaauuuccggaagcucuccuauccugagcauuaccaucuccgaggacggcucuaugagcauuaaaaacgaagaggaggaacaaacacucaccauccugaucagaacagggcuccuggugauuuccggaguuuuccccgugucuaucccgauuacggcugcggccugguaucuuugggaggucaagaagcagcgggcuggcgugcugugggaugucccuucucccccucccguggggaaagccgaacuggaggacggagccuaccgcaucaagcagagaggcauuuuuggcuauucccagaucggggcuggaguuuacaaagaaggcaccuuccacacaauguggcacgugaccagaggggccguccucaugcaucgcggaaagagaaucgagcccuccugggcggaugugaaaaaggaccugauuagcuacggcgggggauggaaacuugagggcgaauggaaagagggcgaagagguucaagugcuggcucucgaaccugggaagaauccgcgggccguccagacaaaacccggacuguuuaagaccaacacgggcaccaucggggccgugucccucgauuucagcccuggaacaucuggcucccccauuguggacagaaaagggaagguugucggacuguauggcaauggcguggugacccgcagcggggcuuacgucucugccaucgcgcagacagagaaguccauugaggauaacccugaaaucgaggacgauaucuuccggaaaaagagacuuaccauuauggaccugcaccccggagcuggcaaaacaaagcgcuaucugccugccaucgugcgggaagccauuaaaagagggcuccgcacgcugauccuugcuccgacccggguuguggccgcugagauggaagaggcccugagaggacuccccauucgcuaccagaccccugcgauccgggccgagcauaccggcagagaaauugucgaccugaugugucacgcuaccuuuacaaugcggcuccugagccccgugcgcguuccuaacuauaaucuuaucaucauggaugaggcccauuucacggaccccgcuuccauugccgccagaggguacaucucuacccggguggaaaugggcgaggcugcgggaauuuuuaugacagccaccccgccuggcagccgcgaucccuucccccaauccaacgcuccuaucauggacgaggaaagagagauucccgaacggagcuggaacucugggcacgagugggucacagauuuuaagggaaagaccgugugguucguuccuuccaucaaagccggcaacgacaucgccgcuugccugagaaagaaugggaaaaaggugauucagcugagccgcaaaacguuugauucugaauaugucaagacacgggccaacgacugggauuucguggugaccaccgacaucagcgagaugggagcgaauuuuagagcugagcgcgucauugauccgcggagauguaugaagcccguuauccucacagacggcgaggaacgcgugauucuggccgggccuaugcccgugacccacuccucugccgcucagcggagaggccgcaucggaagaaacccuaaaaaugaaaacgaccaauacaucuacaugggcgagccccuugaaaaugaugaggacugcgcccauuggaaggaggcgaaaaugcugcucgauaacauuaauacaccggaagggaucauuccuagcauguucgagcccgaacgggagaaggucgacgccaucgauggagaauaucgccugagaggcgaggcucggaaaaccuuuguggaccugaugcgcagaggggaucucccuguuuggcuugccuaccggguggcugccgagggaauuaacuaugcugacagacgcugguguuucgauggcaucaagaauaaccagauucuggaagagaacgucgaaguggagaucuggacgaaagagggggaacggaagaagcugaaacccagauggcucgacgcccgcaucuacuccgauccucuggcgcuuaaggaguucaaagaauuugccgcuggccggaagucucugacacucaaucugauuaccgagaugggaagacugcccacauucaugacccagaaagcccgggacgcucucgauaaccuugccguucugcacacggccgaagugggcgggcgcgcuuauaaucaugcgcugagcgagcucccggagacccuggaaacacuucugcuccugacccugcucgccacagucaccggaggcaucuuucuuuuccugauguccgggaagggaauuggcaagaugacacugggcaugugcugcaucauuaccgcuagcauccuccugugguacgcccagauccaaccucacuggauugccgcuucuaucauucuugaguuuuuccugaucgugcuccugauucccgaacccgagaaacagagaacgccucaggacaaccagcugacauaugucgugaucgccauccucaccguuguggcggccaccauggcuaaugaaaugggguuucuugagaagaccaagaaggaccugggacugggcuccauuaucacccaagagagcgaauccaacauucucgauaucgaccugcggccggccucugcuuggacacuuuacgccguggcgacgaccuucgucacacccaugcugcgccacagcauugaaaauagcucuguuaacgugagccucaccgccaucgcuaaucaggccacagugcugauggggcugggaagaggcuggccucucuccaaaauggauauuggggucccccuucuggcuaucggauguuacagccaggugaacccuaucacccugacggccgcucuccugcuucugguugcccauuaugcgauuaucggccccggccuccaggccaaggcuacccgggaagcccaaaagcgcgcugccgccgggauuaugaaaaauccuacaguggacggaaucaccgucauugaucuggagccgauccccuacgacccuaaguuugaaaaacagcugggccaggugaugcuccuuguccugugcgugacacagguucugaugaugagaaccacgugggcgcucugugaggcucugacacuugccaccgggcccaucucuacacugugggagggaaacccuggccgguucuggaauaccaccauugcuguguccauggccaacaucuuucgcgggagcuaucucgccggagcuggccugcuguucucuauuaugaagaauacaacgaacaccagacggggcacagggaauaucggagaaacccucggcgagaaauggaaguccagacuuaacgcccugggaaagagcgaauuucaaauuuacaaaaagucuggaauccaggaggucgaucgcacacuggcgaaagagggcaucaagagaggggaaaccgaccaccaugccgugagcagaggauccgcuaaacuccgcugguucguugagcggaacauggugacgcccgaaggcaaggucguggaucugggcugcgggagaggaggcuggucuuauuacugugggggacuuaaaaaugugcgcgagguuaagggccugacaaaagggggaccgggccacgaggagccuauucccaugagcaccuauggcuggaaccucguccggcugcaguccgggguggacguguucuuuacacccccugagaaaugcgauacacugcucugugacaucggagaaagcucccccaauccuaccauugaggccggcagaacacuucgcguccugaaccugguugaaaauuggcucaacaauaacacgcaauucugcaucaaggugcugaauccguacaugcccucugugauugagaaaauggaaacccuucagcggaaguacgggggagcucuggucagaaacccucucagccgcaauuccacacaugagauguauugggugucuaacgccaccggcaauaucguuagcuccgugaacaugaucucucggaugcugauuaauagauuuacaaugaaacacaagaaggcgaccuacgagcccgaugucgaccuggggagcggaacgcgcaacaucggcauugaaaacgagaucccuaaucucgacauuaucggcaaaagaauugaaaagaucaaacaggagcacgaaaccuccuggcauuaugaucaggaccaccccuacaagacaugggccuaucaugggagcuacgagaccaaacaaacaggaucugcuuccagcauggugaacggcguugugcggcuucugaccaagccgugggaugucaucccuauggugacacagauggccaugaccgacacgacacccuucgggcagcagcgcguguuuaaggagaaagucgauaccagaacccaagaaccuaaggagggaaccaagaagcugaugcggauuacggcugaauggcucuggaaagagcugggcaagaagaaaacccccagaauguguacacgggaggaguucacccgcaagguuagaucuaaugccgcucuuggggccaucuuuacagacgagaacaaauggaaguccgcgcgggaagccguggaggauagccgcuucugggaacugguggacagagagcggaaucuccaccuggagggaaaaugcgaaaccugugucuauaacaugaugggcaagcgcgagaaaaagcugggcgaauuugggaaggcuaaaggaucuagagccauuugguacauguggcucggcgcucgguuccuggaguuugaagcccuuggguuccugaaugaggaucacugguuuucccgcggaaacagccucuccggcguggagggggaaggccugcauaaacuuggauacauccugagagacguuagcaaaaaggagggcggggccauguaugcggaugacacagcuggaugggacacccggauuacgcucgaagaucugaaaaaugaggaaauggugaccaaccacaugaagggcgagcauaagaaacuggccgaggccaucuucaagcucacauaccagaauaaagucgugcgcguucagagaccuacaccccgggggacagugauggacaucauuucucgcaaggaucagagaggaagcggccaagucgggaccuauggccugaacacguucacaaauauggaagcucagcuuauccggcagauggagggagaaggcauuuuuaaauccauccaacaccugaccgugacagaggagauugccguucagaacuggcucgcuagaguggggcgcgaacggcugucuagaauggccaucagcggagacgauugcgucgugaagccgcuugacgaucgcuucgcguccgcccugaccgcucucaaugacaugggcaagguccggaaagauauccagcagugggagccuucuagaggguggaacgacuggacgcaagugcccuuuugcagccaucacuuccacgaacugguuaugaaggauggacgcgugcuggucgugcccugucggucccaggacgagcucauuggcagagcccgcaucucucagggggcuggcuggagccugaaagaaaccgccugccuuggaaaguccuacgcgcagauguggacacugauguauuuucaucggagagaucuccgccuggccgcuaacgccauuuguagcgcugugccuucucacuggguuccgaccucccggacaaccuggagcauccaugccaaacacgaguggaugacaaccgaggacaugcuugcuguguggaauagagucuggauucaagaaaaccccuggauggaggacaagacgccuguggaaucuugggaggaaguucccuaccugggcaagcgggaggaucaguggugcgggucccucaucggacugacaagcagagccaccugggcgaaaaauauucagaccgccaucaaccaggugcgcucccugaucggcaaugaggaauauauugacuacaugccuucuaugaagcgguucagaaaagaggaagaggaagcugggguccucugguga

SEQ ID NO: 19936 - RNA, 9876 nt, Artificial Sequence
  derived and/or modified CDS sequence (opt5) from DENV-2__EU687212__SS-prME
accgccggcgugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucauuaccgaaaaggacagcccggugaacaucgaggccgaacccccuuuuggggauucuuacauuaucaucggcgucgagcccggacagcucaaacugaauugguucaagaagggcuccagcauugggcaaauguuugagacaaccaugagaggagcuaaacgcauggccauccuuggcgacacggccugggauuucgggucucugggaggcguguuuacaagcauugggaaggcucuccaccagguuuucggcgccaucuacggagcggcuuuuuccggcgugucuuggaccaugaaaauucugaucggggucaucauuaccuggaucggaaugaacagccgguccacaagccugucugugucccuugugcucguuggcgucgugacccuguaucugggggccauggugcaggccgacagcggaugugucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaagagcuucgccggaccggugucucagcacaacuaccgcccuggcuaucauacccaaaccgcugggcccuggcaccuuggaaagcucgaaauggauuuugacuucugugagggcacaaccgucguggugacggaagauugcgggaaccggggacccucccugagaacaaccacagccagcggcaaacugaucaccgaguggugcugucgguccugcacacucccuccgcugcgcuacagaggcgaggacggguguugguacggaauggaaauucggccccuuaaggagaaggaagagaaucuggucaacucucucguuaccgccggccaugggcagaucgauaauuuuagccugggagugcugggcauggcucuuuuccucgaagagaugcugagaacgcgcguggggaccaaacacgcgauccugcucgucgccguguccuuuguuacacugauuaccggaaacaugucuuuccgggaccuuggcagagugauggucauggugggcgcuacaaugaccgaugacaucgggaugggaguuacguaucuggcccuccuggccgcuuuuaaggugcgcccuacauucgccgcgggccugcuucugagaaaacucaccagcaaggagcugaugauggcuacaauugggaucgcccuccugucccagucuaccaugcccgaaaccauucuugagcugacagaugcccucgcucugggaaugaugguccugaaaaucgugcggaauauggaaaaguaccaacuugccguuacgaucauggcgauuagcugcgugccuaacgcugucauccugcagaaugccuggaagguguccuguaccauucucgccacagugagcgucucuccccugcuccugaccuccagccagcagaaagcugacuggaucccucuugcccugacaauuaagggccucaaccccaccgcuaucuuucugacgacacugucucgcaccuccaaaaagagaagcuggccgcuuaaugaggccaucauggcgguugggauggugucuauucuggccuccagccuccugaaaaacgacaucccuaugaccggaccccucguggcuggcggccugcuuacagucugcuaugugcugaccgggcgguccgccgaucuggaacucgagcgcgcugccgacguuaagugggaggaucaagccgaaauuagcggaucuagcccuauccuguccauuacaaucucugaggacggcagcauguccauuaaaaaugaagaggaggaacagacgcuuaccauccugaucagaacagggcuccuggugauuucuggagucuuccccgugagcaucccgauuaccgcugcggccugguaccucugggagguuaagaagcagcgggcuggcgugcugugggaugucccuucucccccucccguggaaaaagccgagcuugaagacggggccuaucgcaucaagcagagagggauucugggcuacagccaaaucggcgcuggggucuauaaagagggaacauuucacaccauguggcaugugacgcggggcgccguucugaugcaccgcgggaagagaaucgagcccagcugggcggaugugaaaaaggaccucauuuccuacggaggcggguggaagcuggaaggagaguggaaagaaggcgaggaaguccaggugcuugcucuggagccuggcaagaacccgcgggccguucagaccaaacccgggaucuucaagacaaauaccggaacaauuggcgccgugagccucgauuuuucuccugggaccuccggaagccccaucgucgacagaaaaggcaaggugguggggcuguacggaaacggcguugucacacgcucuggcgcuuauguguccgccauugcgcagacggaaaaguccaucgaagauaauccugagaucgaagacgauauuuuccggaaaaagagacucaccaucauggaccugcaucccggggcuggaaaaacaaagcgcuaccuuccugccauugugcgggaggccaucaaaagaggccugcgcacccugauucucgcuccgacccgggucguggccgcugaaauggaggaggcccugagagggcuucccauccgcuaucaaacgccugcgauucgggccgaacacacgggaagagagaucguugaccugaugugucaugcuaccuucacaaugcggcuccugucccccgugcgcgucccuaacuacaaccucaucauuauggaugaagcccacuuuaccgaccccgcuucuaucgccgccagaggcuauauuagcacacggguggagaugggggaggcugcgggcaucuucaugaccgccacgccgccuggaucccgcgaucccuuuccccagagcaaugcuccuauuauggacgaagagagagaaauccccgagcggucuuggaacuccggccacgaauggguuacagauuucaaggggaagaccgugugguuugucccuagcaucaaagccggaaaugacauugccgcuugccugagaaagaacggcaaaaaggugauccagcuuucucgcaaaaccuucgauagcgaguacguuaagacacgggccaaugacugggauuuuguggucaccacagacauuuccgagaugggggcgaacuucaaggcugaaagagugaucgauccgcgccgguguaugaaacccgugauucugaccgacggagaggaaagagucauccuggccggcccuaugcccguuacgcauucuagcgccgcucaacgccgggggagaaucggccgcaauccuaagaacgagaaugaccaguauauuuacaugggagaaccccucgagaacgaugaggacugcgcccacuggaaagaagcgaagaugcugcuugauaauaucaacacaccggagggcauuaucccuuccauguuugaacccgagagagaaaaaguggacgccauugauggggaguaccggcugcgcggagaggcuagaaagaccuucguggaccucaugcggcgcggcgaucugccugucuggcuggccuauaaaguggcugccgaagggaucaauuacgcugacagaaagugguguuuugauggaauuaagaacaaucagauccucgaggaaaacguugagguggagaucuggacaaaagaaggcgagcggaagaaacuuaagcccagauggcuggacgcccgcauuuauucugauccucuggcgcucaaagaguucaaggaguucgccgcugggagaaagagccugacccuuaaccugaucacggaaaugggcagacuccccaccuuuaugacacagaaagcccgcaaugcucuggacaaccuggccguccuccauaccgccgaggcuggaggccgggcguacaaucacgcccuuuccgagcugccggaaacacuggagacccuccugcuucugacacuccuggcuaccgugacagggggaauuuuccuguuucucaugagcggcaaggggaucggaaaaaugacacuuggcaugugcugcauuaucaccgccucuauccugcugugguaugcccaaauucagccucacuggaucgcugccuccauuauccucgaguucuuucugauuguucuucugauccccgagcccgaaaagcagagaaccccucaggauaaccaacucacauacguggucaucgcgauucugaccguggucgccgcuacaauggccaaugagaugggcuuccuggagaaaacgaagaaggaccucgggcuuggaagcaucaccacacaggaauccgagucuaacauucuggacaucgaucugcggccggcuagcgccuggacccucuaugcgguggccacaaccuuuguuacgcccaugcugcgccauuccauugaaaauucuagcgugaacgugucccuuaccgcuaucgccaaucaggcuacaguccugaugggccucgggaaaggauggccucugagcaagauggacauuggcguuccccugcucgccaucggguguuacucucaggugaacccuaucacccuuacagcugcccugcugcuccugguggcgcacuacgccauuaucggacccggccuucaagcuaaagccaccagagaggcucagaagcgggccgccgcgggcauuaugaaaaauccuacggucgaugggaucacagugauugaccuggaaccgauccccuaugauccuaaguucgagaagcagcucggacagguuaugcugcugauccucugcgugacccaaguccuuaugaugcgcacaaccugggcucugugugaggcccugacccucgcuacaggccccauuuccacgcugugggaagggaacccuggaagauuuuggaauaccacaaucgccgugagcauggccaacauuuuccggggcucuuaccuugcuggggccggacugcucuuuuccaucaugaaaaauaccacaaacacccgcagaggcacgggcaauauuggggagacacugggagaaaaguggaaaagccggcugaacgcgcucggcaagucugaguuccagaucuauaaaaagagcgggauccaggaggucgaccgcacccuugccaaagaaggaauuaagagaggcgagaccgaucaucacgcugugucccgggggucugccaagcugagaugguuuguugaacgcaacauggugacacccgagggaaaagucguggaccugggcugcggccggggaggauggagcuacuauuguggcgggcucaagaauguuagagaagugaaaggacugaccaagggcgggccgggacaugaggagccuguccccauguccacauacggcuggaaccuugugcgccugcaaagcggcguggauguuuucuucacgcccccugaaaaaugcgacacccuccugugugauaucggggaguccucucccaauccuacaauugaagcuggacggacccugagaguccucaaccuuguggagaauuggcugaacaauaacacacaguuuugcaucaaggugcugaauccguauaugcccagcgucauugaaaagauggagacccuccagcgcaaauacggcggggcccugguucggaacccucuuuccagaaauucuacgcacgagauguacugggugagcaacgcgaccggaaauaucguguccucugucaacaugaucagccgcaugcugauuaaucgguucacaaugaagcacaaaaaggccaccuaugaacccgacguggaucucggcuccgggacaagaaacaucggaauugagagcgaaaucccuaaccuggacauuaucggcaaacgcauugagaagaucaagcaggaacaugagaccucuuggcacuacgaccaagaucaucccuauaaaacaugggcuuaccacggcuccuaugagaccaagcagacggggagcgccucuuccaugguuaauggagugguccggcugcucacaaaaccgugggacgugguuccuauggugacccagauggcuaugaccgauacaacgcccuuuggccagcaaagagucuucaaggaaaaaguggacacccgcacacaggagccuaaggaagggaccaagaaacuuaugaagaucacagccgaguggcuguggaaagagcugggaaagaaaaagacccccagaauguguacacgggaagaguuuaccaaaaaggugcgcagcaacgcugcccucggcgcgauuuucacggaugaaaauaaguggaaaucugccagagaggcugucgaagacgggcgguuuugggagcugguugauagagagcggaaccuucaccuggaaggaaagugcgagaccuguguguacaauaugaugggcaaacgcgaaaagaaacucggcgaguucgggaaggccaagggauccagagcuaucugguauauguggcugggcgcccgguuucuggaguucgaggcccucggguuucugaacgaggaccauugguucagccgcggaaauucccuuagcggcguggaaggggagggccugcacagacucggauacauucugcgggaagucggcaaaaaggaagggggagcgauguacgcugaugacacagccggcugggauacccgcaucacacuugaagaccugaaaaacgaggagauggugaccaaucauaugaagggggaacacaaaaagcucgccgaggcuauuuuuaagcugacguaucagaacaaaguugugagaguccagcggccuacaccccgcggaaccgugauggacaucaucucuagacgggaucaacgcggcagcgggcagguuggcacauacggacugaauaccuucacgaacauggaagcccagcucauuagacaaauggagggcgaggggaucuucaaguccauucagcaucugaccgcuacagaagagaucgccgugcagaauuggcuugcgcgggucggacgcgaaagacugucucggauggccauuagcggcgacgauugcgugguuaaaccgaucgacgauagauuugcuuccgcccucaccgcucugaacgacauggggaaggugcgcaaagauauccagcaaugggagccuucucggggauggaaugacuggacacagguccccuucugcagccaccacuuucaugaacuugugaugaaggauggcagaguccuggugguucccugucgcaaccaggacgagcucauugggcgggccagaaucucccagggcgcgggauggucucugaaggagaccgccugccugggcaaaagcuaugcucaaauguggacacucauguacuuccaccgccgggaucugagacuugccgcuaacgccauuuguuccgcugugccuagccauugggucccgaccucucgcacgacaugguccauccacgccaagcacgaauggaugaccaccgaggacaugcuggcgguguggaaucggguguggauucaggaaaaccccuggauggaggauaaaacaccuguugaaagcugggaggaggugcccuaucucgggaagagagaagaccaguggugcggaucucugaucggccuuaccucccgcgccacaugggcuaaaaauauucagacggccaucaaccaaguccggagccugaucgggaaugaggaauacaccgacuauaugccuuccaugaagagauuucggagagaggaagaggaggccggagugcucugguga

SEQ ID NO: 19937 - RNA, 9876 nt, Artificial Sequence
  derived and/or modified CDS sequence (opt5) from DENV-2__EU660400__SS-prME
accgccggagugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgaucgaucucggagaacugugugaggacaccauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacgaccguggccccuagcaugacaaugcggugcauuggcaucuccaaccgcgauuuugucgaaggggugucuggaggcagcuggguugacaucgugcucgagcacggguccugugucaccacaauggcgaagaauaagcccacccuggauuucgaacuuauuaaaacggaggccaagcagccugcuacacugagaaaauauugcaucgaagccaagcucaccaacaccacaaccgagagccgguguccgacacaaggagagcccucucugaaugaggaacaggacaaacgcuuuauuugcaagcauuccaugguggauagaggcuggggcaacggguguggacuguucggcaaagggggaaucgugacgugcgcuauguuuaccugcaaaaagaauauggaaggcaaagucguucucccugagaaccuggaauacacaauugugaucacaccccacagcggggaggagcaugccgugggaaaugacacaggcaagcacggcaaagaaaucaagauuaccccucagucuuccaucacggaggcggaacuuaccggguauggaacagucaccauggaguguagcccccggacaggccuggauuucaacgaaauggugcuccugcagauggaggacaaagccuggcuuguucaccgccaaugguuucuggaucucccgcugccuuggcugcccggggcugacacccagggaucuaauuggauucagaaggagacgcucgugacauucaagaacccucaugccaaaaagcaggacgucgugguucugggcucccaagaaggggcuaugcacaccgcccuuacaggcgccaccgagauccagaugagcuccggaaaucugcucuuuaccggccaucugaaaugcagacuucggauggauaagcugcagcucaaagggaugucuuacagcauguguacaggaaaguucaagauugugaaagaaaucgcugagacgcaacacggcaccaucgucauuagagugcaguaugagggggacggaucccccugcaagauccccuucgaaauuauggaucuggagaaacgccauguccugggccggcucaucacagugaacccuauuguuaccgaaaaggacagcccggugaacaucgaggcggaacccccuuuuggggauucuuacauuaucaucggcgucgagcccggacagcugaaacuuaauugguucaagaagggcuccagcauugggcagauguuugagacaaccaugagaggagccaaacgcauggcuauccugggcgacacggccugggauuucgggucucucggaggcguguuuacaagcauugggaaggcccugcaccaaguuuucggcgcuaucuacggagccgcguuuuccggcgugucuuggaccaugaaaauucugaucggggucaucauuaccuggaucggaaugaacagccgguccacaagccuuucugugucccucgugcugguuggcgucgugacccuguaucucggggugaugguccaggcugacagcggaugugugguuucuuggaagaauaaagaacugaagugcggcuccgggauuuucaucacagauaacgugcacacguggaccgagcaguacaaguuucagccugaaagccccuccaaacuugccucugccauucaaaaggcucaugaggaaggcaucuguggaaucagaagcgucacacgccuggagaaucucauguggaaacagauuaccccggagcugaaccacauccuguccgaaaaugaggugaaacuuacaauuaugaccggcgacaucaaagggauuaugcaggccggaaagcggucucucagaccucagcccacggaacugaaauauagcuggaagaccuggggcaaggcuaaaaugcuguccacagagagccauaaccaaaccuuccucaucgaugggccugaaacagccgagugccccaauaccaaccgcgcguggaacucucuggagguugaagacuacggauuuggcguguucuccacaaacaucuggcuuaagcugcgggagaaacaggacgucuuuugugauagcaagcucaugucugccgcuauuaaagacaauagagccgugcacgcugauaugggcuauuggaucgaauccgcccugaacgacaccuggaagauggagaaggcgagcuucauugagguuaaaucuugccacuggccuaagagccauacgcugugguccaauggggugcuugaaagcgagaugaucauucccaaaaacuucgccggaccggucucucagcacaacuaccgcccuggcuaucauacacagaccgcugggcccuggcaccucggaaagcuggaaauggauuuugacuucugugagggcaccacagugguggucaccgaagauugcgggaaucggggacccucccugagaacgacaaccgccagcggcaaacucaucacagaguggugcugucgguccugcacccugccuccgcuucgcuacagaggcgaggacggguguugguacggaauggaaauucggccccugaaggagaaggaagagaaccucguuaauucucuggugacagcuggccaugggcaaaucgauaacuuuagccugggagugcuuggcauggcccucuuccuggaagagaugcugagaacccgcgucgggacgaaacacgccauccuccugguggcuguuuccuuugugacccuuauuacaggaaauaugucuuuccgggaccugggcagagucauggugaugguuggcgcgaccaugacagaugacaucgggaugggagugaccuaucucgcccugcuggcugccuuuaagguccgcccuacguucgccgcuggccuucugcucagaaaacugacaagcaaggagcucaugauggccaccauugggaucgcgcugcuuucccagucuacaauucccgaaaccauccuggagcucaccgaugcucuggcccugggaaugauggugcuuaaaaucguucggaacauggaaaaguaccagcuggccgugacaauuauggcuaucagcugcgucccuaaugccgugauucuccaaaacgcguggaagguguccuguacgauccuggcugccgucagcguuucuccccuccugcuuaccuccagccgccagaaagccgacuggauuccucuggcucucacaaucaagggccugaaucccaccgccaucuuucugacaacccuuucuagaacguccaaaaagcggagcuggccgcugaacgaggcugugauggccguggggauggucucuauucucgcguccagccugcucaaaaaugacaucccuaugacaggaccccugguggccggcggccuucugaccguuugcuaugugcugaccgggcgcuccgcugaucucgaacuggagagagccgcugacgucaagugggaggaucaggccgaaauuagcggaucuagcccuauccuuuccauuacaaucucugaggacggcagcauguccauuaaaaacgaagaggaggaacacacccugacaauccucauccggacggggcugcucgugauuucuggaguuuuccccgugagcaucccgauuaccgccgcugcgugguaccugugggaggucaagaagcagcgcgccggcgugcuuugggaugucccuucucccccucccguggggaaagcugaacuggaggacggagccuauagaaucaagcaacggggcauuuuuggcuacagccagaucggggccggaguuuauaaagaaggcacauuccauaccauguggcacgugacacgcggggcuguccugaugcauagaggaaagcggaucgagcccagcugggccgaugugaaaaaggaccucauuuccuacggcgggggauggaagcuggagggcgaauggaaagagggcgaagagguucaggugcuugcgcuggaaccugggaagaauccgagagcuguccagaccaaacccggacucuuuaagacgaacaccggcacaaucggggccgugagccuggauuucucuccuggaaccuccggcagccccauuguggaccgcaaagggaagguugucggacucuacggcaauggcguggugacacggucuggggccuaugucuccgcuaucgcccaaaccgaaaagagcauugaggauaacccugaaaucgaggacgauaucuuccgcaagaagcgccugacaauuauggaccuucaccccggagcgggcaaaacgaagcgguaccugccugcuaucgugagagaagccauuaaacgcgggcugcggacccucauccuggccccgacaagaguuguggcugccgagauggaagaggcucuuagaggacugcccauucgguaucagaccccugccaucagagcggagcauaccggccgggaaauugucgaccucaugugucacgccacauuuacgaugcgccugcucucccccgugagaguuccuaacuacaaucugaucaucauggaugaggcucacuucaccgaccccgccucuauugcugcccggggguauaucagcacacgcguggaaaugggcgaggccgcuggaauuuuuaugaccgcgacaccgccuggcuccagagaucccuucccccagagcaacgccccuaucauggacgaggaacgggagauucccgaaagaucuuggaacuccgggcaugagugggucaccgauuuuaagggaaagacggugugguucguuccuagcaucaaagcuggcaacgacaucgccgccugccuucgcaagaaugggaaaaaggugauucagcugucucggaaaacauuugauagcgaauacgucaagaccagagcuaacgacugggauuucguggugaccacagacaucuccgagaugggagccaauuuucgcgcggagcgggucauugauccgagacgcuguaugaagcccguuauccugaccgacggcgaggaacgggugauucucgcugggccuaugcccgugacacacucuagcgccgcccaaagacgcggcagaaucggacggaacccuaaaaaugaaaacgaccaguauaucuacaugggcgagccccuggaaaaugaugaggacugcgcucauuggaaggaggccaaaaugcuucuggauaacauuaauaccccggaagggaucauuccuuccauguucgagcccgaacgcgagaaggucgacgcgaucgauggagaauacagacuccggggcgaggcccgcaaaacguuuguggaccugaugagaagaggggaucugccuguuuggcucgcuuauagaguggccgcugagggaauuaacuacgccgaccgccggugguguuucgauggcaucaagaauaaccagauucuugaagagaacgucgaaguggagaucuggacaaaagagggggaaagaaagaagcugaaaccccgcuggcuggacgcucggaucuauucugauccucucgcccugaaggaguucaaagaauuugcggccggcagaaagagccuuacccugaaucucauuacagagaugggacggcugcccaccuucaugacgcaaaaagcucgcgacgcccuggauaaccucgcuguucuucacaccgccgaagugggcgggagagccuacaaucacgcucuguccgagcugccggagacacucgaaacccugcuucugcucacacugcuggcgaccgucacaggaggcaucuuucucuuccuuaugagcgggaagggaauuggcaagaugacccugggcaugugcugcaucauuacggccucuauccugcucugguaugcucagauccagccucauuggauugccgccuccaucauucuggaguuuuuccuuaucgugcugcucauucccgaacccgagaaacagcggacaccucaagacaaccagcugaccuacgucgugaucgcuauccugaccguuguggccgcgacaauggccaaugaaaugggguuucucgagaagaccaaaaaggaccuuggacugggcagcauuacaacgcaggaguccgaaucuaacauccuggauauugaccuccgcccggcuagcgccuggacccuguaugcuguggccacaaccuucgucacacccaugcuuagacacuccaucgaaaauucuagcguuaacgugucccugaccgcgauugccaaucaggcuacggugcucauggggcugggacggggcuggccucugagcaaaauggauaucggggucccccuccuugccauuggauguuacucucaagugaacccuaucacccugacagcugcccugcuccugcuuguugcucauuacgccaucauuggccccggccugcaggcgaaggccacccgcgaagcucagaagagagccgcugccgggaucaugaaaaauccuacaguggacggaauuaccgucaucgaucucgagccgauucccuaugacccuaaguuugaaaaacagcugggccaagugaugcugcucguccuuugcgugacgcagguucugaugaugcggacaaccugggcccugugugaggcgcucacacuggcuaccgggcccaucuccacccuuugggagggaaacccuggccgcuucuggaauacaacgaucgccgugagcauggcuaacauuuuuagagggucuuaccuggccggagccggccuccuguucuccaucaugaagaauaccacaaacacccggagaggcacagggaauauuggagaaacccugggcgagaaauggaagucccgccucaacgcucuugggaagucugaauuucagaucuauaaaaagagcggcauucaggaggucgaucggacgcuggccaaagagggcaucaagagaggggaaacagaccaccaugcggugucccgcggaucugccaaacugcggugguucguugagagaaacauggugacccccgaaggcaaggucguggaucucggcugcgggcgcggaggcuggagcuacuauugugggggacugaaaaaugugcgggagguuaagggccuuaccaaagggggaccgggccacgaggagccuauccccauguccacauacggcuggaaccuggucagacuccaaagcgggguggacguguucuuuacacccccugagaaaugcgauacacugcugugugacauuggagaauccucucccaauccuacgaucgaggcuggccgcacccuccggguccuuaaccugguugaaaauuggcugaacaauaacacacaguucugcauuaaggugcucaauccguauaugcccagcgugaucgagaaaauggaaacccugcagagaaaguacgggggagcccuuguccgcaacccucuguccagaaauucuacacacgagauguacugggugagcaacgcuaccggcaauauuguuuccucugugaacaugaucagcagaaugcucaucaaucgcuuuacgaugaaacauaagaaggccaccuaugagcccgaugucgaccugggguccggaacaagaaacauuggcaucgaaaacgagauuccuaaucuggacaucauuggcaaacggaucgaaaagauuaaacaagagcacgaaaccagcuggcauuacgaucaggaccaccccuauaagacaugggcguaccacgggucuuaugagaccaaacagacaggauccgccagcucuauggugaacggcguugugaagcuccuuaccaagccgugggaugucgugccuauggugacgcagauggcuaugacagacaccacccccuucgggcaacagcgcgucuuuaaagagaagguugauacaagaacgcaggaaccuaaagagggaaccaagaaacugaugcggaucacagccgaauggcuguggaaggagcucggcaagaaaaagacccccagaauguguacacgggaggaguucacccgcaaagugagauccaaugcugcccugggggcuaucuuuacagacgagaacaaguggaaaagcgcccgggaagcgguggaggauucucgcuucugggaacuugucgacagagagcggaaucugcaucucgagggaaagugcgaaaccuguguguacaacaugaugggcaaacgcgagaagaagcugggcgaauuugggaaagccaagggauccagagcuauuugguauauguggcugggcgcccgguuccucgaguuugaagcucugggguuccuuaaugaggaucacugguuuagccgcggaaacucccugagcggcguugagggggaaggccuccauaaacugggauacauccuuagagacgugucuaagaaagagggcggggccauguacgccgaugacacggcgggaugggacacccggauuacacuggaagaucucaagaaugaggaaauggucaccaaccacaugaagggcgagcauaaaaagcuggcugaggccaucuucaaacugacauaucagaauaaggugguucgcgugcaaagaccuacaccccgggggacggucauggacauuaucagccgcaaagaucagagaggauccggccagguggggacauacggccucaacaccuucacaaauauggaagcccagcugauccggcaaauggagggagaaggcauuuuuaagucuauccagagacuuaccguuacggaggagauugcugugcagaacuggcuggcccgcgucgggcgggaaagacucagccgcauggcuaucuccggagacgauugcguggucaagccgcuggacgaucgguucgccucugcgcuuaccgcccugaaugacaugggcaaagugagaaaggauauucaacagugggagccuagccgcggguggaacgacuggacacagguucccuuuugcucccaccacuuccaugaacucgugaugaaagauggacggguccugguggugcccuguagaaaccaggacgagcugaucggccgcgcucggaucucucaaggggccggcuggagccucaaggaaaccgcuugccugggaaaauccuaugcccagauguggacacuuauguacuuucacagacgcgaucugcggcucgcggccaaugcuauuuguagcgccguuccuucucauugggugccgaccuccagaacaaccuggagcauccacgcuaagcacgaguggaugacgacagaggacaugcuggccgucuggaaccggguguggauucaggaaaaucccuggauggaggacaagaccccuguugaaucuugggaggaagugcccuaucuuggcaaaagagaggaucaguggugcgggucccugaucggacucaccagccgcgcuacaugggccaagaacauucaaaccgcgaucaaucagguccggucccugauuggcaacgaggaauacacagacuauaugccuucuaugaaaagauuccgcaaggaggaagaggaagccggggugcugugguga

SEQ ID NO: 19938 - RNA, 9876 nt, Artificial Sequence
  derived and/or modified CDS sequence (opt5) from DENV-2__EU569711__SS-prME
acagccggcgugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauauccugggccggcucauuaccgucaacccuaucgugacagaaaaggacagcccgguuaacauugaggccgaacccccuuuuggggauucuuacaucaucauuggcguggagcccggacagcugaaacuuaauugguucaagaagggcuccagcaucgggcagauguuugagaccacaaugagaggagcuaaacgcauggccauucugggcgacaccgccugggauuucgggucucucggaggcgucuuuacgagcaucgggaaggcucugcaccaaguguucggcgccauuuacggagcggcuuuuuccggcguuucuuggacaaugaaaauccugaucggggugauuaucaccuggauuggaaugaacagccgguccaccagccuuucugucucccucgugcuggugggcguugucacacuguaucucggggugauggugcaggccgacagcggaugugucgugucuuggaagaauaaagaacugaagugcggcuccgggaucuucauuaccgauaacguucacacauggacggagcaguacaaguuucagccugaaagccccuccaaacuugccucugcuauccaaaaggcccaugaggaaggcaucuguggaauuagaagcgugacccgccuggagaaucucauguggaaacagaucacaccggagcugaaccacauucuguccgaaaaugaggucaaacuuaccaucaugacaggcgacauuaaagggaucaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguggaagacuacggauuuggcguuuucuccaccaacauuuggcuuaagcugcgggagaaacaggacguguuuugugauagcaagcucaugucugcugccaucaaagacaauagagcuguccacgccgauaugggcuauuggauugaauccgcgcugaacgacacauggaagauggagaaggccagcuucaucgaggugaaaucuugccacuggccuaagagccauacccugugguccaaugggguucuugaaagcgagaugauuauccccaaaaacuucgcuggaccggugucucagcacaacuaccgcccuggcuaucauacgcagacagccgggcccuggcaccucggaaagcuggaaauggauuuugacuucugugagggcaccaccgucguggugacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucgucaauucucugguuaccgccggccaugggcaaaucgauaacuuuagccugggagugcuuggcauggcccucuuccuggaagagaugcugagaacacgcguggggaccaaacacgcuauucuccuggucgcgguguccuuuguuacgcuuaucaccggaaauaugucuuuccgggaccugggcagagugauggucauggugggcgccacaaugaccgaugacauugggaugggaguuacauaucucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauccuggagcucaccgaugcccuggcccugggaaugaugguccuuaaaauugugcggaacauggaaaaguaccagcuggcuguuaccaucauggccauuagcugcgugccuaaugcggucauccuccaaaacgcuuggaagguguccuguacaauucuggccgccgugagcgucucuccccuccugcuuacguccagccagcagaaagcugacuggaucccucuggcccucaccaucaagggccugaaucccacagcuauuuuucugaccacacuuucucgcaccuccaaaaagagaagcuggccgcugaacgaggccguuauggcgguggggauggugucuauccucgccuccagccugcucaaaaaugacauuccuaugacgggaccccuggucgcuggcggccuucugacagugugcuauguucugaccgggcgguccgccgaucucgaacuggagcgcgcugccgacgugaagugggaggaucaggccgaaaucagcggaucuagcccuauucuuuccaucaccauuucugaggacggcagcauguccaucaaaaacgaagaggaggaacacacacugaccauccucauuagaacagggcugcucgucaucucuggaguguuccccguuagcauuccgaucacggcugcggccugguaccugugggaggugaagaagcaacgggcuggcguccuuugggaugugccuucucccccucccgucgggaaagccgaacuggaggacggagccuaucgcauuaagcagagaggcaucuuuggcuacagccagaucggggcuggaguguauaaagaaggcaccuuccauacaauguggcacguuaccagaggggccgugcugaugcaucgcggaaagagaauugagcccagcugggcggaugucaaaaaggaccucaucuccuacggcgggggauggaagcuggagggcgaauggaaagagggcgaagaggugcagguucuugcucuggaaccugggaagaauccgcgggccgugcaaacaaaacccggacucuuuaagaccaacacgggcaccauuggggccgucagccuggauuucucuccuggaacauccggcagccccaucguggacagaaaagggaaggugguuggacucuacggcaauggcgucgugacccgcucuggggcuuauguguccgccauugcgcagacagaaaagagcaucgaggauaacccugaaaucgaggacgauauuuuccggaaaaagagacugaccaucauggaccuucaccccggagcuggcaaaacaaagcgcuaccugccugccauuguccgggaagccaucaaaagagggcugcgcacgcucauucuggcuccgacccgggugguugccgcugagauggaagaggcccuuagaggacugcccauccgcuaucagaccccugcgauucgggccgagcauaccggcagagaaaucguggaccucaugugucacgcuaccuuuacaaugcggcugcucucccccguccgcgugccuaacuacaaucugaucauuauggaugaggcccacuucacggaccccgcuucuaucgccgccagaggguauauuagcacccggguugaaaugggcgaggcugcgggaaucuuuaugacagccaccccgccuggcucccgcgaucccuucccccagagcaacgcuccuauuauggacgaggaaagagagauccccgaacggucuuggaacuccgggcaugagugggugacagauuuuaagggaaagaccgucugguucgugccuagcaucaaagccggcaacgacauugccgcuugccuuagaaagaaugggaaaaagguuauccaacugucucgcaaaacguuugauagcgaauacgugaagacacgggccaacgacugggauuucgucgugaccaccgacauuuccgagaugggagcgaauuuuagagcugagcgcgugaucgauccgcggagauguaugaagcccgucauucugacagacggcgaggaacgcguuauccucgccgggccuaugcccgugacccacucuagcgccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauacaccggaagggauuaucccuuccauguucgagcccgaacgggagaagguggacgccauugauggagaauaccgccucagaggcgaggcucggaaaaccuuugucgaccugaugcgcagaggggaucugccuguguggcucgccuaucggguugcugccgagggaaucaacuacgcugacagacgcugguguuucgauggcauuaagaauaaccaaauccuugaagagaacguggaagucgagaucuggacgaaagagggggaacggaagaagcugaaacccagauggcuggacgcccgcauuuauucugauccucucgcgcugaaggaguucaaagaauuugccgcuggccggaagucccuuacacugaaucucaucaccgagaugggaagacugcccacauucaugacccagaaagcccgggacgcucuggauaaccucgccgugcuucacacggccgaaguuggcgggcgcgcuuacaaucacgcgcuguccgagcugccggagacccucgaaacacugcuucugcucacccugcuggccacagugaccggaggcauuuuucucuuccuuaugagcgggaagggaaucggcaagaugacacugggcaugugcugcauuaucaccgcuucuauccugcucugguaugcccagauucagccucauuggaucgccgcuuccauuauccuggaguuuuuccuuauuguccugcucauccccgaacccgagaaacaaagaacgccucaggacaaccagcugacauacguggucaucgccauucugaccgugguugcggccaccauggcuaaugaaaugggguuucucgagaagaccaagaaggaccuuggacugggcagcaucaccacacaggaguccgaaucuaacauucuggauaucgaccuccggccggccagcgcuuggacgcuguaugccguggcgaccacauucgugacccccaugcuucgccacuccauugaaaauucuagcgucaacguuucccugacagccaucgcuaaucaagccaccgugcucauggggcugggaagaggcuggccucugagcaaaauggauauuggggugccccuccuugcuaucggauguuacucucaggucaacccuaucacgcugaccgccgcucugcuccugcuuguggcccauuacgcgauuaucggccccggccugcaggccaaggcuacacgggaagcccagaagcgcgcugccgccgggauuaugaaaaauccuaccguugacggaaucacagugauugaucucgagccgauccccuaugacccuaaguuugaaaaacaacugggccaggucaugcugcucgugcuuugcgucacccaggugcugaugaugagaacgacaugggcgcugugugaggcucucacccuggccacagggcccaucuccacccuuugggagggaaacccuggccgguucuggaauaccacaauugcuguuagcauggccaacaucuuucgcgggucuuaccuggccggagcuggccuccuguucuccauuaugaagaauacgaccaacacaagacggggcaccgggaauaucggagaaacacugggcgagaaauggaaaagcagacucaacgcccuugggaagucugaauuucagauuuauaaaaagagcggaauccaagagguggaucgcacccuggcgaaagagggcaucaagagaggggaaacggaccaccaugccgucuccagaggaucugcuaaacugcgcugguucguggagcggaacaugguuacacccgaaggcaagguggucgaucucggcugcgggagaggaggcuggagcuacuauugugggggacugaaaaaugugcgcgaggugaagggccuuaccaaagggggaccgggccacgaggagccuauucccauguccaccuacggcuggaaccugguucggcuccagagcggggucgacguguucuuuacacccccugagaaaugcgauacccugcugugugacaucggagaauccucucccaauccuacaauugaggccggcagaacgcuccgcgugcuuaaccuggucgaaaauuggcugaacaauaacacccaguucugcaucaagguucucaauccguauaugcccagcgugauugagaaaauggaaacacugcaacggaaguacgggggagcucuugugagaaacccucugucccgcaauucuacccacgagauguacugggucagcaacgccacaggcaauaucguguccucuguuaacaugaucagccggaugcucauuaauagauuuaccaugaaacauaagaaggcgacguaugagcccgauguggaccugggguccggaacccgcaacaucggcauugaaaacgagaucccuaaucuggacauuaucggcaaaagaauugaaaagaucaaacaggagcacgaaacaagcuggcauuacgaucaggaccaccccuauaagaccugggccuaccacgggucuuaugagacaaaacagaccggauccgcuagcucuauggucaacggcgugguucggcuccuuacaaagccgugggauguggucccuauggugacccaaauggccaugacggacacaacccccuucgggcagcagcgcguguuuaaggagaaagucgauaccagaacacaggaaccuaaggagggaacgaaaaagcugaugcggaucaccgcugaauggcuguggaaagagcucggcaagaagaaaacacccagaauguguacccgggaggaguucacacgcaagguuagauccaaugccgcucugggggccauuuuuaccgacgagaacaaauggaaaagcgcgcgggaagccguggaggauucucgcuucugggaacuuguggacagagagcggaaucugcaucucgagggaaaaugcgaaacaugugucuacaacaugaugggcaagcgcgagaaaaagcugggcgaauuugggaaggcuaaaggauccagagccaucugguauauguggcugggcgcucgguuccucgaguuugaagcccugggguuccuuaaugaggaucacugguuuagccgcggaaacucccugagcggcguggagggggaaggccuccauaagcugggauacauucuuagagacguuucuaaaaaggagggcggggccauguacgcggaugacaccgcuggaugggacacgcggaucacccuggaagaucucaaaaaugaggaaauggugacaaaccacaugaagggcgagcauaagaaacuggccgaggccauuuucaagcugaccuaucaaaauaaagucgugcgcguucagagaccuacaccccgggggaccgugauggacaucaucagccgcaaggaucagagaggauccggccaggucgggacguacggccucaacacauucaccaauauggaagcucaacugauucggcagauggagggagaaggcaucuuuaaaucuauucagagacuuacagugaccgaggagaucgccguucaaaacuggcuggcucgcguggggcgggaaagacucagccgcauggccauuuccggagacgauugcgucgugaagccgcuggacgaucgguucgcgucugcccuuacggcucugaaugacaugggcaaggucagaaaagauauccagcagugggagccuagccgcggguggaacgacuggacccaggugcccuuuugcucccaccacuuccaugaacucguuaugaaggauggacgggugcuggucgugcccuguagaaaccaagacgagcugaucggccgcgcccggauuucucagggggcuggcuggagccucaaagaaacagccugccugggaaaguccuaugcgcagauguggacccuuauguacuuucacagacgcgaucugcggcucgccgcuaaugccaucuguagcgcugugccuucucauuggguuccgacauccagaaccacauggagcauucacgccaaacacgaguggaugaccacggaggacaugcuggcuguguggaaccgggucuggauccaggaaaaucccuggauggaggacaagacaccuguggaaucuugggaggaaguucccuaucuuggcaagagagaggaucaauggugcgggucccugauuggacucaccagccgcgccaccugggcgaaaaacauccagacagccauuaaucaggugcggucccugaucggcaacgaggaauacaccgacuauaugccuucuaugaagagauuccgcaaagaggaagaggaagcugggguccugugguga

SEQ ID NO: 19939 - RNA, 9876 nt, Artificial Sequence
  derived and/or modified CDS sequence (opt5) from DENV-2__EU569712__SS-prME
accgccggcaugaucauuaugcugauccccacggcuauggccuuccaccucacgaccagaaauggggaaccucauaugauugugggacggcaggaaaagggcaaaagccugcuuuuuaagacagaagacggggucaauaugugcacccugauggcgaucgaucucggagaacugugugaggacacaauuaccuacaaaugcccgcuucugcgccaaaaugaacccgaggauaucgacuguuggugcaauagcacaucuaccuggguuacguauggcaccuguacaaccacaggggagcacagacgggaaaagcgcagcguggcucucgugccucaugucggaaugggccuggagaccagaacggaaacauggauguccucugagggcgccuggaaacacgugcagcggaucgagaccuggauucugcgccaucccggguucacaaucauggccgcuauucucgccuacaccaucggaaccacacacuuucagagagcucugauuuucauccuucugacggccguugcgccuagcaugaccaugcggugcauuggcaucuccaaccgcgauuuuguggaaggggucucuggaggcagcuggguggacaucguucucgagcacggguccugugugacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccauggucgauagaggcuggggcaacggguguggacuguucggcaaagggggaaucgugacaugcgccauguuuacgugcaaaaagaauauggaaggcaaagugguccucccugagaaccuggaauacaccauuguuaucacaccccacagcggggaggagcaugcggugggaaaugacaccggcaagcacggcaaagaaaucaagauuacaccucagucuuccaucaccgaggccgaacuuacgggguauggaaccgugacaauggaguguagcccccggaccggccuggauuucaacgaaaugguccuccugcagauggaggacaaggcuuggcuugugcaccgccaaugguuucuggaucucccgcugccuuggcugcccggggccgacacacagggaucuaauuggauucagaaggagacccucguuacguucaagaacccucaugcuaaaaagcaggacguggucgugcugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauuguuaaagaaaucgcggagacacaacacggcacgaucgugauuagaguccaguaugagggggacggaucccccugcaagauccccuucgaaauuauggaucuggagaaacgcuacgugcugggccggcucaucaccgucaacccuauugugacagaaaaggacagcccgguuaacaucgaggccgaacccccuuuuggggauucuuacauuaucaucggcguggagcccggacagcugaaacuuaauugguucaagaagggcuccagcauugggcagauguuugagaccacaaugagaggagcuaaacgcauggccauccugggcgacaccgccugggauuucgggucucucggaggcgucuuuacgagcauugggaaggcucugcaucaaguguucggcgccaucuauggagcggcuuuuuccggcguuucuuggacaaugaaaauucugaucggggugaucauuaccuggaucggaaugaacagccgguccaccagccuuucugucucccucgugcuggugggcguugucacacuguaccucggggugauggugcaggccgacagcggaugugucgugucuuggaagaauaaagaacugaagugcggcuccgggauuuucaucaccgauaacguucacacauggacggagcaguauaaguuucagccugaaagccccuccaaacuugccucugcuauucaaaaggcccacgaggaaggcaucuguggaaucagaagcgugacccgccuggagaaucucauguggaaacagauuacaccggagcugaaccauauccuguccgaaaaugaggucaaacuuaccauuaugacaggcgacaucaaagggauuaugcaggcuggaaagcggucucucagaccucagcccaccgaacugaaauacagcuggaagacguggggcaaggccaaaaugcuguccaccgagagccacaaccaaacauuccucaucgaugggccugaaaccgcggagugccccaauacaaaccgcgccuggaacucucuggagguggaagacuauggauuuggcguuuucuccaccaacaucuggcuuaagcugcgggagaaacaggacguguuuugugauagcaagcucaugucugcugccauuaaagacaauagagcuguccaugccgauaugggcuacuggaucgaauccgcgcugaacgacacauggaagauggagaaggccagcuucauugaggugaaaucuugccacuggccuaagagccacacccugugguccaaugggguucuugaaagcgagaugaucauucccaaaaacuucgcuggaccggugucucagcauaacuaucgcccuggcuaccacacgcagacagccgggcccuggcaucucggaaagcuggaaauggauuuugacuucugugagggcaccaccgucguggugacagaagauugcgggaaucggggacccucccugagaaccacgacagcuagcggcaaacucaucaccgaguggugcugucgguccugcacacugccuccgcuucgcuacagaggcgaggacggguguugguauggaauggaaauucggccccugaaggagaaggaagagaaccucgucaauucucugguuaccgccggccacgggcaaaucgauaacuuuagccugggagugcuuggcauggcccucuuccuggaagagaugcugagaacacgcguggggaccaaacaugcuauccuccuggucgcgguguccuuuguuacgcuuauuaccggaaauaugucuuuccgggaccugggcagagugauggucauggugggcgccacaaugaccgaugacaucgggaugggaguuacauaccucgcucugcuggccgccuuuaaggugcgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugaugguccuuaaaaucgugcggaacauggaaaaguaucagcuggcuguuaccauuauggccauccucugcgugccuaaugcggucauucugcaaaacgcuuggaaggugagcuguacaauccucgccgccguguccgucagcccccugcuucugacgucuucccagcagaaagcugacuggauuccucucgcccugaccaucaagggccugaaucccacagcuaucuuucuuaccacacugagccgcaccucuaaaaagagauccuggccgcucaacgaggccguuauggcgguggggauggugagcauucuggccucuucccuccugaaaaaugacaucccuaugacgggaccccuugucgcuggcggccugcugacagugugcuacguucucaccgggcggagcgccgaucuggaacuugagcgcgcugccgacgugaagugggaggaucaggccgaaauuuccggaagcucuccuauccugagcauuaccaucuccgaggacggcucuaugagcauuaaaaacgaagaggaggaacaaacacucaccauccugaucagaacagggcuccuggucauuuccggaguguuccccguuucuaucccgauuacggcugcggccugguaucuuugggaggugaagaagcagcgggcuggcguccugugggaugugccuucucccccucccgucgaaaaagccgagcuggaagacggggccuaccgcaucaagcagagaggaauuuuuggcuauucccagaucggcgcugggguguacaaagagggaaccuuccacacaauguggcacguuacccggggcgccgugcucaugcaucgcgggaagagaaucgagcccuccugggcggaugucaaaaaggaccugauuagcuacggaggcggguggaaacuugaaggagaguggaaagaaggcgaggaagugcaaguucuggcucucgagccuggcaagaauccgcgggccgugcagacaaaacccgggcuguuuaagaccaacacgggaaccaucggcgccgucucccucgauuucagcccugggacaucuggaucccccauuguggacagaaaaggcaaggugguugggcuguauggaaauggcgucgugacccgcagcggcgcuuacgugucugccaucgcgcagacagagaaguccauugaagauaacccugagaucgaagacgauaucuuccggaaaaagagacuuaccauuauggaccugcaccccggggcuggaaaaacaaagcgcuaucugccugccaucguccgggaggccauuaaaagaggccuccgcacgcugauccuugcuccgacccgggugguugccgcugaaauggaggaggcccugagagggcuccccauucgcuaccagaccccugcgauccgggccgaacauaccggaagagagauuguggaccugaugugucacgcuaccuuuacaaugcggcuccugagccccguccgcgugccuaacuauaaucuuaucaucauggaugaagcccauuucacggaccccgcuuccauugccgccagaggcuacaucucuacccggguugagaugggggaggcugcgggcauuuuuaugacagccaccccgccuggaagccgcgaucccuucccccaauccaacgcuccuaucauggacgaagagagagaaauucccgagcggagcuggaacucuggccacgaaugggugacagauuuuaaggggaagaccgucugguucgugccuuccaucaaagccggaaacgacaucgccgcuugccugagaaagaauggcaaaaagguuauucagcugagccgcaaaacguuugauucugaguaugugaagacacgggccaacgacugggauuucgucgugaccaccgacaucagcgagaugggggcgaauuuuagagcugaacgcgugauugauccgcggagauguaugaagcccgucauccucacagacggagaggaacgcguuauucuggccggcccuaugcccgugacccacuccucugccgcucagcggagagggcgcaucggcagaaacccuaaaaaugagaacgaccaauacaucuacaugggagaaccccuugagaaugaugaggacugcgcccauuggaaggaagcgaaaaugcugcucgauaacauuaauacaccggagggcaucauuccuagcauguucgaacccgagcgggaaaagguggacgccaucgauggggaguaucgccugagaggagaggcucggaaaaccuuugucgaccugaugcgcagaggcgaucucccuguguggcuugccuaccggguugcugccgaagggauuaacuaugcugacagacgcugguguuucgauggaaucaagaauaaccagauucuggaggaaaacguggaggucgagaucuggacgaaagaaggcgagcggaagaagcugaaacccagauggcucgacgcccgcaucuacuccgauccucuggcgcuuaaggaguucaaagaguuugccgcugggcggaagucucugacacucaaucugauuaccgaaaugggcagacugcccacauucaugacccagaaagcccgggacgcucucgauaaccuugccgugcugcacacggccgagguuggaggccgcgcuuauaaucaugcgcugagcgagcucccggaaacccuggagacacuucugcuccugacccugcucgccacagugaccgggggaaucuuucuuuuccugauguccggcaaggggauuggaaagaugacacugggcaugugcugcaucauuaccgcuagcauccuccugugguacgcccagauccaaccucacuggauugccgcuucuaucauucuugaauuuuuccugaucguccuccugauucccgagcccgaaaaacagagaacgccucaggacaaccagcugacauauguggucaucgccauccucaccgugguugcggccaccauggcuaaugagaugggcuuucuugagaagaccaagaaggaccuggggcugggauccauuaucacccaagaaagcgaguccaacauucucgauaucgaccugcggccggccucugcuuggacacuuuacgccguggcgacgaccuucgugacacccaugcugcgccacagcauugaaaauuccucugucaacguuagccucaccgccaucgcuaaucaggccacagugcugaugggccuggggagaggauggccucucuccaaaauggauauuggcgugccccuucuggcuaucggguguuacagccaggucaacccuaucacccugacggccgcucuccugcuucugguggcccauuaugcgauuaucggacccggccuccaggccaaggcuacccgggaggcccaaaagcgcgcugccgccggcauuaugaaaaauccuacaguugacgggaucaccgugauugaucuggaaccgauccccuacgacccuaaguuugagaaacagcugggacaggucaugcuccuugugcugugcgucacacaggugcugaugaugagaaccacgugggcgcucugugaggcucugacacuugccaccggccccaucucuacacugugggaagggaacccuggacgguucuggaauaccaccauugcuguuuccauggccaacaucuuucgcggcagcuaucucgccggggcuggacugcuguucucuauuaugaagaauacaacgaacaccagacggggcacaggcaauaucggggagacccucggagaaaaauggaaguccagacuuaacgcccugggcaagagcgaguuucaaauuuacaaaaagucugggauccaggagguggaucgcacacuggcgaaagaaggaaucaagcggggcgagaccgaccaccaugccgucagcagaggguccgcuaaacuccgcugguucguggaacggaacaugguuacgcccgagggaaagguggucgaucugggcugcggcagagggggauggucuuauuacuguggcgggcuuaaaaaugugcgcgaagugaagggacugacaaagggcgggccgggacacgaggagccuauucccaugagcaccuauggcuggaaccucguucggcugcaguccggcgucgacguguucuuuacacccccugaaaaaugcgauacacugcucugugacaucggggagagcucccccaauccuaccauugaagccggaagaacacuucgcgugcugaaccuggucgagaauuggcucaacaauaacacgcaauucugcaucaagguucugaauccguacaugcccucugugauugagaagauggagacccuucagcggaaguacggcggggcucuggugagaaacccucucagccgcaauuccacacaugagauguauugggucucuaacgccaccggaaauaucgugagcuccguuaacaugaucucucggaugcugauuaauagauuuacaaugaaacacaagaaggcgaccuacgaacccgauguggaccugggcagcgggacgcgcaacaucggaauugagaacgaaaucccuaaucucgacauuaucggcaaaagaauugagaagaucaaacaggaacacgagaccuccuggcauuaugaucaggaccaccccuacaagacaugggccuaucauggcagcuacgagaccaaacaaacagggucugcuuccagcauggucaacggagugguucggcuucugaccaagccgugggauguggucccuauggugacacagauggccaugaccgacacgacacccuucggccagcagcgcguguuuaaggaaaaagucgauaccagaacccaagagccuaaggaagggaccaagaagcugaugcggaucacggcugaguggcucuggaaagagcugggaaagaagaaaacccccagaauguguacacgggaagaguucacccgcaagguuagaucuaaugccgcucuuggcgccauuuuuacagacgaaaacaaauggaaguccgcgcgggaggccguggaagauagccgcuucugggagcugguggacagagagcggaaucuccaccuggaagggaaaugcgagaccugugucuauaacaugaugggaaagcgcgagaaaaagcugggcgaguuuggcaaggcuaaagggucuagagccaucugguacauguggcucggagcucgguuccuggaauuugaggcccuuggcuuccugaaugaggaucacugguuuucccgcgggaacagccucuccggaguggaaggcgaggggcugcauaaacuuggcuacauucugagagacguuagcaaaaaggaaggaggcgccauguaugcggaugacacagcugggugggacacccggaucacgcucgaggaucugaaaaaugaagagauggugaccaaccacaugaagggagagcauaagaaacuggccgaagccauuuucaagcucacauaccagaauaaagucgugcgcguucagagaccuacaccccggggcacagugauggacaucaucucucgcaaggaucagagagggagcggacaagucggcaccuaugggcugaacacguucacaaauauggaggcucagcuuauucggcagauggaaggcgagggaaucuuuaaauccauucaacaccugaccgugacagaggaaaucgccguuagaaacuggcucgcucgcgugggccgggagagacugucucgcauggccauuagcggggacgauugcgucgugaagccgcuugacgaucgguucgcguccgcccugaccgcucucaaugacaugggaaaggucagaaaagauauccagcagugggaaccuucucgcggcuggaacgacuggacacaggugcccuuuugcagccaucacuuccacgagcugguuaugaaggaugggcgggugcuggucgugcccuguagaaaccaagacgaacucaucggacgcgcccggauuucccagggcgcuggguggucucugaaagagaccgccugccuuggcaagagcuacgcgcagauguggacacugauguauuuucauagacgcgaucuccggcuggccgcuaaugccaucuguuccgcugugccuagccacuggguuccgaccucuagaacaaccugguccauucaugccaaacacgaguggaugacaaccgaagacaugcuugcuguguggaaccgggucuggauccaggagaaucccuggauggaagacaagacgccuguggagagcugggaagagguucccuaccugggaaagagagaggaucaauggugcggcucucucauugggcugacaucccgcgccaccugggcgaaaaacauccagaccgccauuaaucaggugcggagccugaucggaaacgaagaguauacagacuacaugccuuccaugaagagauuccgcaaagaagaggaagaggcuggcguccucugguga

SEQ ID NO: 19940 - RNA, 9876 nt, Artificial Sequence
  derived and/or modified CDS sequence (opt5) from DENV-2__EU596487__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacacacacugaccauccucaucagaacagggcugcucgugauuucuggaguuuuccccgugagcaucccgauuacggcugcggccugguaccugugggaggucaagaagcaacgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccauacaauguggcacgugaccagaggggccguccugaugcaucgcggaaagagaaucgagcccagcugggcggaugugaaaaaggaccucauuuccuacggcgggggauggaagcuggagggcgaauggaaagagggcgaagagguucaggugcuugcucuggaaccugggaagaauccgcgggccguccaaacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaccccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcauaccggcagagaaauugucgaccucaugugucacgcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccagagcaacgcuccuaucauggacgaggaaagagagauucccgaacggucuuggaacuccgggcaugagugggucacagauuuuaagggaaagaccgugugguucguuccuagcaucaaagccggcaacgacaucgccgcuugccuuagaaagaaugggaaaaaggugauucaacugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccacucuagcgccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccaaauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucacacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccagccucauuggauugccgcuuccaucauucuggaguuuuuccuuaucgugcugcucauucccgaacccgagaaacaaagaacgccucaggacaaccagcugacauacgucgugaucgccauccugaccguuguggcggccaccauggcuaaugaaaugggguuucucgagaagaccaagaaggaccuuggacugggcagcauuaccacacaggaguccgaaucuaacauccuggauauugaccuccggccggccagcgcuuggacgcuguaugccguggcgaccacauucgucacccccaugcuucgccacuccaucgaaaauucuagcguuaacgugucccugacagccauugcuaaucaagccaccgugcucauggggcugggaagaggcuggccucugagcaaaauggauaucggggucccccuccuugcuauuggauguuacucucaggugaacccuaucacgcugaccgccgcucugcuccugcuuguugcccauuacgcgaucauuggccccggccugcaggccaaggcuacacgggaagcccagaagcgcgcugccgccgggaucaugaaaaauccuaccguggacggaauuacagucaucgaucucgagccgauucccuaugacccuaaguuugaaaaacaacugggccaggugaugcugcucguccuuugcgugacccagguucugaugaugagaacgacaugggcgcugugugaggcucucacccuggccacagggcccaucuccacccuuugggagggaaacccuggccgguucuggaauaccacaaucgcugugagcauggccaacauuuuucgcgggucuuaccuggccggagcuggccuccuguucuccaucaugaagaauacgaccaacacaagacggggcaccgggaauauuggagaaacacugggcgagaaauggaaaagcagacucaacgcccuugggaagucugaauuucagaucuauaaaaagagcggcauucaagaggucgaucgcacccuggcgaaagagggcaucaagagaggggaaacggaccaccaugccguguccagaggaucugcuaaacugcgcugguucguugagcggaacauggugacacccgaaggcaaggucguggaucucggcugcgggagaggaggcuggagcuacuauugugggggacugaaaaaugugcgcgagguuaagggccuuaccaaagggggaccgggccacgaggagccuauccccauguccaccuacggcuggaaccugguccggcuccagagcgggguggacguguucuuuacacccccugagaaaugcgauacccugcugugugacauuggagaauccucucccaauccuacaaucgaggccggcagaacgcuccgcguccuuaaccugguugaaaauuggcugaacaauaacacccaguucugcauuaaggugcucaauccguauaugcccagcgugaucgagaaaauggaaacacugcaacggaaguacgggggagcucuugucagaaacccucugucccgcaauucuacccacgagauguacugggugagcaacgccacaggcaauauuguuuccucugugaacaugaucagccggaugcucaucaauagauuuaccaugaaacauaagaaggcgacguaugagcccgaugucgaccugggguccggaacccgcaacauuggcaucgaaaacgagauuccuaaucuggacaucauuggcaaaagaaucgaaaagauuaaacaggagcacgaaacaagcuggcauuacgaucaggaccaccccuauaagaccugggccuaccacgggucuuaugagacaaaacagaccggauccgcuagcucuauggugaacggcguugugaagcuccuuacaaagccgugggaugucgugccuauggugacccaaauggccaugacggacacaacccccuucgggcagcagcgggucuuuaaagagaagguugauacccgcacacaggaaccuaaagagggaacgaagaaacugaugagaaucaccgcugaauggcuguggaaggagcucggcaagaaaaagacaccccggauguguaccagagaggaguucacacggaaagugcgcuccaaugccgcucugggggccaucuuuaccgacgagaacaaguggaaaagcgcgagagaagccguggaggauucucgguucugggaacuugucgaccgcgagagaaaucugcaucucgagggaaagugcgaaacauguguguacaacaugaugggcaaacgggagaagaagcugggcgaauuugggaaagcuaagggaucccgcgccauuugguauauguggcugggcgcuagauuccucgaguuugaagcccugggguuccuuaaugaggaucacugguuuagccggggaaacucccugagcggcguugagggggaaggccuccauaaacugggauacauccuucgcgacgugucuaagaaagagggcggggccauguacgcggaugacaccgcuggaugggacacgagaauuacccuggaagaucucaagaaugaggaaauggucacaaaccacaugaagggcgagcauaaaaagcuggccgaggccaucuucaaacugaccuaucaaaauaaggugguucgggugcagcgcccuacacccagagggaccgucauggacauuaucagccggaaagaucagcgcggauccggccagguggggacguacggccucaacacauucaccaauauggaagcucaacugaucagacagauggagggagaaggcauuuuuaagucuauccagcggcuuacaguuaccgaggagauugccgugcaaaacuggcuggcuagagucgggcgcgaacggcucagcagaauggccaucuccggagacgauugcguggucaagccgcuggacgaucgcuucgcgucugcccuuacggcucugaaugacaugggcaaagugcggaaggauauucagcagugggagccuagcagaggguggaacgacuggacccagguucccuuuugcucccaccacuuccaugaacucgugaugaaagauggacgcguccugguggugcccugucggaaccaagacgagcugaucggcagagcccgcaucucucagggggcuggcuggagccucaaggaaacagccugccugggaaaauccuaugcgcagauguggacccuuauguacuuucaccggagagaucugcgccucgccgcuaaugccauuuguagcgcuguuccuucucauugggugccgacaucccggaccacauggagcauccacgccaagcacgaguggaugaccacggaggacaugcuggcugucuggaacagaguguggauucaggaaaaucccuggauggaggacaagacaccuguugaaucuugggaggaagugcccuaucuuggcaaacgggaggaucaauggugcgggucccugaucggacucaccagcagagccaccugggcgaagaacauucagacagccaucaaucagguccgcucccugauuggcaacgaggaauacaccgacuauaugccuucuaugaaacgguucagaaaggaggaagaggaagcuggggugcugugguga

SEQ ID NO: 19941 - RNA, 9876 nt, Artificial Sequence
  derived and/or modified CDS sequence (opt5) from DENV-2__EU569713__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaucugacaccggcaagcacggcaaagaaaucaagauuacaccucaguccagcaucaccgaggccgaacuuacgggguauggaaccgucacaauggaguguucuccccggaccggccuggauuucaaugaaauggugcuccugcagauggaggacaaggcuuggcuuguucaccgccaaugguuucuggaucucccgcugccuuggcugcccggggccgacacacagggauccaacuggauucagaaggagacccucgugacguucaagaauccucaugcuaaaaagcaggacgucgugguucugggcagccaagaaggggccaugcacacagcccuuaccggcgcuacagagauccagauguccucuggaaaccugcucuuuaccggccaucugaaaugcagacuucggauggauaagcugcagcucaaagggaugagcuacuccauguguaccggaaaguucaagauugugaaagaaaucgcggagacacaacacggcacgaucgucauuagagugcaguaugagggggacggaagccccugcaagauccccuucgaaauuauggaucuggagaaacgcuacguccugggccggcucaucaccgugaauccuauuguuacagaaaaggacucuccggugaacaucgaggccgaacccccuuuuggggauuccuacauuaucaucggcgucgagcccggacagcugaaacuuaacugguucaagaagggcagcucuauugggcagauguuugagaccacaaugagaggagcuaaacgcauggccauccugggcgacaccgccugggauuucgggagccucggaggcguguuuacguccauugggaaggcucugcaucaaguuuucggcgccaucuauggagcggcuuuuucuggcgugagcuggacaaugaaaauucugaucggggucaucauuaccuggaucggaaugaacucccggagcaccucucuuuccgugagccucgugcugguuggcgucgugacacuguaccucggggugaugguccaggccgacucuggaugugugguuuccuggaagaacaaagaacugaagugcggcagcgggauuuucaucaccgauaaugugcacacauggacggagcaguauaaguuucagccugaaucccccucuaaacuugccagcgcuauucaaaaggcccacgaggaaggcaucuguggaaucagauccgucacccgccuggagaaccucauguggaaacagauuacaccggagcugaaucauauccugucugaaaacgaggcuaaacuuaccauuaugacaggcgacaucaaagggauuaugcaggccggaaagcggagccucagaccucagcccaccgaacugaaauacuccuggaagacguggggcaaggcgaaaaugcugagcaccgagucucacaaucaaacauuccucaucgaugggccugaaaccgccgagugccccaacacaaaucgcgcuuggaacucccuggagguggaagacuauggauuuggcguuuucagcaccaauaucuggcuuaagcugcgggagaaacaggacguguuuugugauucuaagcucauguccgccgcuauuaaagacaacagagccguccaugcggauaugggcuacuggaucgaaagcgcccugaaugacacauggaagauggagaaggcuucuuucauugaggugaaaagcugccacuggccuaagucccacacccuguggagcaacgggguucuugaaucugagaugaucauucccaaaaauuucgccggaccggugucccagcauaacuaucgcccuggcuaccacacgcagacagcugggcccuggcaucucggaaagcuggaaauggauuuugacuucugugagggcaccaccgucguggugacagaagauugcgggaaccggggacccagccugagaaccacgacagccuccggcaaacucaucaccgaguggugcugucggucuugcacacugccuccgcuucgcuacagaggcgaggacggguguugguauggaauggaaauucggccccugaaggagaaggaagagaaucucgucaacagccugguuaccgccggccacgggcaaaucgauaauuuuucccugggagugcuuggcauggcucucuuccuggaagagaugcugagaacacgcguggggaccaaacaugcgauccuccuggucgccgugucuuuuguuacgcuuauuaccggaaacaugagcuuccgggaccugggcagagugauggucauggugggcgcuacaaugaccgaugacaucgggaugggaguuacauaccucgcccugcuggccgcuuuuaaggugcgcccuaccuucgccgcgggccuucugcucagaaaacugacguccaaggagcucaugauggcuacaauugggaucgcccugcuuucucagagcaccauucccgaaacaauccuggagcucaccgaugcccuggcucugggaaugaugguccuuaaaaucgugcggaauauggaaaaguaucagcuggccguuaccauuauggcgauccucugcgugccuaacgcugucauucugcaaaaugccuggaagguguccuguacaauccucgccgcugugagcgucucuccccugcuucugacguccagccagcagaaagccgacuggauuccucucgcucugaccaucaagggccugaaccccacagccaucuuucuuaccacacugucucgcaccuccaaaaagagaagcuggccgcucaaugaggcgguuauggccguggggauggugucuauucuggcuuccagccuccugaaaaacgacaucccuaugacgggaccccuugucgccggcggccugcugacagugugcuacguucucaccgggcgguccgcugaucuggaacuugagcgcgccgccgacgugaagugggaggaucaggcugaaauuagcggaucuagcccuauccuguccauuaccaucucugaggacggcagcauguccauuaaaaaugaagaggaggaacaaacacucaccauccugaucagaacagggcuccuggucauuucuggaguguuccccguuagcaucccgauuacggcggccgcuugguaucuuugggaggugaagaagcagcgggccggcguccugugggaugugccuucucccccucccgucgggaaagccgaacuggaggacggagcuuaccgcaucaagcagagaggcauuuuuggcuauagccagaucggggccggaguguacaaagaaggcaccuuccacacaauguggcacguuaccagaggggcggugcucaugcaucgcggaaagagaaucgagcccagcugggcugaugucaaaaaggaccugauuuccuacggcgggggauggaaacuugagggcgaauggaaagagggcgaagaggugcaaguucuggcccucgaaccugggaagaacccgcgggccgugcagacaaaacccggacuguuuaagaccaauacgggcaccaucggggcugucagccucgauuucucuccuggaacauccggcagccccauuguggacagaaaagggaaggugguuggacuguauggcaacggcgucgugacccgcucuggggccuacguguccgcgaucgcucagacagaaaagagcauugaggauaauccugaaaucgaggacgauaucuuccggaaaaagagacuuaccauuauggaccugcaccccggagccggcaaaacaaagcgcuaucugccugccaucguccgggaagcuauuaaaagagggcuccgcacgcugauccuugccccgacccgggugguugcugccgagauggaagaggcgcugagaggacuccccauucgcuaccagaccccugccauccgggcugagcauaccggcagagaaauuguggaccugaugugucacgccaccuuuacaaugcggcuccugucccccguccgcgugccuaacuauaaccuuaucaucauggaugaggcucauuucacggaccccgccucuauugccgcuagaggguacaucagcacccggguugaaaugggcgaggcggccggaauuuuuaugacagcuaccccgccuggcucccgcgaucccuucccccaaagcaaugccccuaucauggacgaggaaagagagauucccgaacggucuuggaacuccgggcacgagugggugacagauuuuaagggaaagaccgucugguucgugccuagcaucaaagccggcaaugacaucgcugccugccugagaaagaacgggaaaaagguuauucagcugucucgcaaaacguuugauagcgaauaugugaagacacgggcgaaugacugggauuucgucgugaccaccgacaucuccgagaugggagcuaacuuuagagccgagcgcgugauugauccgcggagauguaugaagcccgucauccucacagacggcgaggaacgcguuauucuggccgggccuaugcccgugacccacucuagcgcugcccagcggagaggccgcaucggaagaaauccuaaaaacgaaaaugaccaauacaucuacaugggcgagccccuugaaaacgaugaggacugcgcgcauuggaaggaggccaaaaugcugcucgauaauauuaacacaccggaagggaucauuccuuccauguucgagcccgaacgggagaagguggacgcuaucgauggagaauaucgccugagaggcgaggcccggaaaaccuuugucgaccugaugcgcagaggggaucucccuguguggcuugcuuaccggguugccgcugagggaauuaauuaugccgacagacgcugguguuucgauggcaucaagaacaaucagauucuggaagagaacguggaagucgagaucuggacgaaagagggggaacggaagaagcugaaacccagauggcucgacgcgcgcaucuacucugauccucuggcccuuaaggaguucaaagaauuugcugccggccggaagucccugacacucaaccugauuaccgagaugggaagacugcccacauucaugacccagaaagcucgggacgcccucgauaaucuugccgugcugcacacggcugaaguuggcgggcgcgcguauaaccaugcccuguccgagcucccggagacccuggaaacacuucugcuccugacccugcucgcuacagugaccggaggcaucuuucuuuuccugaugagcgggaagggaauuggcaagaugacacugggcaugugcugcaucauuaccgccucuauccuccugugguacgcccagauccaaccucacuggauugcugccuccaucauucuugaguuuuuccugaucguccuccugauucccgaacccgagaaacagagaacgccucaggacaaucagcugacauauguggucaucgcgauccucaccgugguugccgcuaccauggccaacgaaaugggguuucuugagaagaccaagaaggaccugggacugggcagcauuaucacccaagaguccgaaucuaauauucucgauaucgaccugcggccggcuagcgccuggacacuuuacgcgguggccacgaccuucgugacacccaugcugcgccacuccauugagaacucuagcgucaauguuucccucaccgcuaucgccaaccaggcuacagugcugauggggcugggaagaggcuggccucucagcaaaauggauauuggggugccccuucuggccaucggauguuacucucaggucaauccuaucacccugacggcugcccuccugcuucugguggcgcauuaugccauuaucggccccggccuccaggcuaaggccacccgggaagcucaaaagcgcgccgccgcggggauuaugaaaaacccuacaguugacggaaucaccgugauugaucuggagccgauccccuacgacccuaaguuugaaaaacagcugggccaggucaugcuccuugugcugugcgucacacaggugcugaugaugagaaccacgugggcucucugugaggcccugacacuugcuaccgggcccaucuccacacugugggagggaaauccuggccgguucuggaacaccaccauugccguuagcauggccaauaucuuucgcgggucuuaucucgcuggagccggccugcuguucuccauuaugaagaacacaacgaauaccagacggggcacagggaacaucggagaaacccucggcgagaaauggaaaagcagacuuaaugcgcuggggaagucugaauuucaaauuuacaaaaagagcggaauccaggagguggaucgcacacuggccaaagagggcaucaagagaggggaaaccgaccaccaugcugucuccagaggaucugccaaacuccgcugguucguggagcggaacaugguuacgcccgaaggcaagguggucgaucugggcugcgggagaggaggcuggagcuauuacugugggggacuuaaaaacgugcgcgaggugaagggccugacaaaagggggaccgggccacgaggagccuauucccauguccaccuauggcuggaaucucguucggcugcagagcggggucgacguguucuacacacccccugagaaaugcgauacacugcucugugacaucggagaauccucucccaacccuaccauugaggcuggcagaacacuucgcgugcugaaucuggucgaaaacuggcucaauaacaauacgcaauuuugcaucaagguucugaacccguacaugcccagcgugauugagaaaauggaaacccuucagcggaaguaugggggagcccuggugagaaauccucucucccgcaacucuacacaugagauguacugggucagcaaugcgaccggcaacaucguguccucuguuaauaugaucagccggaugcugauuaacagauucacaaugaaacacaagaaggccaccuaugagcccgauguggaccugggguccggaacgcgcaauaucggcauugaaaacgagaucccuaaccucgacauuaucggcaaaagaauugaaaagaucaaacaggagcacgaaaccagcuggcauuacgaucaggaccaccccuauaagacaugggcuuaccaugggucuuaugagaccaaacaaacaggauccgccagcucuauggucaauggcgugguucggcuucugaccaagccgugggauguggucccuauggugacacagauggcuaugaccgacacgacacccuuugggcagcagcgcguguucaaggagaaagucgauaccagaacccaagaaccuaaggagggaaccaagaagcugaugcggaucacggccgaauggcucuggaaagagcugggcaagaagaaaacccccagaauguguacacgggaggaauuuacccgcaagguuagauccaacgcugcccuuggggcgauuuucacagacgagaauaaauggaaaagcgcccgggaagcuguggaggauucucgcuuuugggaacugguggacagagagcggaaccuccaccuggagggaaaaugcgaaaccugugucuacaauaugaugggcaagcgcgagaaaaagcugggcgaguucgggaaggccaaaggauccagagcuaucugguacauguggcucggcgcccgguuucuggaguucgaagcccuuggguuucugaacgaggaucacugguucagccgcggaaauucccucagcggcguggagggggaaggccugcauaaacuuggauauauucugagagacguuucuaaaaaggagggcggggcgauguacgcugaugacacagccggaugggacacccggaucacgcucgaagaucugaaaaacgaggaaauggugaccaaucacaugaagggcgagcauaagaaacuggccgaggcuauuuuuaagcucacauaucagaacaaagucgugcgcguucagagaccuacaccccgggggacagugauggacaucaucagccgcaaggaucagagaggauccggccaagucgggaccuacggccugaauacguucacaaacauggaagcccagcuuauucggcagauggagggagaaggcaucuucaaaucuauucaacaccugaccgugacagaggagaucgcuguucagaauuggcucgccagaguggggcgcgaacggcugagcagaauggcgauuuccggagacgauugcgucgugaagccgcuugacgaucgcuuugccucugcucugaccgcccucaacgacaugggcaagguccggaaagauauccagcagugggagccuagcagaggguggaaugacuggacgcaagugcccuucugcucccaucacuuucacgaacugguuaugaaggauggacgcgugcuggucgugcccugucggaaccaggacgagcucaucggcagagcucgcauuucucagggggccggcuggagccugaaagaaaccgcgugccuuggaaaguccuaugcccagauguggacacugauguacuuccaucggagagaucuccgccuggcugccaacgcuaucuguagcgccgugccuucucacuggguuccgaccucccggacaaccuggagcauucaugcuaaacacgaguggaugacaaccgaggacaugcuugccguguggaauagagucuggauccaagaaaaccccuggauggaggacaagacgccuguggaaucuugggaggaaguucccuaucugggcaagcgggaggaucaguggugcgggucccucauuggacugacaagcagagcgaccugggccaaaaauauccagaccgcuauuaaccaggugcgcucccugaucggcaaugaggaauacacagacuacaugccuucuaugaagcgguuuagaaaagaggaagagaaggccgggguccucugguga

SEQ ID NO: 19942 - RNA, 9876 nt, Artificial Sequence
  derived and/or modified CDS sequence (opt5) from DENV-2__EU569714__SS-prME
accgccggcgugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgugauccuccugguugcuguguccuuugucacgcuuauuaccggaaauaugucuuuccgggaccugggcagagugaugguuauggugggcgcgacaaugaccgaugacaucgggaugggagucacauaucucgcccugcuggcugccuuuaaggugcgcccuaccuucgccgcuggccuucugcucagaaaacugacgagcaaggagcucaugauggccacaauugggaucgcgcugcuuucccagucuaccauucccgaaacaauccuggagcucaccgaugcucuggcccugggaaugaugguucuuaaaaucgugcggaacauggaaaaguaccagcuggccgucaccauuauggcuaucagcugcgugccuaaugccgugauucuccaaaacgcguggaaggucuccuguacaauccuggcuguugugagcgugucuccccuccugcuuacguccagccagcagaaagccgacuggauuccucuggcccucaccaucaagggccugaaucccacagcuaucuuucugaccacacuuucucgcaccuccaaaaagagaagcuggccgcugaacgaggccgucauggcuguggggaugguuucuauucucgccuccagccugcucaaaaaugacaucccuaugacgggaccccugguggcgggcggccuucugacagucugcuaugugcugaccgggcgguccgccgaucucgaacuggagcgcgcugccgacguuaagugggaggaucaggcugaaauuagcggaucuagcccuauccuuuccauuaccaucucugaggacggcagcauguccauuaaaaacgaagaggaggaacaaacacugaccauccucaucagaacagggcugcucgugauuucuggagucuuccccgugagcaucccgauuacggccgccgcuugguaccugugggaggucaagaagcagcgggcgggcgugcuuugggauguuccuagcccuccucccguggggaaagccgaacuggaggacggagcuuaucgcaucaagcagagaggcauuuuuggcuacucucagaucggggccggagucuauaaagaaggcaccuuccacacaauguggcaugugaccagaggggccguucugaugcaccgcggaaagagaaucgagcccagcugggcugaugugaaaaaggaccucauuuccuacggcgggggauggaagcuggagggcgaauggaaagagggcgaagagguccaagugcuugcccuggaaccugggaagaauccgcgggcggugcagacaaaacccggacucuuuaagaccaacacgggcaccaucggggcuguuagccuggauuucucuccuggaacauccggcagccccauugucgacagaaaagggaagguggugggacucuacggcaauggcgucgugacccgcucuggggccuauguuuccgccaucgcucagacagaaaagagcauugaggauaacccugaaaucgaggacgauaucuuccggaaaaagagacugaccauuauggaccuucaucccggagccggcaaaacaaagcgcuaccugccugcgaucgugcgggaagcuauuaaaagagggcugcgcacgcucauccuggccccgacccgggucguggccgcugagauggaagaggcccuuagaggacugcccauucgcuaucagacacccgcuauccgggccgagcacaccggcagagaaauuguugaccucaugugucaugcgaccuuuacaaugcggcugcucucccccgugcgcgucccuaacuacaaucugaucaucauggaugaggcccacuucacggaccccgcuucuauugccgcuagaggguauaucagcacccggguggaaaugggcgaggccgccggaauuuuuaugacagcuaccccgccuggcucccgcgaucccuucccccaaagcaacgcgccuaucauggacgaggaaagagagauucccgaacggucuuggaacuccgggcacgaguggguuacagauuuuaagggaaagaccgugugguucgucccuagcaucaaagccggcaacgacaucgcugccugccuuagaaagaaugggaaaaaggugauucagcugucucgcaaaacguuugauagcgaauacgugaagacacgggccaacgacugggauuucgucguuaccaccgacaucuccgagaugggagcuaauuuuagagccgagcgcgugauugauccgcggagauguaugaagcccgugauccugacagacggcgaggaacgcgucauucucgcggggccuaugcccgugacccauucuagcgcugcccagcggagaggccgcaucggaagaaacccuaaaaaugaaaacgaccaauauaucuacaugggcgagccccuggaaaaugaugaggacugcgcccacuggaaggaggcuaaaaugcuucuggauaacauuaauacaccggaagggaucauuccuuccauguucgagcccgaacgggagaagguugacgccaucgauggagaauaccgccucagaggcgaggcgcggaaaaccuuuguggaccugaugcgcagaggggaucugccugucuggcucgccuaucggguggcugccgagggaauuaacuacgcugacagacgcugguguuucgauggcaucaagaauaaccagauucuugaagagaacguugaaguggagaucuggacgaaagagggggaacggaagaagcugaaacccagauggcuggacgcccgcaucuauucugauccucucgcucugaaggaguucaaagaauuugccgcgggccggaagucccuuacacugaaucucauuaccgagaugggaagacugcccacauucaugacccagaaagcccgggacgcucuggauaaccucgccguccuucauacggcugaagugggcgggcgcgccuacaaucacgcccuguccgagcugccggagacccucgaaacacugcuucugcucacccugcuggcugcggucacaggaggcaucuuucucuuccuuaugagcgggaagggaauuggcaagaugacccugggcaugugcugcaucauuacagccucuauccugcucugguaugcucagauccaaccucacuggauugccgccuccaucauucuggaguuuuuccuuaucgugcugcucauucccgaacccgagaaacagagaaccccucaggacaaccagcugacguacguugugaucgcuauccugacaguggucgccgcgaccauggccaaugaaaugggguuucucgagaagaccaaaaaggaccuuggacugggcagcauuaucacacaagaguccgaaucuaacauucuggauaucgaccuccggccggcuagcgccuggacccuguaugcuguugccacaacguucgugacccccaugcuucgccauuccauugaaaauucuagcgugaacgucucccugacagcgaucgccaaucaggcuaccgugcucauggggcugggaagaggcuggccucugagcaaaauggauauugggguuccccuccuugccaucggauguuacucucaggugaacccuaucacacugaccgcugcccugcuccugcuugucgcucacuacgccauuaucggccccggccugcaggcgaaggccacgcgggaagcucaaaagcgcgccgcugccgggauuaugaaaaauccuaccguggacggaaucacagucauugaucucgagccgauccccuaugacccuaaguuugaaaaacagcugggccaggugaugcugcucguucuuugcgugacccagguccugaugaugagaacaaccugggcccugugugaggcgcucacgcuggcuacagggcccaucuccacccuuugggagggaaacccuggccgguucuggaauacaaccauugccgugagcauggcuaacaucuuucgcgggucuuaccuggccggagccggccuccuguucuccauuaugaagaauaccacaaacacgagacggggcaccgggaauaucggagaaacacugggcgagaaauggaaaagcagacucaacgcucuugggaagucugaauuucaaauuuauaaaaagagcggaauccaggagguugaucgcacccuggccaaagagggcaucaagagaggggaaacagaccaucacgcgguguccagaggaucugccaaacugcgcugguucgucgagcggaacauggugacccccgaaggcaaggugguugaucucggcugcgggagaggaggcuggagcuacuauugugggggacugaaaaauguccgcgaggugaagggccuuacgaaagggggaccgggccaugaggagccuauucccauguccacauacggcuggaaccuggugcggcuccagagcggggucgacguuuucuuuacacccccugagaaaugcgauacccugcugugugacaucggagaauccucucccaauccuacaauugaggcuggcagaacccuccgcgugcuuaaccugguggaaaauuggcugaacaauaacacacaauucugcaucaagguccucaauccguauaugcccagcgugauugagaaaauggaaacgcugcagcggaaguacgggggagcccuuguuagaaacccucugucccgcaauucuacccacgagauguacugggugagcaacgcuacaggcaauaucgucuccucugugaacaugaucagccggaugcucauuaauagauuuaccaugaaacacaagaaggccacauaugagcccgauguugaccugggguccggaacccgcaacaucggcauugaaaacgagaucccuaaucuggacauuaucggcaaaagaauugaaaagaucaaacaggagcaugaaacgagcuggcacuacgaucaggaccaucccuauaagaccugggcguaccacgggucuuaugagacaaaacaaaccggauccgccagcucuauggugaacggcgucgugcggcuccuuacaaagccgugggauguggucccuaugguuacccagauggcuaugacagacaccacgcccuucgggcagcagcgcguguuuaaggagaaaguggauacaagaacccaagaaccuaaggagggaaccaaaaagcugaugcggaucacagccgaauggcuguggaaagagcucggcaagaagaaaacgcccagaauguguacccgggaggaguucacacgcaaggucagauccaaugcugcccugggggcuauuuuuaccgacgagaacaaauggaaaagcgcccgggaagcgguggaggauucucgcuucugggaacuuguugacagagagcggaaucugcaccucgagggaaaaugcgaaacauguguguacaacaugaugggcaagcgcgagaaaaagcugggcgaauuugggaaggccaaaggauccagagcuaucugguauauguggcugggcgcccgguuccucgaguuugaagcucugggguuccuuaaugaggaucauugguuuagccgcggaaacucccugagcggcgucgagggggaaggccuccacaagcugggauacauucuuagagacgugucuaaaaaggagggcggggccauguacgccgaugacaccgcgggaugggacacacggaucacccuggaagaucucaaaaaugaggaaaugguuacgaaccauaugaagggcgagcacaagaaacuggcugaggccauuuucaagcugaccuaucagaauaaagugguccgcgugcagagaccuacaccccgggggaccguuauggacaucaucagccgcaaggaucagagaggauccggccaaguggggacauacggccucaacaccuucacgaauauggaagcccagcugauucggcagauggagggagaaggcaucuuuaaaucuauucaacaucuuacagucaccgaggagaucgcugugcagaacuggcuggccagagucgggcgcgaacggcucagcagaauggcuauuuccggagacgauugcgugguuaagccgcuggacgaucgcuucgccucugcgcuuacagcccugaaugacaugggcaaggugcggaaagauauccagcagugggagccuagcagaggguggaacgacuggacccaaguccccuuuugcucccaccacuuccaugaacucgugaugaaggauggacgcgugcugguugugcccugucggaaccaggacgagcugaucggcagagcucgcauuucucagggggccggcuggagccucaaagaaacggcuugccugggaaaguccuaugcccagauguggacccuuauguacuuucaccggagagaucugcgccucgcggccaaugcuaucuguagcgccgucccuucucauugggugccgacaucccggaccacauggagcauucacgcuaaacacgaguggaugaccacagaggacaugcuggccguuuggaacagaguguggauccaagaaaaucccuggauggaggacaagaccccugucgaaucuugggaggaagugcccuaucuuggcaagcgggaggaucaguggugcgggucccugauuggacucacgagcagagcuacaugggccaaaaacauccagaccgcgauuaaucagguccgcucccugaucggcaacgaggaauacaccgacuauaugccuucuaugaagcgguucagaaaagaggaagaggaagccggggugcugugguga

SEQ ID NO: 19943 - RNA, 9876 nt, Artificial Sequence
  derived and/or modified CDS sequence (opt5) from DENV-2__EU569715__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacacacacugaccauccucaucagaacagggcugcucgugauuucuggaguuuuccccgugagcaucccgauuacggcugcggccugguaccugugggaggucaagaagcaacgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccauacaauguggcacgugaccagaggggccguccugaugcaucgcggaaagagaaucgagcccagcugggcggaugugaaaaaggaccucauuuccuacggcgggggauggaagcuggagggcgaauggaaagagggcgaagagguucaggugcuugcucuggaaccugggaagaauccgcgggccguccaaacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaccccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcauaccggcagagaaauugucgaccucaugugucacgcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccagagcaacgcuccuaucauggacgaggaaagagagauucccgaacggucuuggaacuccgggcaugagugggucacagauuuuaagggaaagaccgugugguucguuccuagcaucaaagccggcaacgacaucgccgcuugccuuagaaagaaugggaaaaaggugauucaacugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccacucuagcgccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccaaauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucacacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccagccucauuggauugccgcuuccaucauucuggaguuuuuccuuaucgugcugcucauucccgaacccgagaaacaaagaacgccucaggacaaccagcugacauacgucgugaucgccauccugaccguuguggcggccaccauggcuaaugaaaugggguuucucgagaagaccaagaaggaccuuggacugggcagcauuaccacacaggaguccgaaucuaacauccuggauauugaccuccggccggccagcgcuuggacgcuguaugccguggcgaccacauucgucacccccaugcuucgccacuccaucgaaaauucuagcguuaacgugucccugacagccauugcuaaucaagccaccgugcucauggggcugggaagaggcuggccucugagcaaaauggauaucggggucccccuccuugcuauuggauguuacucucaggugaacccuaucacgcugaccgccgcucugcuccugcuuguugcccauuacgcgaucauuggccccggccugcaggccaaggcuacacgggaagcccagaagcgcgcugccgccgggaucaugaaaaauccuaccguggacggaauuacagucaucgaucucgagccgauucccuaugacccuaaguuugaaaaacaacugggccaggugaugcugcucguccuuugcgugacccagguucugaugaugagaacgacaugggcgcugugugaggcucucacccuggccacagggcccaucuccacccuuugggagggaaacccuggccgguucuggaauaccacaaucgcugugagcauggccaacauuuuucgcgggucuuaccuggccggagcuggccuccuguucuccaucaugaagaauacgaccaacacaagacggggcaccgggaauauuggagaaacacugggcgagaaauggaaaagcagacucaacgcccuugggaagucugaauuucagaucuauaaaaagagcggcauucaagaggucgaucgcacccuggcgaaagagggcaucaagagaggggaaacggaccaccaugccguguccagaggaucugcuaaacugcgcugguucguugagcggaacauggugacacccgaaggcaaggucguggaucucggcugcgggagaggaggcuggagcuacuauugugggggacugaaaaaugugcgcgagguuaagggccuuaccaaagggggaccgggccacgaggagccuauccccauguccaccuacggcuggaaccugguccggcuccagagcgggguggacguguucuuuacacccccugagaaaugcgauacccugcugugugacauuggagaauccucucccaauccuacaaucgaggccggcagaacgcuccgcguccuuaaccugguugaaaauuggcugaacaauaacacccaguucugcauuaaggugcucaauccguauaugcccagcgugaucgagaaaauggaaacacugcaacggaaguacgggggagcucuugucagaaacccucugucccgcaauucuacccacgagauguacugggugagcaacgccacaggcaauauuguuuccucugugaacaugaucagccggaugcucaucaauagauuuaccaugaaacauaagaaggcgacguaugagcccgaugucgaccugggguccggaacccgcaacauuggcaucgaaaacgagauuccuaaucuggacaucauuggcaaaagaaucgaaaagauuaaacaggagcacgaaacaagcuggcauuacgaucaggaccaccccuauaagaccugggccuaccacgggucuuaugagacaaaacagaccggauccgcuagcucuauggugaacggcguugugaagcuccuuacaaagccgugggaugucgugccuauggugacccaaauggccaugacggacacaacccccuucgggcagcagcgggucuuuaaagagaagguugauacccgcacacaggaaccuaaagagggaacgaagaaacugaugagaaucaccgcugaauggcuguggaaggagcucggcaagaaaaagacaccccggauguguaccagagaggaguucacacggaaagugcgcuccaaugccgcucugggggccaucuuuaccgacgagaacaaguggaaaagcgcgagagaagccguggaggauucucgguucugggaacuugucgaccgcgagagaaaucugcaucucgagggaaagugcgaaacauguguguacaacaugaugggcaaacgggagaagaagcugggcgaauuugggaaagcuaagggaucccgcgccauuugguauauguggcugggcgcuagauuccucgaguuugaagcccugggguuccuuaaugaggaucacugguuuagccggggaaacucccugagcggcguugagggggaaggccuccauaaacugggauacauccuucgcgacgugucuaagaaagagggcggggccauguacgcggaugacaccgcuggaugggacacgagaauuacccuggaagaucucaagaaugaggaaauggucacaaaccacaugaagggcgagcauaaaaagcuggccgaggccaucuucaaacugaccuaucaaaauaaggugguucgggugcagcgcccuacacccgggggaaccgucauggacauuaucagcagaaaagaucagcggggcuccggacaggugggcacguacggacucaacacauucaccaauauggaagcucaacugauccgccagauggagggcgaagggauuuuuaagucuauccagagacuuacaguuaccgaggagauugccgugcaaaacuggcuggcucgggucggaagagaacgccucagccggauggccaucuccggcgacgauugcguggucaagccgcuggacgauagauucgcgucugcccuuacggcucugaaugacauggggaaagugcgcaaggauauucagcagugggagccuagccggggauggaacgacuggacccagguucccuuuugcucccaccacuuccaugaacucgugaugaaagauggcagaguccugguggugcccugucgcaaccaagacgagcugaucgggcgggccagaaucucucagggcgcuggauggagccucaaggaaacagccugccugggcaaauccuaugcgcagauguggacccuuauguacuuucaccgccgggaucugagacucgccgcuaaugccauuuguagcgcuguuccuucucauugggugccgacaucccgcaccacauggagcauccacgccaagcacgaguggaugaccacggaggacaugcuggcugucuggaaccggguguggauucaggaaaaucccuggauggaggacaagacaccuguugaaucuugggaggaagugcccuaucuugggaaaagagaggaucaauggugcggaucccugaucggccucaccagccgggccaccugggcgaagaacauucagacagccaucaaucaggucagaucccugauugggaacgaggaauacaccgacuauaugccuucuaugaaacgcuuccggaaggaggaagaggaagcuggagugcugugguga

SEQ ID NO: 19944 - RNA, 9876 nt, Artificial Sequence
  derived and/or modified CDS sequence (opt5) from DENV-2__EU569716__SS-prME
accgccggcgugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacaccauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuauuugcaaaaagaauauggaagggaaagucguucucccugagaaccuggaauacacgaucgugaucacaccccacagcggggaggagcaugcggugggaaaugacacaggcaagcacggcaaagaaauuaagaucaccccucagucuuccauuacagaggccgaacuuaccggguauggaacggucaccauggaguguagcccccggacaggccuggauuucaacgaaauggugcuccugcagauggaggacaaggcuuggcuuguucaccgccaaugguuucuggaucucccgcugccuuggcugcccggggccgacacccagggaucuaauuggauccagaaggagacacucgugaccuucaagaacccucaugcuaaaaagcaggacgucgugguucugggcucccaagaaggggccaugcacacggcccuuacaggcgcuaccgagauucagaugagcuccggaaaucugcucuuuacaggccaucugaaaugcagacuucggauggauaagcugcagcucaaagggaugucuuacagcauguguaccggaaaguucaagaucgugaaagaaaucgcggagacccaacacggcacaauugucaucagagugcaguaugagggggacggaucccccugcaagauucccuucgaaaucauggaucuggagaaacgcuacguccugggccggcucauuacggugaacccuaucguuaccgaaaaggacagcccggugaacauugaggccgaacccccuuuuggggauucuuacaucaucauuggcgucgagcccggacagcugaaacuuaauugguucaagaagggcuccagcaucgggcagauguuugagacaaccaugagaggagcuaaacgcauggccauucugggcgacacagccugggauuucgggucucucggaggcguguuuaccagcaucgggaaggcucugcaucaaguuuucggcgccauuuauggagcggcuuuuuccggcgugucuuggacgaugaaaauccugaucggggucauuaucacauggauuggaaugaacagccgguccaccagccuuucugugucccucgugcugguuggcgucgugacccuguaccucggggugaugguccaggccgacagcggaugugugguuucuuggaagaauaaagaacugaagugcggcuccgggaucuucauuacagauaacgugcacaccuggacagagcaguauaaguuucagccugaaagccccuccaaacuugccucugcuauccaaaaggcccacgaggaaggcaucuguggaauuagaagcgucacgcgccuggagaaucucauguggaaacagaucaccccggagcugaaccauauucuguccgaaaaugaggugaaacuuacaaucaugaccggcgacauuaaagggaucaugcaggcuggaaagcggucucucagaccucagcccacagaacugaaauacagcuggaagaccuggggcaaggccaaaaugcuguccacggagagccacaaccaaaccuuccucaucgaugggccugaaacagcggagugccccaauaccaaccgcgccuggaacucucuggagguugaagacuauggauuuggcguguucuccacaaacauuuggcuuaagcugcgggagaaacaggacgucuuuugugauagcaagcucaugucugcugccaucaaagacaauagagcugugcaugccgauaugggcuacuggauugaauccgcgcugaacgacaccuggaagauggagaaggccagcuucaucgagguuaaaucuugccacuggccuaagagccacacacugugguccaauggggugcuugaaagcgagaugauuauccccaaaaacuucgcuggaccggucucucagcauaacuaucgcccuggcuaccacacccagacggccgggcccuggcaucucggaaagcuggaaauggauuuugacuucugugagggcacaaccgugguggucaccgaagauugcgggaaucggggacccucccugagaacaaccacggcuagcggcaaacucauuacagaguggugcugucgguccugcacccugccuccgcuucgcuacagaggcgaggacggguguugguauggaauggaaauccggccccugaaggagaaggaagagaaccucguuaauucucuggugacagccggccacgggcaaaucgauaacuuuagccugggagugcuuggcauggcccucuuccuggaagagaugcugagaacccgcgucgggacaaaacaugcuauucuccugguggcgguuuccuuugugacccuuaucacgggaaauaugucuuuccgggaccugggcagagucauggugaugguuggcgccaccaugacagaugacauugggaugggagugaccuaccucgcucugcuggccgccuuuaagguccgcccuacauucgcugccggccuucugcucagaaaacugaccagcaaggagcucaugauggcgacgaucgggauugcucugcuuucccagucuacaauccccgaaaccauccuggagcucacagaugcccuggcccugggaaugauggugcuuaaaauuguucggaacauggaaaaguaucagcuggcugugaccaucauggccauucucugcgucccuaaugcggugauccugcaaaacgcuuggaaggugagcuguaccauucucgccgccgucuccguuagcccccugcuucugacaucuucccagcagaaagcugacuggaucccucucgcccugacgaucaagggccugaaucccaccgcuauuuuucuuacaacccugagccgcacaucuaaaaagagauccuggccgcucaacgaggccgugauggcgguggggauggucagcauccuggccucuucccuccugaaaaaugacauuccuaugaccggaccccuuguggcuggcggccugcugacgguuugcuacgugcucacagggcggagcgccgaucuggaacuugagcgcgcugccgacgucaagugggaggaucaggccgaaaucuccggaagcucuccuauucugagcaucaccauuuccgaggacggcucuaugagcaucaaaaacgaagaggaggaacaaacccucacaauccugauuagaaccgggcuccuggugaucuccggaguuuuccccgugucuauuccgaucacagcugcggccugguaucuuugggaggucaagaagcagcgggcuggcgugcugugggaugucccuucucccccucccguggggaaagccgaacuggaggacggagccuaccgcauuaagcagagaggcaucuuuggcuauucccagaucggggcuggaguuuacaaagaaggcacguuccacaccauguggcacgugacaagaggggccguccucaugcaucgcggaaagagaauugagcccuccugggcggaugugaaaaaggaccugaucagcuacggcgggggauggaaacuugagggcgaauggaaagagggcgaagagguucaagugcuggcucucgaaccugggaagaauccgcgggccguccagaccaaacccggacuguuuaagacaaacaccggcacgauuggggccgugucccucgauuucagcccuggaaccucuggcucccccaucguggacagaaaagggaagguugucggacuguauggcaauggcguggugacacgcagcggggcuuacgucucugccauugcgcagaccgagaaguccaucgaggauaacccugaaaucgaggacgauauuuuccggaaaaagagacuuacaaucauggaccugcaccccggagcuggcaaaaccaagcgcuaucugccugccauugugcgggaagccaucaaaagagggcuccgcacacugauucuugcuccgacgcggguuguggccgcugagauggaagaggcccugagaggacuccccauccgcuaccagaccccugcgauucgggccgagcauacaggcagagaaaucgucgaccugaugugucacgcuaccuuuaccaugcggcuccugagccccgugcgcguuccuaacuauaaucuuaucauuauggaugaggcccauuucacagaccccgcuuccaucgccgccagaggguacauuucuacgcggguggaaaugggcgaggcugcgggaaucuuuaugaccgccacaccgccuggcagccgcgaucccuucccccaauccaacgcuccuauuauggacgaggaaagagagauccccgaacggagcuggaacucugggcacgagugggucaccgauuuuaagggaaagacagugugguucguuccuuccaucaaagccggcaacgacauugccgcuugccugagaaagaaugggaaaaaggugauccagcugagccgcaaaaccuuugauucugaauaugucaagacgcgggccaacgacugggauuucguggugacaaccgacauuagcgagaugggagcgaauuuuagagcugagcgcgucaucgauccgcggagauguaugaagcccguuauucucaccgacggcgaggaacgcgugauccuggccgggccuaugcccgugacacacuccucugccgcucagcggagaggccgcaucggaagaaacccuaaaaaugaaaacgaccaauacauuuacaugggcgagccccuugaaaaugaugaggacugcgcccauuggaaggaggcgaaaaugcugcucgauaacaucaauaccccggaagggauuaucccuagcauguucgagcccgaacgggagaaggucgacgccauugauggagaauaucgccugagaggcgaggcucggaaaacauuuguggaccugaugcgcagaggggaucucccuguuuggcuugccuaccggguggcugccgagggaaucaacuaugcugacagacgcugguguuucgauggcauuaagaauaaccagauccuggaagagaacgucgaaguggagaucuggaccaaagagggggaacggaagaagcugaaacccagauggcucgacgcccgcauuuacuccgauccucuggcgcuuaaggaguucaaagaauuugccgcuggccggaagucucugacgcucaaucugaucacagagaugggaagacugcccaccuucaugacacagaaagcccgggacgcucucgauaaccuugccguucugcacaccgccgaagugggcgggcgcgcuuauaaucaugcgcugagcgagcucccggagacgcuggaaacccuucugcuccugacacugcucgccaccgucacaggaggcauuuuucuuuuccugauguccgggaagggaaucggcaagaugacccugggcaugugcugcauuaucacagcuagcauccuccugugguacgcccagauucaaccucacuggaucgccgcuucuauuauccuugaguuuuuccugauugugcuccugauccccgaacccgagaaacagagaaccccucaggacaaccagcugacguaugucgugaucgccauucucacaguuguggcggccaccauggcuaaugaaaugggguuucuugagaagaccaaaaaggaccugggacugggcuccaucauuacacaagagagcgaauccaacauccucgauauugaccugcggccggccucugcuuggacccuuuacgccguggcgacaacguucgucacccccaugcugcgccacagcaucgaaaauagcucuguuaacgugagccucacagccauugcuaaucaggccaccgugcugauggggcugggaagaggcuggccucucuccaaaauggauaucggggucccccuucuggcuaucggauguuacagccaggugaacccuauuacacugaccgccgcucuccugcuucugguugcccauuaugcgaucauuggccccggccuccaggccaaggcuacgcgggaagcccaaaagcgcgcugccgccgggaucaugaaaaauccuaccguggacggaauuacagucaucgaucuggagccgauccccuacgacccuaaguuugaaaaacagcugggccaggugaugcuccuuguccugugcgugacccagguucugaugaugagaacaaccugggcgcucugugaggcucugacgcuugccacagggcccauuucuacccugugggagggaaacccuggccgguucuggaauacaaccaucgcuguguccauggccaacauuuuucgcgggagcuaucucgccggagcuggccugcuguucucuaucaugaagaauaccacaaacacgagacggggcaccgggaauauuggagaaacacucggcgagaaauggaaguccagacuuaacgcccugggaaagagcgaauuucaaaucuacaaaaagucuggaauccaggaggucgaucgcacccuggcgaaagagggcauuaagagaggggaaacagaccaccaugccgugagcagaggauccgcuaaacuccgcugguucguugagcggaacauggugacccccgaaggcaaggucguggaucugggcugcgggagaggaggcuggucuuauuacugugggggacuuaaaaaugugcgcgagguuaagggccugacgaaagggggaccgggccacgaggagccuauccccaugagcacauauggcuggaaccucguccggcugcaguccgggguggacguguucuuuacacccccugagaaaugcgauacccugcucugugacauuggagaaagcucccccaauccuacaaucgaggccggcagaacccuucgcguccugaaccugguugaaaauuggcucaacaauaacacacaauucugcauuaaggugcugaauccguacaugcccucugugaucgagaaaauggaaacgcuucagcggaaguacgggggagcucuggucagaaacccucucagccgcaauuccacccaugagauguauugggugucuaacgccacaggcaauaucguuagcuccgugaacaugauuucucggaugcugaucaauagauuuaccaugaaacacaagaaggcgacauacgagcccgaugucgaccuggggagcggaacccgcaacauuggcaucgaaaacgagauuccuaaucucgacaucauuggcaaaagaaucgaaaagaucaaacaggagcacgaaacguccuggcauuaugaucaggaccaccccuacaagaccugggccuaucaugggagcuacgagacaaaacaaaccggaucugcuuccagcauggugaacggcguugugcggcuucugacaaagccgugggaugucgugccuauggugacccagauggccaugacagacaccacgcccuucgggcagcagcgcgucuuuaaggagaaaguugauacaagaacccaagaaccuaaggagggaaccaaaaagcugaugcggauuacagcugaauggcucuggaaagagcugggcaagaagaaaacgcccagaauguguacccgggaggaguucacacgcaaggugagaucuaaugccgcucuuggggccaucuuuaccgacgagaacaaauggaaguccgcgcgggaagccguggaggauagccgcuucugggaacuggucgacagagagcggaaucuccaccuggagggaaaaugcgaaacauguguguauaacaugaugggcaagcgcgagaaaaagcugggcgaauuugggaaggcuaaaggaucuagagccauuugguacauguggcucggcgcucgguuccuggaguuugaagcccuuggguuccugaaugaggaucacugguuuucccgcggaaacagccucuccggcguugagggggaaggccugcauaaacuuggauacauccugagagacgugagcaaaaaggagggcggggccauguaugcggaugacaccgcuggaugggacacacggauuacccucgaagaucugaaaaaugaggaaauggucacgaaccacaugaagggcgagcauaagaaacuggccgaggccaucuucaagcucaccuaccagaauaaagugguucgcgugcagagaccuacaccccgggggaccgucauggacaucauuucucgcaaggaucagagaggaagcggccaaguggggacauauggccugaacaccuucacgaauauggaagcucagcuuauccggcagauggagggagaaggcauuuuuaaauccauccaacaccugacaguuaccgaggagauugccgugcagaacuggcucgcuagagucgggcgcgaacggcugucuagaauggccaucagcggagacgauugcguggucaagccgcuugacgaucgcuucgcguccgcccugacagcucucaaugacaugggcaaggugcggaaagauauccagcagugggagccuucuagaggguggaacgacuggacccaaguucccuuuugcagccaucacuuccacgaacuggugaugaaggauggacgcguccugguggugcccugucggucccaggacgagcucauuggcagagcccgcaucucucagggggcuggcuggagccugaaagaaacggccugccuuggaaaguccuacgcgcagauguggacccugauguauuuucaucggagagaucuccgccuggccgcuaacgccauuuguagcgcuguuccuucucacugggugccgacaucccggaccacauggagcauccaugccaaacacgaguggaugaccacagaggacaugcuugcugucuggaauagaguguggauucaagaaaaccccuggauggaggacaagaccccuguugaaucuugggaggaagugcccuaccugggcaagcgggaggaucaguggugcgggucccucaucggacugacgagcagagccacaugggcgaaaaauauucagaccgccaucaaccagguccgcucccugaucggcaaugaggaauauaccgacuacaugccuucuaugaagcgguucagaaaagaggaagaggaagcuggggugcucugguga

SEQ ID NO: 19945 - RNA, 9876 nt, Artificial Sequence
  derived and/or modified CDS sequence (opt5) from DENV-2__EU569717__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacacacacugaccauccucaucagaacagggcugcucgugauuucuggaguuuuccccgugagcaucccgauuacggcugcggccugguaccugugggaggucaagaagcaacgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccauacaauguggcacgugaccagaggggccguccugaugcaucgcggaaagagaaucgagcccagcugggcggaugugaaaaaggaccucauuuccuacggcgggggauggaagcuggagggcgaauggaaagagggcgaagagguucaggugcuugcucuggaaccugggaagaauccgcgggccguccaaacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaccccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcauaccggcagagaaauugucgaccucaugugucacgcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccagagcaacgcuccuaucauggacgaggaaagagagauucccgaacggucuuggaacuccgggcaugagugggucacagauuuuaagggaaagaccgugugguucguuccuagcaucaaagccggcaacgacaucgccgcuugccuuagaaagaaugggaaaaaggugauucaacugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccacucuagcgccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccaaauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucacacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccagccucauuggauugccgcuuccaucauucuggaguuuuuccuuaucgugcugcucauucccgaacccgagaaacaaagaacgccucaggacaaccagcugacauacgucgugaucgccauccugaccguuguggcggccaccauggcuaaugaaaugggguuucucgagaagaccaagaaggaccuuggacugggcagcauuaccacacaggaguccgaaucuaacauccuggauauugaccuccggccggccagcgcuuggacgcuguaugccguggcgaccacauucgucacccccaugcuucgccacuccaucgaaaauucuagcguuaacgugucccugacagccauugcuaaucaagccaccgugcucauggggcugggaagaggcuggccucugagcaaaauggauaucggggucccccuccuugcuauuggauguuacucucaggugaacccuaucacgcugaccgccgcucugcuccugcuuguugcccauuacgcgaucauuggccccggccugcaggccaaggcuacacgggaagcccagaagcgcgcugccgccgggaucaugaaaaauccuaccguggacggaauuacagucaucgaucucgagccgauucccuaugacccuaaguuugaaaaacaacugggccaggugaugcugcucguccuuugcgugacccagguucugaugaugagaacgacaugggcgcugugugaggcucucacccuggccacagggcccaucuccacccuuugggagggaaacccuggccgguucuggaauaccacaaucgcugugagcauggccaacauuuuucgcgggucuuaccuggccggagcuggccuccuguucuccaucaugaagaauacgaccaacacaagacggggcaccgggaauauuggagaaacacugggcgagaaauggaaaagcagacucaacgcccuugggaagucugaauuucagaucuauaaaaagagcggcauucaagaggucgaucgcacccuggcgaaagagggcaucaagagaggggaaacggaccaccaugccguguccagaggaucugcuaaacugcgcugguucguugagcggaacauggugacacccgaaggcaaggucguggaucucggcugcgggagaggaggcuggagcuacuauugugggggacugaaaaaugugcgcgagguuaagggccuuaccaaagggggaccgggccacgaggagccuauccccauguccaccuacggcuggaaccugguccggcuccagagcgggguggacguguucuuuacacccccugagaaaugcgauacccugcugugugacauuggagaauccucucccaauccuacaaucgaggccggcagaacgcuccgcguccuuaaccugguugaaaauuggcugaacaauaacacccaguucugcauuaaggugcucaauccguauaugcccagcgugaucgagaaaauggaaacacugcaacggaaguacgggggagcucuugucagaaacccucugucccgcaauucuacccacgagauguacugggugagcaacgccacaggcaauauuguuuccucugugaacaugaucagccggaugcucgucaauagauuuaccaugaaacauaagaaggcgacguaugagcccgauguggaccugggguccggaacccgcaacaucggcauugaaaacgagaucccuaaucuggacauuaucggcaaaagaauugaaaagaucaaacaggagcacgaaacaagcuggcauuacgaucaggaccaccccuauaagaccugggccuaccacgggucuuaugagacaaaacagaccggauccgcuagcucuaugguuaacggcgugguccggcuccuuacaaagccgugggauguggugccuauggucacccaaauggccaugacggacacaacccccuucgggcagcagcgcguuuuuaaggagaaaguggauaccagaacacaggaaccuaaggagggaacgaaaaagcugaugcggauuaccgcugaauggcuguggaaagagcucggcaagaagaaaacacccagaauguguacccgggaggaguucacacgcaaggugagauccaaugccgcucugggggccaucuuuaccgacgagaacaaauggaaaagcgcgcgggaagccgucgaggauucucgcuucugggaacuuguggacagagagcggaaucugcaucucgagggaaaaugcgaaacauguguuuacaacaugaugggcaagcgcgagaaaaagcugggcgaauuugggaaggcuaaaggauccagagccaucugguauauguggcugggcgcucgguuccucgaguuugaagcccugggguuccuuaaugaggaucacugguuuagccgcggaaacucccugagcggcguggagggggaaggccuccauaagcugggauacauucuuagagacgucucuaaaaaggagggcggggccauguacgcggaugacaccgcuggaugggacacgcggaucacccuggaagaucucaaaaaugaggaaauggugacaaaccacaugaagggcgagcauaagaaacuggccgaggccauuuucaagcugaccuaucaaaauaaaguugugcgcguccagagaccuacaccccgggggaccgugauggacaucauuagccgcaaggaucagagaggauccggccagguugggacguacggccucaacacauucaccaauauggaagcucaacugauccggcagauggagggagaaggcaucuuuaaaucuauucagagacuuacagugaccgaggagaucgccguccaaaacuggcuggcucgcguggggcgggaaagacucagccgcauggccauuuccggagacgauugcgucgugaagccgcuggacgaucgguucgcgucugcccuuacggcucugaaugacaugggcaagguuagaaaagauauccagcagugggagccuagccgcggguggaacgacuggacccaggugcccuuuugcucccaccacuuccaugaacucgucaugaaggauggacgggugcuggugguucccuguagaaaccaagacgagcugauuggccgcgcccggaucucucagggggcuggcuggagccucaaagaaacagccugccugggaaaguccuaugcgcagauguggacccuuauguacuuucacagacgcgaucugcggcucgccgcuaaugccaucuguagcgcugugccuucucauugggucccgacauccagaaccacauggagcauucacgccaaacacgaguggaugaccacggaggacaugcuggcuguguggaaccggguuuggauccaggaaaaucccuggauggaggacaagacaccuguggaaucuugggaggaaguccccuaucuuggcaagagagaggaucaauggugcgggucccugauuggacucaccagccgcgccaccugggcgaaaaacauccagacagccauuaaucaggugcggucccugaucggcaacgaggaauacaccgacuauaugccuucuaugaagagauuccgcaaagaggaagaggaagcugggguccugugguga

SEQ ID NO: 19946 - RNA, 9876 nt, Artificial Sequence
  derived and/or modified CDS sequence (opt5) from DENV-2__EU569718__SS-prME
acagccggcgugaucauuaugcugauccccacagcuauggccuuccaccucacgacccggaauggggagccucauaugauugugggacggcaggaaaagggcaagagccugcuuuuuaagacagaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggaguaugcggugggaaaugacaccggcaagcauggcaaagaaaucaagauuacaccucagucuuccaucaccgaggccgaacuuacgggguacggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucacgcuaaaaagcaggacgucgugguucugggcucccaagaaggggccaugcauacagcccuuaccggcgcuacagagauccagaugagcuccggaaaucugcucuuuaccggccaccugaaaugcagacuucggauggauaagcugcagcucaaagggaugucuuauagcauguguaccggaaaguucaagauugugaaagaaaucgcggagacacaacauggcacgaucgucauuagagugcaguacgagggggacggaucccccugcaagauccccuucgaaauuauggaucuggagaaacgccacguccugggccggcucaucaccgugaacccuauuguuacagaaaaggacagcccggugaacgucgaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaucaaguguucggcgccauuuauggagcggcuuuuuccggcgucucuuggacaaugaaaauccugauuggggugaucaucaccuggauuggaaugaacagccgguccaccagccuuucugugucccucguucuggucggcguggugacacuguaccucggggucauggugcaggccgacagcggauguguugugucuuggaagaauaaagaacugaagugcggcuccgggaucuucauuaccgauaacguccacacauggacggagcaguauaaguuucagccugaaagccccuccaaacuugccucugcuauccaaaaggcccacgaggaaggcauuuguggaaucagaagcgugacccgccuggagaaucucauguggaaacagaucacaccggagcugaaccauauucuguccgaaaaugagguuaaacuuaccaucaugacaggcgacauuaaagggaucaugcaggcuggaaagcggucucucagaccucagcccaccgaacugaaauacagcuggaagacguggggcaaggccaaaaugcuguccaccgagagccacaaccaaacauuccucauugaugggccugaaaccgcggagugccccaauacaaaccgcgccuggaacucucuggagguggaagacuauggauuuggcgucuucuccaccaacaucuggcuuaagcugcgggagaaacaggacguguuuugugauagcaagcucaugucugcugccaucaaagacaauagagcuguucaugccgauaugggcuacuggauugaauccgcgcugaacgacacauggaagauggagaaggccagcuucaucgaggugaaaucuugccacuggccuaagagccacacccugugguccaaugggguccuugaaagcgagaugauuauccccaaaaacuucgcuggaccggugucucagcauaacuaucgcccuggcuaccacacgcagacagccgggcccuggcaucucggaaagcuggaaauggauuuugacuucugugagggcaccaccguggucguuacagaagauugcgggaaucggggacccucccugagaaccacgacagcuagcggcaaacucauuaccgaguggugcugucgguccugcacacugccuccgcuucgcuacagaggcgaggacggguguugguauggaauggaaauccggccccugaaggagaaggaagagaaccucgucaauucucuggugaccgccggccacgggcaaauugauaacuuuagccugggaguccuuggcauggcccucuuccuggaagagaugcugagaacacgcguggggaccaaacaugcuauccuccugguugcgguguccuuugucacgcuuaucaccggaaauaugucuuuccgggaccugggcagagugaugguuauggugggcgccacaaugaccgaugacauugggaugggagucacauaccucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauucuggagcucaccgaugcccuggcccugggaaugaugguucuuaaaaucgugcggaacauggaaaaguaucagcuggcugucaccaucauggccauuagcugcgugccuaaugcggugauccuccaaaacgcuuggaaggucuccuguacaauucuggccgccguuagcgugucuccccuccugcuuacguccagccagcagaaagcugacuggaucccucuggcccucaccauuaagggccugaaucccacagcuaucuuucugaccacacuuucucgcaccuccaaaaagagaagcuggccgcugaacgaggccgugauggcggucgggauggugucuauccucgccuccagccugcucaaaaaugacauuccuaugacgggaccccugguugcuggcggccuucugacagugugcuacguccugaccgggcgguccgccgaucucgaacuggagcgcgcugccgacgugaagugggaggaucaggccgaaaucagcggaucuagcccuauucuuuccaucaccauuucugaggacggcagcauguccaucaaaaacgaagaggaggaacaaacacugaccauucucaucagaacagggcugcucguuaucucuggaguguuccccgucagcauuccgaucacggcugcggccugguaucugugggaggugaagaagcagcgggcuggcguccuuugggaugugccuucucccccucccguugggaaagccgaacuggaggacggagccuaccgcauuaagcagagaggcaucuuuggcuauagccagauuggggcuggaguguacaaagaaggcaccuuccacacaauguggcacgucaccagaggggccgugcugaugcaucgcggaaagagaaucgagcccagcugggcggauguuaaaaaggaccucaucuccuacggcgggggauggaagcuggagggcgaauggaaagagggcgaagaggugcaaguccuugcucuggaaccugggaagaauccgcgggccgugcagacaaaacccggacucuuuaagaccaacacgggcaccauuggggccgugagccuggauuucucuccuggaacauccggcagccccaucguugacagaaaagggaaggucgugggacucuauggcaauggcguggucacccgcucuggggcuuacguguccgccauugcgcagacagaaaagagcaucgaggauaacccugaaauugaggacgauaucuuccggaaaaagagacugaccaucauggaccuucaccccggagcuggcaaaacaaagcgcuaucugccugccauuguucgggaagccaucaaaagagggcugcgcacgcucauucuggcuccgacccggguggucgccgcugagauggaagaggcccuuagaggacugcccauccgcuaccagaccccugcgauucgggccgagcauaccggcagagaaaucguggaccucaugugucacgcuaccuuuacaaugcggcugcucucccccguucgcgugccuaacuauaaucugauuaucauggaugaggcccauuucacggaccccgcuucuaucgccgccagaggguacauuagcacccgggucgaaaugggcgaggcugcgggaaucuuuaugacagccaccccgccuggcucccgcgaucccuucccccaaagcaacgcuccuauuauggacgaggaaagagagauccccgaacggucuuggaacuccgggcacgagugggugacagauuuuaagggaaagaccguuugguucgugccuagcauuaaagccggcaacgacaucgccgcuugccuuagaaagaaugggaaaaaggucauccagcugucucgcaaaacguuugauagcgaauaugugaagacacgggccaacgacugggauuucguggucaccaccgacauuuccgagaugggagcgaauuuuagagcugagcgcguuaucgauccgcggagauguaugaagcccgugauucugacagacggcgaggaacgcgugauccucgccgggccuaugcccgucacccacucuagcgccgcucagcggagaggccgcauuggaagaaacccuaaaaaugaaaacgaccaauacaucuacaugggcgagccccuggaaaaugaugaggacugcgcccauuggaaggaggcgaaaaugcuucuggauaacaucaauacaccggaagggauuaucccuuccauguucgagcccgaacgggagaagguggacgccauugauggagaauaucgccucagaggcgaggcucggaaaaccuuuguugaccugaugcgcagaggggaucugccuguguggcucgccuaccgggucgcugccgagggaaucaacuaugcugacagacgcugguguuucgauggcauuaagaauaaccagauccuugaagagaacguggaaguugagauuuggacgaaagagggggaacggaagaagcugaaacccagauggcuggacgcccgcaucuacucugauccucucgcgcugaaggaguucaaagaauuugccgcuggccggaagucccuuacacugaaucucaucaccgagaugggaagacugcccacauucaugacccagaaagcccgggacgcucuggauaaccucgccgugcuucacacggccgaagucggcgggaaggcuuauaaucaugcgcuguccgagcugccggagacccucgaaacacugcuucugcucacccugcuggccacagugaccggaggcauuuuucucuuccuuaugagcgggaagggaaucggcaaaaugacacugggcaugugcugcauuaucaccgcuucuauucugcucugguacgcccagauccaaccucacuggaucgccgcuuccauuauccuggaguuuuuccuuauuguccugcucauccccgaacccgagaagcagcgcacgccucaggacaaccagcugacauaugugguuauugccauccugaccgugguggcggccaccauggcuaaugaaaugggguuucucgagaaaacaaagaaagaccuuggacugggcagcaucaccacacaagaguccgaaucuaacauucuggauaucgaccucagaccggccagcgcuuggacgcuguacgccgucgcgaccacauucguuacccccaugcuucggcacuccauugaaaauucuagcgugaacgugucccugacagccaucgcuaaucaggccaccguccucauggggcugggacgcggcuggccucugagcaagauggauauuggggugccccuccuugcuaucggauguuacucucagguuaacccuauuacgcugaccgccgcucugcuccugcuuguggcccauuaugcgaucaucggccccggccugcaggccaaggcuacaagagaagcccaaaaacgggcugccgccgggauuaugaagaauccuaccgucgacggaaucacagugauugaucucgagccgauccccuacgacccuaaauuugaaaagcagcugggccaggucaugcugcucgugcuuugcguuacccaggugcugaugaugcgcacgacaugggcgcugugugaggcucucacccuggccacagggcccauuuccacccuuugggagggaaacccuggcagauucuggaauaccacaaucgcugucagcauggccaacaucuuucgggggucuuaucuggccggagcuggccuccuguucuccauuaugaaaaauacgaccaacacacgcagaggcaccgggaauaucggagaaacacugggcgagaaguggaaaagccggcucaacgcccuugggaaaucugaauuucaaauuuacaagaaaagcggaauccaggagguggauagaacccuggcgaaggagggcauuaaacgcggggaaacggaccaccaugccguuucccggggaucugcuaagcugagaugguucguggagcgcaacauggucacacccgaaggcaaagugguggaucucggcugcgggcggggaggcuggagcuauuacugugggggacugaagaauguuagagaggucaagggccuuaccaaagggggaccgggccacgaggaaccuauccccauguccaccuauggcuggaaccuggugcgccuccagagcgggguggacgucuucuuuacacccccugagaagugcgauacccugcugugugacaucggagaauccucucccaauccuacaauugaggccggccggacgcucagaguucuuaaccugguggaaaauuggcugaacaauaacacccaauucugcaucaaagugcucaauccguacaugcccagcgucauugagaagauggaaacacugcagcgcaaauacgggggagcucuugugcggaacccucuguccagaaauucuacccaugagauguauuggguuagcaacgccacaggcaauaucguguccucugucaacaugauuagccgcaugcucaucaaucgguuuaccaugaagcacaagaaagcgacguacgagcccgauguggaccugggguccggaaccagaaacaucggcauugaaaacgagaucccuaaucuggacauuaucggcaagcgcauugagaagaucaagcaggagcacgaaacaagcuggcauuaugaucaggaccaccccuacaaaaccugggccuaucaugggucuuacgagacaaagcaaaccggauccgcuagcucuaugguuaacggcguggucagacuccuuacaaagccgugggauguggugccuauggucacccagauggccaugacggacacaacccccuucgggcagcagcggguuuuuaaagagaagguggauacccgcacacaagaaccuaaagagggaacgaagaaacugaugagaauuaccgcugaauggcuguggaaggagcucggcaagaaaaagacaccccggauguguaccagagaggaguucacacggaaagugcgcuccaaugccgcucugggggccaucuuuaccgacgagaacaaguggaaaagcgcgagagaagccgucgaggauucucgguucugggaacuuguggaccgcgagagaaaucugcaccucgagggaaagugcgaaacauguguuuauaacaugaugggcaaacgggagaagaagcugggcgaauuugggaaagcuaagggaucccgcgccaucugguacauguggcugggcgcuagauuccucgaguuugaagcccugggguuccuuaaugaggaucacugguuuagccggggaaacucccugagcggcguggagggggaaggccuccauaaacugggauacauucuucgcgacgucucuaagaaagagggcggggccauguaugcggaugacaccgcuggaugggacacgagaaucacccuggaagaucucaagaaugaggaaauggugacaaaccacaugaagggcgagcauaaaaagcuggccgaggccauuuucaaacugaccuaccagaauaagguugugcggguccagcgcccuacacccagagggaccgugauggacaucauuagccggaaagaucagcgcggauccggccaaguugggacguauggccucaacacauucaccaauauggaagcucagcugaucagacagauggagggagaaggcaucuuuaagucuauucaacggcuuacagugaccgaggagaucgccguccagaacuggcuggcuagaguggggcgcgaacggcucagcagaauggccauuuccggagacgauugcgucgugaagccgcuggacgaucgcuucgcgucugcccuuacggcucugaaugacaugggcaaaguucggaaggauauccagcagugggagccuagcagaggguggaacgacuggacccaagugcccuuuugcucccaccauuuccacgaacucgucaugaaagauggacgcgugcuggugguucccugucggaaccaggacgagcugauuggcagagcccgcaucucucagggggcuggcuggagccucaaggaaacagccugccugggaaaauccuacgcgcagauguggacccuuauguauuuucaccggagagaucugcgccucgccgcuaaugccaucuguagcgcugugccuucucauugggucccgacaucccggaccacauggagcauucacgccaagcaugaguggaugaccacggaggacaugcuggcuguguggaacagaguuuggauccaagaaaaucccuggauggaggacaagacaccuguggaaucuugggaggaaguccccuaccuuggcaaacgggaggaucaguggugcgggucccugauuggacucaccagcagagccaccugggcgaagaacauccagacagccauuaaucaggugcgcucccugaucggcaacgaggaauauaccgacuacaugccuucuaugaaacgguucagaaaggaggaagaggaagcugggguccugugguga

SEQ ID NO: 19947 - RNA, 9876 nt, Artificial Sequence
  derived and/or modified CDS sequence (opt5) from DENV-2__EU596488__SS-prME
accgccggcgugaucauuaugcugauccccaccgucauggcuuuccaccucacgacccggaauggggagccucauaugauuguuggacggcaggaaaagggcaagagccugcuuuuuaagaccgaggacggggugaauaugugcacccugauggccaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcgucgcgcucgugccucauguuggaaugggccuggagaccagaacggaaacauggauguccucugagggcgcuuggaagcacgugcagcggaucgagaccuggauucugcgccaucccggguucacaaucauggccgccauucucgcuuacaccaucggaaccacacacuuucagagagcccugauuuucauccuucugacggcugucgccccuagcaugaccaugcggugcauuggcaucuccaaccgcgauuuuguggaagggguuucuggaggcagcuggguggacaucguccucgagcacggguccugugugacaaccauggcgaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgucacaugcgcuauguuuacgugcaaaaagaauauggaagggaaaguugugcucccugagaaccuggaauacaccauugugaucacaccccacagcggggaggagcaugccgucggaaaugacaccggcaagcacggcaaagaaaucaagauuacaccucagucuuccaucaccgaggcggaacuuacgggguauggaaccgugacaauggaguguagcccccggaccggccuggauuucaacgaaaugguucuccugcagauggaggacaaagccuggcuugugcaccgccaaugguuucuggaucucccgcugccuuggcugcccggggcugacacacagggaucuaauuggauucagaaggagacccucgucacguucaagaacccucaugccaaaaagcaggacgugguugugcugggcucccaagaaggggcuaugcacacagcccuuaccggcgccacagagauccagaugagcuccggaaaucugcucuuuaccggccaucugaaaugcagacuucggauggauaagcugcagcucaaagggaugucuuacagcauguguaccggaaaguucaagauugucaaagaaaucgcugagacacaacacggcacgaucgugauuagaguccaguaugagggggacggaucccccugcaagauccccuucgaaauuauggaucuggagaaacgccaugugcugggccggcucaucaccguuaacccuauugugacagaaaaggacagcccggucaacaucgaggcggaacccccuuuuggggauucuuacauuaucaucggcguggagcccggacagcugaaacuuaauugguucaagaagggcuccagcauugggcagauguuugagaccacaaugagaggagccaaacgcauggcuauccugggcgacaccgccugggauuucgggucucucggaggcguuuuuacgagcauugggaaggcccugcaccaaguguucggcgcuaucuacggagccgcguuuuccggcgucucuuggacaaugaaaauucugaucggggugaucauuaccuggaucggaaugaacagccgguccaccagccuuucugugucccucguucuggucggcguggugacacuguaucucggggucauggugcaggcugacaccggauguguugugagcuggaagaauaaagaacugaagugcggcucugggauuuucaucacagauaacguccacacguggaccgagcaguacaaguuucagccugaaucccccagcaaacuugccuccgccauucaaaaggcucaugaggaaggcaucuguggaaucagaucugugacacgccuggagaaucucauguggaaacagauuaccccggagcugaaccacauccugagcgaaaaugagguuaaacuuacaauuaugaccggcgacaucaaagggauuaugcaggccggaaagcggucccucagaccucagcccacggaacugaaauauucuuggaagaccuggggcaaggcuaaaaugcugagcacagagucccauaaccaaaccuuccucaucgaugggccugaaacagccgagugccccaauaccaaccgcgcguggaauagccuggagguggaagacuacggauuuggcgucuucucuacaaacaucuggcuuaagcugcgggagaaacaggacguguuuugugauuccaagcucaugagcgccgcuauuaaagacaauagagccguucacgcugauaugggcuauuggaucgaaucugcccugaacgacaccuggaagauggagaaggcguccuucauugagaucaaaagcugccacuggccuaagucucauacgcuguggagcaauggggugcuugaauccgagaugauuauccccaaaaacuucgccggaccggucagccagcacaacuaccgcccuggcuaucauacacagaccgcugggcccuggcaccucggaaagcuggaaauggauuuugacuucugugagggcaccacagugguggucaccgaagauugcgggaaucggggacccucucugagaacgacaaccgccuccggcaaacucauuacagaguggugcugucggagcugcacccugccuccgcuucgcuacagaggcgaggacggguguugguacggaauggaaauccggccccugaaggagaaggaagagaaccucguuaauucccuggugacagcuggccaugggcaaaucgauaacuuuucucugggagugcuuggcauggcccucuuccuggaagagaugcugagaacccgcgucgggacgaaacacgccauucuccugguggcuguuagcuuugugacccuuaucacaggaaauauguccuuccgggaccugggcagagucauggugaugguuggcgcgaccaugacagaugacauugggaugggagugaccuaucucgcccugcuggcugccuuuaagguccgcccuacguucgccgcuggccuucugcucagaaaacugacaucuaaggagcucaugauggccaccaucgggauugcgcugcuuagccaguccacaauccccgaaaccauccuggagcucaccgaugcucuggcccugggaaugauggugcuuaaaauuguucggaacauggaaaaguaccagcuggccgugacaaucauggcuauuucuugcgucccuaaugccgugauccuccaaaacgcguggaaggugagcuguacgauucuggcugccgucuccguuagcccccuccugcuuaccucuucccagcagaaagccgacuggaucccucuggcucucacaaucaagggccugaaucccaccgccauuuuucugacaacccuuagccgcacgucuaaaaagagauccuggccgcugaacgaggcugugauggccguggggauggucagcauccucgcgucuucccugcucaaaaaugacauuccuaugacaggaccccugguggccggcggccuucugaccguuugcuaugugcugaccgggcggagcgcugaucucgaacuggagcgcgccgcugacgucaagugggaggaucaggccgaaaucuccggaagcucuccuauucuuagcaucacaauuuccgaggacggcucuaugagcaucaaaaacgaagaggaggaacacacccugacaauccucauuagaacggggcugcucgugaucuccggaguuuuccccgugucuauuccgaucaccgccgcugcgugguaccugugggaggucaagaagcaacgggccggcgugcuuugggaugucccuucucccccucccguggggaaagcugaacuggaggacggagccuaucgcauuaagcagagaggcaucuuuggcuacucccagaucggggccggaguuuauaaagaaggcacauuccauaccauguggcacgugacaagaggggcuguccugaugcaucgcggaaagagaauugagcccuccugggccgaugugaaaaaggaccucaucagcuacggcgggggauggaagcuggagggcgaauggaaagagggcgaagagguucaggugcuugcgcuggaaccugggaagaauccgcgggcuguccaaaccaaacccggacucuuuaagacgaacaccggcacaauuggggccgugucccuggauuucagcccuggaaccucuggcucccccaucguggacagaaaagggaagguugucggacucuacggcaauggcguggugacacgcagcggggccuaugucucugcuauugcccagaccgagaaguccaucgaggauaacccugaaaucgaggacgauauuuuccggaaaaagagacugacaaucauggaccuucaccccggagcgggcaaaacgaagcgcuaccugccugcuauugugcgggaagccaucaaaagagggcugcgcacccucauucuggccccgacacggguuguggcugccgagauggaagaggcucuuagaggacugcccauccgcuaucagaccccugccauucgggcggagcauaccggcagagaaaucgucgaccucaugugucacgccacauuuacgaugcggcugcucagccccgugcgcguuccuaacuacaaucugaucauuauggaugaggcucacuucaccgaccccgccuccaucgcugccagaggguauauuucuacacggguggaaaugggcgaggccgcuggaaucuuuaugaccgcgacaccgccuggcagccgcgaucccuucccccaguccaacgccccuauuauggacgaggaaagagagauccccgaacggagcuggaacucugggcaugagugggucaccgauuuuaagggaaagacggugugguucguuccuuccaucaaagcuggcaacgacauugccgccugccuuagaaagaaugggaaaaaggugauccaacugagccgcaaaacauuugauucugaauacgucaagacccgggcuaacgacugggauuucguggugaccacagacauuagcgagaugggagccaauuuuagagcggagcgcgucaucgauccgcggagauguaugaagcccguuauucugaccgacggcgaggaacgcgugauccucgcugggccuaugcccgugacacacuccucugccgcccagcggagaggccgcaucggaagaaacccuaaaaaugaaaacgaccaguauauuuacaugggcgagccccuggaaaaugaugaggacugcgcucauuggaaggaggccaaaaugcuucuggauaacaucaauaccccggaagggauuaucccuagcauguucgagcccgaacgggagaaggucgacgcgauugauggagaauaccgccucagaggcgaggcccggaaaacguuuguggaccugaugcgcagaggggaucugccuguuuggcucgcuuaucggguggccgcugagggaaucaacuacgccgacagacgcugguguuucgauggcauuaagaauaaccaaauccuugaagagaacgucgaaguggagaucuggacaaaagagggggaacggaagaagcugaaacccagauggcuggacgcucgcauuuauuccgauccucucgcccugaaggaguucaaagaauuugcggccggccggaagucucuuacccugaaucucaucacagagaugggaagacugcccaccuucaugacgcagaaagcucgggacgcccuggauaaccucgcuguucuucacaccgccgaagugggcgggcgcgccuacaaucacgcucugagcgagcugccggagacacucgaaacccugcuucugcucacacugcuggcgaccgucacaggaggcauuuuucucuuccuuauguccgggaagggaaucggcaagaugacccugggcaugugcugcauuaucacggccagcauccugcucugguaugcucagauucagccucauuggaucgccgccucuauuauccuggaguuuuuccuuauugugcugcucauccccgaacccgagaaacaaagaacaccucaggacaaccagcugaccuacgucgugaucgcuauucugaccguuguggccgcgacaauggccaaugaaaugggguuucucgagaagaccaaaaaggaccuuggacugggcuccaucacaacgcaggagagcgaauccaacauucuggauaucgaccuccggccggcuucugccuggacccuguaugcuguggccacaaccuucgucacacccaugcuucgccacagcauugaaaauagcucuguuaacgugagccugaccgcgaucgccaaucaagcuacggugcucauggggcugggaagaggcuggccucuguccaaaauggauauuggggucccccuccuugccaucggauguuacagccaggugaacccuaucacccugacagcugcccugcuccugcuuguugcucauuacgccauuaucggccccggccugcaggcgaaggccacccgggaagcucagaagcgcacagccgcugggauuaugaaaaauccuaccguggacggaaucacggucauugaucucgagccgauccccuaugacccuaaguuugaaaaacaacugggccaggugaugcugcucguccuuugcgugacacagguucugaugaugagaaccacaugggcccugugugaggcccucacccuggcgaccgggcccaucucuacacuuugggagggaaacccuggccgguucuggaauacgaccauugcuguguccauggccaacaucuuucgcgggagcuaccuggcuggagccggccuccuguucucuauuaugaagaauacaaucaacaccagacggggcacagggaauauuggagaaacccugggcgagaaauggaaguccagacucaacgcccuuggaaagagcgaauuucagaucuauaaaaagucuggaauccaagaggucgaucgcacgcuggcuaaagagggcauuaagagaggggaaacagaccaccaugccgugagcagaggauccgcgaaacugcgcugguucguugagcggaacauggugacccccgaaggcaaggucguggaucucggcugcgggagaggaggcuggucuuacuauugugggggacugaaaaaugugcgcgagguuaagggccuuaccaaagggggaccgggccacgaggagccuauccccaugagcacauacggcuggaaccugguccggcuccaguccgggguggacguguucuuuacacccccugagaaaugcgauacacugcugugugacauuggagaaagcucccccaauccuacgaucgaggccggcagaacccuccgcguccuuaaccugguugaaaauuggcugaacaauaacacacaguucugcgugaaggugcucaauccguauaugcccucugucauugagaaaauggaaacccugcaacggaaguacgggggagcucuugugagaaacccucugagccgcaauuccacacacgagauguacuggguuucuaacgccaccggcaauaucgugagcuccgucaacaugaucucucggaugcucauuaauagauuuacgaugaaacauaagaaggcuaccuaugagcccgauguggaccuggggagcggaacacgcaacaucggcauugaaaacgagaucccuaaucuggacauuaucggcaaaagaauugaaaagaucaaacaggagcacgaaaccuccuggcauuacgaucaggaccaccccuauaagacaugggccuaccacgggagcuaugagaccaaacagacaggaucugcguccagcaugguuaacggcguggucaagcuccuuaccaagccgugggauguggugccuauggucacgcaaauggccaugacagacaccacccccuucgggcagcagcggguuuuuaaagagaagguggauacacgcacgcaggaaccuaaagagggaaccaagaaacugaugagaaucacagcugaauggcuguggaaggagcucggcaagaaaaagacaccccggauguguacaagagaggaguucacccggaaagugcgcucuaaugccgcucugggggccauuuuuacagacgagaacaaguggaaauccgcuagagaagccgucgaggauagccgguucugggaacuuguggaccgcgagagaaaucugcaucucgagggaaagugcgaaaccuguguuuacaacaugaugggcaaacgggagaagaagcugggcgaauuugggaaagcgaagggaucucgcgccaucugguauauguggcugggcgcuagauuccucgaguuugaagcccugggguuccuuaaugaggaucacugguuuucccggggaaacagccuguccggcguggagggggaaggccuccauaaacugggauacauucuucgcgacgucagcaagaaagagggcggggcuauguacgccgaugacacggccggaugggacaccagaaucacacuggaagaucucaagaaugaggaaauggugaccaaccacaugaagggcgagcauaaaaagcuggcggaggcuauuuucaaacugacauaucaaaauaagguugugcggguccagcgcccuacccccagagggacggugauggacaucaucucucggaaagaucagcgcggaagcggccagguugggacauacggccucaacaccuucacaaauauggaagcccaacugauuagacagauggagggagaaggcaucuuuaaguccauucagcggcuuaccgugacggaggagaucgccguccaaaacuggcuggcuagaguggggcgcgaacggcucucuagaauggccauuagcggagacgauugcgucgugaagccgcuggacgaucgcuucgcuuccgcccuuaccgcgcugaaugacaugggcaaaguucggaaggauauccagcagugggagccuucuagaggguggaacgacuggacacaggugcccuuuugcagccaccacuuccaugaacucgucaugaaagauggacgcgugcuggugguucccugucggaaccaagacgagcugaucggcagagcccgcauuucccagggggcuggcuggucucucaaggaaaccgccugccugggaaaaagcuaugcucagauguggacacuuauguacuuucaccggagagaucugcgccucgccgcgaaugccaucuguuccgcugugccuagccauugggucccgaccucucggacaaccugguccauucacgccaagcacgaguggaugacgacagaggacaugcuggcuguguggaacagaguuuggauccaggaaaaucccuggauggaggacaagaccccuguggaaagcugggaggaaguccccuaucuuggcaaacgggaggaucaauggugcgggucucugauuggacucaccuccagagccacaugggcuaagaacauccagaccgccauuaaucaggugcgcagccugaucggcaacgaggaauacacagacuauaugccuuccaugaaacgguucagaaaggaggaagaggaagcggggguccugugguga

SEQ ID NO: 19948 - RNA, 9876 nt, Artificial Sequence
  derived and/or modified CDS sequence (opt5) from DENV-2__EU596489__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaccauggccgcuauccucgccuacaccauuggaacaacgcacuuucagagagcucugaucuucauucuucugaccgccguggcgccuagcaugacaaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacggaggcuaagcagccugccacacugagaaaauauugcauugaagcuaagcucaccaacaccacaaccgagagccgguguccgacacaaggagagcccucucugaaugaagagcaggacaaacgcuuuaucugcaagcauuccaugguggauagaggcuggggcaacggguguggacuguucggcaaggggggaauugugacgugcgccauguuuaccugcaaaaagaauauggaaggcaaagucguucucccugagaaccuggaauacacaaucgugauuaccccccacagcggggaggagcaugcggugggaaaugacacaggcaagcacggcaaagaaaucaagaucaccccucagucuuccauuacggaggccgaacuuaccggguauggaacagucaccauggaguguagcccccggacaggccuggauuucaacgaaauggugcuccugcagauggaggacaaagcuuggcuuguucaccgccaaugguuucuggaucucccgcugccuuggcugcccggggccgacacccagggaucuaauuggauccagaaggagacgcucgugacauucaagaacccucaugcuaaaaagcaggacgucgugguucugggcucccaagaaggggccaugcacaccgcccuuacaggcgcuaccgagauucagaugagcuccggaaaucugcucuuuaccggccaucugaaaugcagacuucggauggauaagcugcagcucaaagggaugucuuacagcauguguacaggaaaguucaagaucgugaaagaaauugcggagacgcaacacggcaccaucgucaucagagugcaguaugagggggacggaucccccugcaagauucccuucgaaaucauggaucuggagaaacgccauguccugggccggcucauuacagugaacccuaucguuaccgaaaaggacagcccggugaacauugaggccgaacccccuuuuggggauucuuacaucauuaucggcgucgagcccggacagcugaaacuuaauugguucaagaagggcuccagcaucgggcagauguuugagacaaccaugagaggagcuaaacgcauggccauucugggcgacacggccugggauuucgggucucucggaggcguguuuacaagcaucgggaaggcucugcaccaaguuuucggcgccauuuacggagcggcuuuuuccggcgugucuuggaccaugaaaauccugauuggggucaucaucaccuggauuggaaugaacagccgguccacaagccuuucugugucccucgugcugguuggcaucgucacccuguaucucggggugauggugcaggccgacacaggaugugucgugagcuggaagaauaaagaacugaagugcggcucugggauuuucaucacggauaacguucacaccuggacagagcaguacaaguuucagccugaauuccccuccaaacuugccagcgcuauuaagaaagcccaugaggaaggcaucuguggaaucagauccgugacccgccuggagaaucucauguggaagcaaauuacaccggagcugaaccacauccugucugaaaaugaggucaaacuuaccauuaugacgggcgacaucaaggggauuaugcaggcuggaaaacggagccucagaccucagcccaccgaacugaaguauuccuggaagacauggggcaaagccaagaugcugucuaccgagagccauaaccagacauuucucaucgaugggccugaaaccgcggagugccccaauacaaaccgcgccuggaauucccuggagguggaagacuacggauucggcguuuuuagcaccaacaucuggcuuaaacugcgggagaagcaagacguguucugugauucuaaacucauguccgcugccauuaaggacaauagagcuguccacgccgauaugggcuauuggaucgaaagcgcgcugaacgacacguggaagauggagaaagccucuuucauugagaucaaguccugccacuggccuaaaagccauacacuguggucuaauggggugcuugaaagcgagaugauuauccccaagaacuuugcuggaccgguuucccagcacaacuaccgcccuggcuaucauacccagaccgccgggcccuggcaccucggaaaacuggaaauggauuucgacuuuugugagggcacaaccguggucgugacggaagauugcgggaaucggggacccagccugagaacaaccacagcuucuggcaagcucauuaccgaguggugcugucgguccugcacacugccuccgcuucgcuacagaggcgaggacggguguugguacggaauggaaauccggccccugaaggagaaagaagagaaccucgugaauagccuggucaccgccggccaugggcagaucgauaacuucucccugggaguucuuggcauggcccucuuucuggaagagaugcugagaacgcgcguggggaccaagcacgcuauucuccugguggcggucucuuucgugacacuuaucaccggaaauaugagcuuucgggaccugggcagaguuauggugauggucggcgccacaaugaccgaugacauugggaugggagugacguaucucgcucugcuggccgccuucaaaguucgcccuacauuugcugccggccuucugcucagaaagcugaccuccaaagagcucaugauggcgacaaucgggauugcucugcuuucucaaagcaccauccccgaaaccauccuggagcucacagaugcccuggcccugggaaugauggugcuuaagauuguccggaacauggaaaaguaccagcuggcugugacgaucauggccauuuccugcguuccuaaugcggugauccuccagaacgcuuggaaagucucuuguaccauucuggccgccgugagcguguccccccuccugcuuacaagcucucaacagaaggcugacuggaucccucuggcccucaccaucaaaggccugaaucccacagcuauuuuccugaccacgcuuucccgcacaagcaagaaaagaucuuggccgcugaacgaggccgucauggcgguugggaugguguccauccucgccagcucucugcucaagaaugacauuccuaugaccggaccccugguggcuggcggccuucugaccgucugcuaugugcugacagggcgguccgccgaucucgaacuggagaaagcugccgacguuaagugggaggaucaggccgaaaucagcggauccagcccuauucuuucuaucaccauuagcgaggacggcuccaugucuaucaagaacgaagaggaggaacacacacugacgauccucauucgcaccgggcugcucgugaucagcggagucuuucccguguccauuccgaucacagcugcggccugguaccugugggagguuaaaaagcagagagcuggcgugcuuugggaugucccuucucccccucccguggggaaagccgaacuggaggacggagccuaucggauuaagcaacgcggcaucuucggcuacagccagaucggggcuggagucuauaaagaaggcaccuuucauacaauguggcacgugaccagaggggccguucugaugcaucggggaaagcgcauugagcccuccugggcggaugugaagaaagaccucaucucuuacggcgggggauggaagcuggagggcgaauggaaagagggcgaagagguccaggugcuugcucuggaaccugggaagaauccgagagccguucagacgaaacccggacucuucaagaccaacacaggcaccauuggggccgugagccuggauuucuccccuggaacaagcggcucucccaucgucgaccggaaggggaaaguggugggacucuacggcaauggcguugucaccagauccggggcuuaugugagcgccauugcgcaaacagagaagucuaucgaggauaacccugaaaucgaggacgauauuuuucgcaaaaagcggcugacgaucauggaccuucaccccggagcuggcaaaaccaagagauaccugccugccauugugcgcgaagccaucaagcgggggcugagaacacucauucuggcuccgacccgcgucguggccgcugagauggaagaggcccuucggggacugcccaucagauaucagaccccugcgauucgcgccgagcauacaggccgggaaaucguugaccucaugugucacgcuacguucaccaugagacugcucucccccgugcgggucccuaacuacaaucugaucauuauggaugaggcccacuuuacagaccccgcuagcaucgccgcccgcggguauauuuccaccagaguggaaaugggcgaggcugcgggaaucuucaugacagccaccccgccuggcucucgggaucccuuuccccagagcaacgcuccuauuauggacgaggaacgcgagauccccgaaagauccuggaauagcgggcaugaguggguuacggauuucaaaggaaagacagugugguuugucccuucuaucaaagccggcaacgacauugccgcuugccuucggaagaaugggaaaaaggugauccagcuguccagaaagaccuucgauagcgaauacguuaaaacccgcgccaacgacugggauuuuguggucacaaccgacauuucugagaugggagcgaauuuccgggcugagagagugaucgauccgcgccgguguaugaagcccgugauucugacagacggcgaagagagagucauccucgccgggccuaugcccguuacccacagcuccgccgcucaacgccggggcagaaucggacgcaacccuaaaaaugaaaacgaccaguauauuuacaugggcgagccccuggaaaaugaugaggacugcgcccauuggaaggaggcgaaaaugcuucuggauaacaucaauacgccggaagggauuaucccuucuauguuugagcccgaaagagagaagguggacgccauugauggagaauaccggcuccgcggcgaggcuagaaaaacauucguggaccugaugcggcgcggggaucugccugucuggcucgccuauagaguggcugccgagggaaucaacuacgcugaccggagaugguguuucgauggcauuaagaauaaccagauccuugaagagaacguugaaguggagaucuggaccaaggagggggaacgcaaaaagcugaaaccccgguggcuggacgccagaauuuauagcgauccucucgcgcugaaggaguuuaaagaauucgccgcuggccgcaagucccuuacacugaaucucaucaccgagaugggacggcugcccacguuuaugacccaaaaggccagagacgcucuggauaaccucgccguccuucacacagccgaagugggcgggcgggcuuacaaucacgcgcugucugagcugccggagacccucgaaacacugcuucugcucacccugcuggccacaguuaccggaggcauuuuccucuuucuuaugagcgggaaaggaaucggcaagaugacgcugggcaugugcugcauuaucacagcuuccauccugcucugguaugcccagauucagccucauuggaucgccgcuagcauuauccuggaguucuuucuuauugugcugcucauccccgaacccgagaaacagcgcaccccucaagacaaccagcugaccuacgucgugaucgccauucugacagucguggcggccaccauggcuaaugaaaugggguuccucgagaagacaaaaaaggaccuuggacugggcucuaucacgacccaggaguccgaaagcaacauucuggauaucgaccucagaccggccuccgcuuggacacuguaugccguugcgaccacauuugugacccccaugcuucggcacucuauugagaauagcuccgugaacgucucucugacggccaucgcuaaucaggccaccguucucauggggcugggacgcggcuggccucugagcaagauggauauuggggugccccuccuugcuaucggauguuacucccaagugaacccuaucacacugaccgccgcucugcuccugcuugucgcccauuacgcgauuaucggccccggccugcaggccaaagcuacaagagaagcccagaagcggaccgcugccgggauuaugaaaaauccuacgguggacggaaucacaguuauugaucucgagccgauccccuaugacccuaaguucgaaaaacagcugggccaagugaugcugcucguccuuugcgugacccagguccugaugaugcgcacaaccugggcccugugugaggcgcucacccuggcuacagggcccaucagcacgcuuugggagggaaacccuggcagauuuuggaauaccacaauugccgugucuauggcuaacaucuuccggggguccuaccuggccggagccggccuccuguuuagcauuaugaagaauaccacaaacacccgcagaggcacggggaauaucggagaaacacugggcgagaaguggaaaucucggcucaacgcucuugggaaguccgaauuccagauuuauaaaaagagcggaauccaggagguugauagaacccuggccaaagagggcaucaagcgcggggaaaccgaccaccaugcggugucucggggaagcgccaaacugagaugguucgucgagcgcaacauggugacacccgaaggcaagguuguggaucucggcugcgggcggggaggcugguccuacuauugugggggacugaagaaugucagagaggugaaaggccuuaccaaggggggaccgggccacgaagagccuauucccaugucuacauacggcuggaaccuggugcgccuccaaagcgggguugacgucuuuuucacgcccccugagaaaugcgauacccugcugugugacaucggagaauccagccccaauccuacaauugaggcuggccggacccucagagugcuuaaccugguggaaaauuggcugaacaauaacacacaguuuugcgucaagguucucaauccguauaugcccuccgugaucgagaaaauggaaacccugcagcgcaaguacgggggagcccuugugcggaacccucugucuagaaauagcacgcacgagauguacugggucuccaacgcuaccggcaauauugugucuagcguuaacaugaucucccgcaugcucaucaaucgguucacaaugaagcauaaaaaggccaccuaugagcccgauguggaccuggggucuggaacaagaaacauuggcaucgaaaacgagauuccuaaucuggacaucauuggcaaacgcaucgaaaagauuaaacaagagcacgaaaccagcuggcauuacgaucaggaccaccccuauaagacaugggcguaccacggguccuaugagaccaagcagacgggaagcgccucuuccauggucaacggcgugguuaaacuccuuacaaagccgugggauguggucccuauggugacccagauggcuaugaccgacacaacgcccuuugggcaacagagaguguucaaagagaaggucgauacccggacacaggaaccuaaagagggaaccaagaagcugaugcgcaucacagccgaauggcuguggaaagagcucggcaagaaaaagacccccagaauguguacacgggaggaauuuaccagaaaaguucggagcaaugcugcccugggggcuaucuucacggacgagaacaaguggaaaucugcccgcgaagcgguggaggauuccagauuuugggaacuuguggaccgggagcgcaaucugcaucucgagggaaagugcgaaaccugugucuacaacaugaugggcaagagagagaaaaagcugggcgaauucgggaaagccaagggaagccgggcuauuugguauauguggcugggcgcccgcuuucucgaguucgaagcucugggguuucuuaaugaggaucacugguucucuagaggaaacucccugagcggcguggagggggaaggccuccauaaacugggauacauccuucgggacguuuccaagaaggagggcggggccauguacgccgaugacacagcgggaugggacacccgcauuacacuggaagaucucaaaaaugaggaaauggugaccaaccacaugaagggcgagcauaaaaagcuggcugaggccaucuucaaacugacguaucagaauaaggucgugagaguucaacggccuacaccccgcgggaccgugauggacauuaucagcagaaaggaucagcggggaucuggccaggucgggacauacggccucaacaccuuuacgaauauggaagcccagcugauccgccaaauggagggagaaggcauuuucaaaagcauccagagacuuaccgugacagaggagauugcuguucagaacuggcuggcccggguggggagagaacgccucucccggauggcuaucucuggagacgauugcgucgugaagccgcuggacgauagauuugccagcgcgcuuaccgcccugaaugacaugggcaaaguccgcaaggauauucaacagugggagccuucccggggguggaacgacuggacacaggugcccuucugcucucaccacuuucaugaacucguuaugaaagauggaagaaugcuggugguccccugucgcaaccaggacgagcugaucggccgggcuagaaucagccaaggggccggcuggucccucaaggaaaccgcuugccugggaaagucuuaugcccagauguggacacuuauguacuuccaccgccgggaucugagacucgcggccaaugcuauuuguagcgccgugccuucccauugggugccgaccagccgcacgacauggucuauccacgcuaaacacgaguggaugaccaccgaggacaugcuggccguuuggaaccggguguggauucaggaaaaucccuggauggaggacaagacaccugucgaauccugggaggaagugcccuaucuuggcaaaagagaggaucaguggugcgggagccugaucggacucaccucucgggcuacaugggccaagaacauucaaacggcgaucaaucagguuagaucccugauuggcaacgaggaauacaccgacuauaugccuagcaugaaacgcuuucggaaggaggaagaggaagccggggugcugugguga

SEQ ID NO: 19949 - RNA, 9876 nt, Artificial Sequence
  derived and/or modified CDS sequence (opt5) from DENV-2__EU596490__SS-prME
accgccggagugaucauuaugcugauccccacagucauggcuuuccaccucacgacccggaauggggagccucauaugauuguuggacggcaggaaaagggcaagagccugcuuuuuaagacagaggacggggugaauaugugcacccugauggccaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcgucgcgcucgugccucauguuggaaugggccuggagaccagaacggaaacauggauguccucugagggcgcuuggaagcacgugcagcggaucgagaccuggauucugcgccaucccggguucacaaucauggccgccauucucgcuuacaccaucggaaccacacacuuucagagagcccugauuuucauccuucugacggcugucgccccuagcaugaccaugcggugcauuggcaucuccaaccgcgauuuuguggaagggguuucuggaggcagcuggguggacaucguccucgagcacggguccugugugacaaccauggcgaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgucacaugcgcuauguuuacgugcaaaaagaauauggaagggaaaguugugcucccugagaaccuggaauacaccauugugaucacaccccacagcggggaggagcaugccgucggaaaugacaccggcaagcacggcaaagaaaucaagauuacaccucagucuuccaucaccgaggcggaacuuacgggguauggaaccgugacaauggaguguagcccccggaccggccuggauuucaacgaaaugguucuccugcagauggaggacaaagccuggcuugugcaccgccaaugguuucuggaucucccgcugccuuggcugcccggggcugacacacagggaucuaauuggauucagaaggagacccucgucacguucaagaacccucaugccaaaaagcaggacgugguugugcugggcucccaagaaggggcuaugcacacagcccuuaccggcgccacagagauccagaugagcuccggaaaucugcucuuuaccggccaucugaaaugcagacuucggauggauaagcugcagcucaaagggaugucuuacagcauguguaccggaaaguucaagauugucaaagaaaucgcugagacacaacacggcacgaucgugauuagaguccaguaugagggggacggaucccccugcaagauccccuucgaaauuauggaucuggagaaacgccaugugcugggccggcucaucaccguuaacccuauugugacagaaaaggacagcccggucaacaucgaggcggaacccccuuuuggggauucuuacauuaucaucggcguggagcccggacagcugaaacuuaauugguucaagaagggcuccagcauugggcagauguuugagaccacaaugagaggagccaaacgcauggcuauccugggcgacaccgccugggauuucgggucucucggaggcguuuuuacgagcauugggaaggcccugcaccaaguguucggcgcuaucuacggagccgcguuuuccggcgucucuuggacaaugaaaauucugaucggggugaucauuaccuggaucggaaugaacagccgguccaccagccuuucugugucccucguucuggucggcguggugacacuguaucucggggucauggugcaggcugacaccggauguguugugagcuggaagaauaaagaacugaagugcggcucugggauuuucaucacagauaacguccacacguggaccgagcaguacaaguuucagccugaaucccccagcaaacuugccuccgccauucaaaaggcucaugaggaaggcaucuguggaaucagaucugugacacgccuggagaaucucauguggaaacagauuaccccggagcugaaccacauccugagcgaaaaugagguuaaacuuacaauuaugaccggcgacaucaaagggauuaugcaggccggaaagcggucccucagaccucagcccacggaacugaaauauucuuggaagaccuggggcaaggcuaaaaugcugagcacagagucccauaaccaaaccuuccucaucgaugggccugaaacagccgagugccccaauaccaaccgcgcguggaauagccuggagguggaagacuacggauuuggcgucuucucuacaaacaucuggcuuaagcugcgggagaaacaggacguguuuugugauuccaagcucaugagcgccgcuauuaaagacaauagagccguucacgcugauaugggcuauuggaucgaaucugcccugaacgacaccuggaagauggagaaggcguccuucauugagaucaaaagcugccacuggccuaagucucauacgcuguggagcaauggggugcuugaauccgagaugauuauccccaaaaacuucgccggaccggucagccagcacaacuaccgcccuggcuaucauacacagaccgcugggcccuggcaccucggaaagcuggaaauggauuuugacuucugugagggcaccacagugguggucaccgaagauugcgggaaucggggacccucucugagaacgacaaccgccuccggcaaacucauuacagaguggugcugucggagcugcacccugccuccgcuucgcuacagaggcgaggacggguguugguacggaauggaaauccggccccugaaggagaaggaagagaaccucguuaauucccuggugacagcuggccaugggcaaaucgauaacuuuucucugggagugcuuggcauggcccucuuccuggaagagaugcugagaacccgcgucgggacgaaacacgccauucuccugguggcuguuagcuuugugacccuuaucacaggaaauauguccuuccgggaccugggcagagucauggugaugguuggcgcgaccaugacagaugacauugggaugggagugaccuaucucgcccugcuggcugccuuuaagguccgcccuacguucgccgcuggccuucugcucagaaaacugacaucuaaggagcucaugauggccaccaucgggauugcgcugcuuagccaguccacaauccccgaaaccauccuggagcucaccgaugcucuggcccugggaaugauggugcuuaaaauuguucggaacauggaaaaguaccagcuggccgugacaaucauggcuauuucuugcgucccuaaugccgugauccuccaaaacgcguggaaggugagcuguacgauucuggcugccgucuccguuagcccccuccugcuuaccucuucccagcagaaagccgacuggaucccucuggcucucacaaucaagggccugaaucccaccgccauuuuucugacaacccuuagccgcacgucuaaaaagagauccuggccgcugaacgaggcugugauggccguggggauggucagcauccucgcgucuucccugcucaaaaaugacauuccuaugacaggaccccugguggccggcggccuucugaccguuugcuaugugcugaccgggcggagcgcugaucucgaacuggagcgcgccgcugacgucaagugggaggaucaggccgaaaucuccggaagcucuccuauucuuagcaucacaauuuccgaggacggcucuaugagcaucaaaaacgaagaggaggaacacacccugacaauccucauuagaacggggcugcucgugaucuccggaguuuuccccgugucuauuccgaucaccgccgcugcgugguaccugugggaggucaagaagcaacgggccggcgugcuuugggaugucccuucucccccucccguggggaaagcugaacuggaggacggagccuaucgcauuaagcagagaggcaucuuuggcuacucccagaucggggccggaguuuauaaagaaggcacauuccauaccauguggcacgugacaagaggggcuguccugaugcaucgcggaaagagaauugagcccuccugggccgaugugaaaaaggaccucaucagcuacggcgggggauggaagcuggagggcgaauggaaagagggcgaagagguucaggugcuugcgcuggaaccugggaagaauccgcgggcuguccaaaccaaacccggacucuuuaagacgaacaccggcacaauuggggccgugucccuggauuucagcccuggaaccucuggcucccccaucguggacagaaaagggaagguugucggacucuacggcaauggcguggugacacgcagcggggccuaugucucugcuauugcccagaccgagaaguccaucgaggauaacccugaaaucgaggacgauauuuuccggaaaaagagacugacaaucauggaccuucaccccggagcgggcaaaacgaagcgcuaccugccugcuauugugcgggaagccaucaaaagagggcugcgcacccucauucuggccccgacacggguuguggcugccgagauggaagaggcucuuagaggacugcccauccgcuaucagaccccugccauucgggcggagcauaccggcagagaaaucgucgaccucaugugucacgccacauuuacgaugcggcugcucagccccgugcgcguuccuaacuacaaucugaucauuauggaugaggcucacuucaccgaccccgccuccaucgcugccagaggguauauuucuacacggguggaaaugggcgaggccgcuggaaucuuuaugaccgcgacaccgccuggcagccgcgaucccuucccccaguccaacgccccuauuauggacgaggaaagagagauccccgaacggagcuggaacucugggcaugagugggucaccgauuuuaagggaaagacggugugguucguuccuuccaucaaagcuggcaacgacauugccgccugccuuagaaagaaugggaaaaaggugauccaacugagccgcaaaacauuugauucugaauacgucaagacccgggcuaacgacugggauuucguggugaccacagacauuagcgagaugggagccaauuuuagagcggagcgcgucaucgauccgcggagauguaugaagcccguuauucugaccgacggcgaggaacgcgugauccucgcugggccuaugcccgugacacacuccucugccgcccagcggagaggccgcaucggaagaaacccuaaaaaugaaaacgaccaguauauuuacaugggcgagccccuggaaaaugaugaggacugcgcucauuggaaggaggccaaaaugcuucuggauaacaucaauaccccggaagggauuaucccuagcauguucgagcccgaacgggagaaggucgacgcgauugauggagaauaccgccucagaggcgaggcccggaaaacguuuguggaccugaugcgcagaggggaucugccuguuuggcucgcuuaucggguggccgcugagggaaucaacuacgccgacagacgcugguguuucgauggcauuaagaauaaccaaauccuugaagagaacgucgaaguggagaucuggacaaaagagggggaacggaagaagcugaaacccagauggcuggacgcucgcauuuauuccgauccucucgcccugaaggaguucaaagaauuugcggccggccggaagucucuuacccugaaucucaucacagagaugggaagacugcccaccuucaugacgcagaaagcucgggacgcccuggauaaccucgcuguucuucacaccgccgaagugggcgggcgcgccuacaaucacgcucugagcgagcugccggagacacucgaaacccugcuucugcucacacugcuggcgaccgucacaggaggcauuuuucucuuccuuauguccgggaagggaaucggcaagaugacccugggcaugugcugcauuaucacggccagcauccugcucugguaugcucagauucagccucauuggaucgccgccucuauuauccuggaguuuuuccuuauugugcugcucauccccgaacccgagaaacaaagaacaccucaggacaaccagcugaccuacgucgugaucgcuauucugaccguuguggccgcgacaauggccaaugaaaugggguuucucgagaagaccaaaaaggaccuuggacugggcuccaucacaacgcaggagagcgaauccaacauucuggauaucgaccuccggccggcuucugccuggacccuguaugcuguggccacaaccuucgucacacccaugcuucgccacagcauugaaaauagcucuguuaacgugagccugaccgcgaucgccaaucaagcuacggugcucauggggcugggaagaggcuggccucuguccaaaauggaugucggggugccccuccuugccauuggauguuacagccagguuaacccuaucacccugacagcugcccugcuccugcuuguggcucauuacgccaucauuggccccggccugcaggcgaaggccacccgggaagcucagaagcgcacagccgcugggaucaugaaaaauccuaccgucgacggaauuacggugaucgaucucgagccgauucccuaugacccuaaguuugaaaaacaacugggccaggucaugcugcucgugcuuugcguuacacaggugcugaugaugagaaccacaugggcccugugugaggcccucacccuggcgaccgggcccaucucuacacuuugggagggaaacccuggccgguucuggaauacgaccaucgcugucuccauggccaacauuuuucgcgggagcuaccuggcuggagccggccuccuguucucuaucaugaagaauacaaccaacacaagacggggcaccgggaauauuggagaaacgcugggcgagaaauggaaguccagacucaacgcccuuggaaagagcgaauuucagaucuauaaaaagucuggcauucaagagguggaucgcacacuggcuaaagagggcaucaagagaggggaaaccgaccaccaugccguuagcagaggauccgcgaaacugcgcugguucguggagcggaacauggucacccccgaaggcaaggugguggaucucggcugcgggagaggaggcuggucuuacuauugugggggacugaaaaauguucgcgaggucaagggccuuacaaaagggggaccgggccacgaggagccuauccccaugagcaccuacggcuggaaccuggugcggcuccaguccgggguggacgucuucuuuacacccccugagaaaugcgauacgcugcugugugacauuggagaaagcucccccaauccuaccaucgaggccggcagaacacuccgcguucuuaaccugguggaaaauuggcugaacaauaacacccaguucugcgugaagguccucaauccguauaugcccucugugauugagaaaauggaaacacugcaacggaaguacgggggagcucuuguuagaaacccucugagccgcaauuccacccacgagauguacugggugucuaacgccacgggcaauaucgucagcuccgugaacaugauuucucggaugcucaucaauagauuuaccaugaaacauaagaaggcuacauaugagcccgauguugaccuggggagcggaacccgcaacaucggcauugaaaacgagaucccuaaucuggacauuaucggcaaaagaauugaaaagaucaaacaggagcacgaaacauccuggcauuacgaucaggaccaccccuauaagaccugggccuaccacgggagcuaugagacaaaacagaccggaucugcguccagcauggugaacggcgucgugaagcuccuuacgaagccgugggauguggucccuaugguuacacaaauggccaugaccgacaccacacccuucgggcagcagcggguguuuaaagagaagguggauacgcgcacccaggaaccuaaagagggaacaaagaaacugaugagaauuaccgcugaauggcuguggaaggagcucggcaagaaaaagacaccccggauguguaccagagaggaguucacacggaaaguccgcucuaaugccgcucugggggccaucuuuaccgacgagaacaaguggaaauccgcuagagaagccguggaggauagccgguucugggaacuuguugaccgcgagagaaaucugcaucucgagggaaagugcgaaacguguguguacaacaugaugggcaaacgggagaagaagcugggcgaauuugggaaagcgaagggaucucgcgccaucugguauauguggcugggcgcuagauuccucgaguuugaagcccugggguuccuuaaugaggaucacugguuuucccggggaaacagccuguccggcgucgagggggaaggccuccauaaacugggauacauucuucgcgacgugagcaagaaagagggcggggcuauguacgccgaugacaccgccggaugggacacaagaaucacccuggaagaucucaagaaugaggaaaugguuacaaaccacaugaagggcgagcauaaaaagcuggcggaggcuauuuucaaacugaccuaucaaaauaaggugguccgggugcagcgcccuacgcccagagggacaguuauggacaucauuucucggaaagaucagcgcggaagcggccagguggggaccuacggccucaacacauucaccaauauggaagcccaacugaucagacagauggagggagaaggcaucuuuaaguccauucagcggcuuacggucaccgaggagaucgccgugcaaaacuggcuggcuagagucgggcgcgaacggcucucuagaauggccauuagcggagacgauugcgugguuaagccgcuggacgaucgcuucgcuuccgcccuuacagcgcugaaugacaugggcaaagugcggaaggauauccagcagugggagccuucuagaggguggaacgacuggacccagguccccuuuugcagccaccacuuccaugaacucgugaugaaagauggacgcgugcugguugugcccugucggaaccaagacgagcugauuggcagagcccgcaucucccagggggcuggcuggucucucaaggaaacagccugccugggaaaaagcuaugcucagauguggacccuuauguacuuucaccggagagaucugcgccucgccgcgaaugccaucuguuccgcugucccuagccauugggugccgacaucucggaccacgugguccauucacgccaagcacgaguggaugacaaccgaggacaugcuggcuguuuggaacagaguguggauccaggaaaaucccuggauggaggacaagaccccugucgaaagcugggaggaagugcccuaucuuggcaaacgggaggaucaauggugcgggucucugauuggacucacauccagagccaccugggcuaagaacauccagacagccauuaaucagguccgcagccugaucggcaacgaggaauacacggacuauaugccuuccaugaaacgguucagaaaggaggaagaggaagcgggggugcugugguga

SEQ ID NO: 19950 - RNA, 9876 nt, Artificial Sequence
  derived and/or modified CDS sequence (opt5) from DENV-2__EU596491__SS-prME
accgccggcgugaucauuaugcugauccccacagucauggcuuuccaccucacgacccggaacggggagccucauaugauuguuggacggcaggaaaagggcaagucccugcuuuuuaagacagaggacggggugaauaugugcacccugauggccaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcgucgcgcucgugccucauguuggaaugggccuggagaccagaacggaaacauggauguccucugagggcgcuuggaagcacgugcagcggaucgagaccuggauucugcgccaucccggguucacaaucauggccgccauucucgcuuacaccaucggaaccacacacuuucagagagcccugauuuucauccuucugacggcugucgccccuagcaugaccaugcggugcauuggcaucuccaaccgcgauuuuguggaagggguuucuggaggcagcuggguggacaucguccucgagcacggguccugugugacaaccauggcgaagaauaagcccacacuggauuucgaacuuauuaagaccgaggccaagcagccugcuacgcugagaaaauauugcaucgaagccaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggcaucgucacaugcgcuauguuuacgugcaaaaagaauauggaaggcaaaauuguucagccugagaaccucgaauacaccaucgugaucacaccccacagcggggaggagcaugccgugggaaaugacaccggcaagcacggcaaagaaauuaagaucacaccucagucuuccaccacggaggcggaacugaccggguauggaacagucaccauggaguguagcccccggacaggccuugauuucaacgaaauggugcugcuccaaauggaggacaaagccuggcugguucaccgccagugguuucuugaucugccgcucccuuggcugcccggggcugacacccagggaucuaauuggauucagaaggagacgcuggugacauucaagaacccucaugccaaaaagcaagacgucgugguucucggcucccaggaaggggcuaugcacaccgcccugacaggcgccaccgagauccagaugagcuccggaaaucuucuguuuaccggccaucucaaaugcagacugcggauggauaaacuucaacugaaagggaugucuuacagcauguguacaggaaaguucaagauugugaaagaaaucgcugagacgcagcacggcaccaucgucauuagagugcaguaugagggggacggaucccccugcaagauccccuucgaaauuacagaucucgagaaacgccauguccugggccggcugaucaccgugaacccuauuguuacagaaaaggacgcgccggugaacaucgaggccgaacccccuuuuggggauagcuacauuaucgucggcguggagcccggacagcucaaacugaauugguucaagaagggaucuuccaucgggcaaauguuugagaccacgaugagaggagcuaaacgcauggccauucuuggcgacacagccugggauuucgggagccugggaggcguuuuuaccucuaucgggaaggcucuccaccagguguucggcgccauuuacggagcggcuuuuagcggcgucuccuggaccaugaaaauccugauuggggugaucaucacauggauuggaaugaacucucggagcaccucccugagcgugucucuuguucucgucggcguggugacacuguaucugggggccgucgugcaggccgacuccggauguguugugagcuggaagaauaaagaacucaagugcggcucugggaucuucauuacggauaacguccacaccuggacagagcaguacaaguuucaaccugaaucccccagcaaacuggcuuccgccauccagaaggcucaugaggaaggcauuuguggaaucagaucugugacccgccuugagaaucugauguggaaacagaucacaccggagcucaaccacauucugagcgaaaaugagguuaagcugaccaucaugacgggcgacauuaaagggaucaugcaggccggaaagcggucccuuagaccucaacccaccgaacucaaauauucuuggaagacauggggcaaggcgaaaaugcugagcaccgagucccauaaccagacauuccugauugaugggccugaaaccgccgagugccccaauacaaaccgcgcuuggaauagccucgagguggaagacuacggauuuggcgucuucaccacgaacaucuggcugaaacuucgggagaaacaggacguguuuugugauucuaagcugauguccgccgcuaucaaagacaauagagccguucacgcggauaugggcuauuggauugaaagcgcccucaacgacacauggaagauggagaaggcuucuuucaucgaggugaaauccugccacuggccuaagagccauacccuguggucuaaugggguccuggaaagcgagaugauuauccccaaaaacuucgccggaccggugucccagcacaacuaccgcccuggcuaucauacccaaacagcugggcccuggcaccuuggaaagcucgaaauggauuuugacuucugugagggcaccacgguggucguuacagaagauugcgggaaucggggacccagccugagaaccacaaccgccucuggcaaacugauuacagaguggugcugucgguccugcacccucccuccgcugcgcuacagaggcgaggacggguguugguacggaauggaaauccggccccuuaaggagaaggaagagaaccuggugaauagccucgugacggccggccaugggcagauugauaacuuuucccugggaguccugggcauggcucuuuuccucgaagagaugcugagaacccgcguggggacaaaacacgcgacccugcucguugcccugucuuuugugacacuuaucaccggaaauaugagcuuccgggaccugggcagagucauggugaugguuggcgcuacgaugacagaugacaucgggaugggagugaccuaucucgcccugcuggccgcuuuuaagguccgcccuacauucgccgcgggccuucugcucagaaaacugaccuccaaggagcucaugauggcuaccauugggaucgcccugcuuucucagagcacacugcccgaaacgauucucgagcugaccgaugcccuggcucuuggaaugauggugcugaaaaucguucggaacauggaaaaguaccaacucgccgugacaauuauggcgaucuccugcgucccuaaugcugugauccugcagaacgccuggaaggugucuuguaccauucucgccgcugucagcguuagcccccugcuucugacaagcucucagcagaaagccgacuggaucccucucgcucugaccauuaagggccugaaucccacggccaucuuucuuacaacccugucccgcaccagcaaaaagagaucuuggccgcucaacgaggcgauuauggccguggggaugguguccauccuggcuagcucucuccugaaaaaugacaucccuaugacaggaccccuugucgccggcggccugcugaccgugugcuauguucucacagggcgguccgcugaucuggaacuugagcgcgccgccgacgugaagugggaggaucaagcugaaauuagcggauccagcccuauccugucuauuacgaucagcgaggacggcuccaugucuauuaaaaacgaagaggaggaacagacccucacaauccugauuagaaccgggcuccuggucaucagcggaguguuccccguuuccaucccgauuacagcggccgcuugguaccuuugggaggugaagaagcagcgggccggcguccugugggaugugccuucucccccucccgucgggaaagccgaacuggaggacggagcuuaucgcaucaagcagagaggcauucucggcuacagccaaaucggggccggaguguauaaagaaggcaccuuucacacgauguggcauguuaccagaggggcggugcugaugcaccgcggaaagagaauugagcccuccugggcugaugucaaaaaggaccuuaucucuuacggcgggggauggaagcuggagggcgaauggaaagagggcgaagaggugcagguucucgcccuggaaccugggaagaauccgcgggccgugcagacaaaacccggaaucuucaagaccaacacaggcaccauuggggcugucagccucgauuuuuccccuggaacaagcggcucucccaucguggacagaaaagggaaggugguuggacuguacggcaauggcgucgugacgcgcuccggggccuaugugagcgcgauugcucagaccgagaagucuaucgaggauaacccugaaauugaggacgauaucuuccggaaaaagagacuuacaaucauggaccugcaucccggagccggcaaaaccaagcgcuaccugccugccauuguccgggaagcuaucaaaagagggcuccgcacccugauucuugccccgacacgggugguugcugccgagauggaagaggcgcugagaggacuccccauccgcuaucaaacgccugccauucgggcugagcacaccggcagagaaaucguggaccugaugugucaugccacauucaccaugcggcuccugucccccguccgcgugccuaacuacaaucuuauuaucauggaugaggcucacuuuacagaccccgccagcaucgccgcuagaggguauauuuccacccggguugaaaugggcgaggcggccggaaucuucaugacggcuacaccgccuggcucucgcgaucccuuuccccagagcaacgccccuauuaucgacgaggaaagagagauucccgaacgguccuggaauagcgggcacgagugggugaccgauuucaagggaaagaccgucugguuugugccuucuaucaaagccggcaacgacaucgcugccugccugagaaagaaugggaaaaagguuauucagcugucccgcaaaacauucgauagcgaauacgugaagacccgggcgaacgacugggauuuugucgugacaaccgacaucucugagaugggagcuaauuucaaggccgagagagugauugauccgcgccgguguaugaaacccgucauccucacggacggcgaagagagaguuauucuggccgggccuaugcccgugacacauagcuccgcugcccaacgccggggcagaaucggacgcaacccuaagaaugaaaacgaccaguauaucuacaugggcgagccccuugaaaaugaugaggacugcgcgcacuggaaagaggccaagaugcugcucgauaacauuaauaccccggaagggaucauuccuucuauguuugagcccgaaagagagaaaguggacgcugucgauggagaauaccggcugcgcggcgaggccagaaagacauucguggaccugaugcggcgcggggaucucccuguuuggcuugcuuauaaaguggccgcugagggaaucaacuacgccgacagaaagugguguuuugauggcauuaagaauaaccagauccuggaagagaacgucgaaguggagauuuggaccaaagagggggaacggaagaaacugaagcccagauggcucgacgcgcgcaucuauagcgauccucuggcccuuaaagaguucaaggaguucgcugccggccggaagucccugacgcucaaucugaucaccgagaugggaagacugcccacauuuaugacccagaaagcucgcaacgcccucgacaaucuugccguucugcauacagcugaagugggcgggcgggcgcacaaccacgcccugucugagcucccggagacccuggaaacacuucugcuccugacccugcucgcuacggucacaggaggcauuuuccuuuuucugaugagcgggaagggaaucggcaaaaugacccugggcaugugcugcauuaucaccgccuccauucuccugugguacgcccaaauccagccucauuggaucgcugccagcauuauccuugaguucuuucugauugugcuccugauccccgaacccgagaagcagagaacaccucaggauaaucaacugaccuaugucgugauugcgauccucacaguuguggccgcuacgauggccaacgaaaugggguuccuugagaaaaccaagaaggaccugggauuuggcucuaucacaacccaggaguccgaaagcaauauucuggacaucgaucuccggccggcuuccgccuggacacuguacgcgguggccaccacguucgucacccccaugcuucgccacucuauugagaacagcuccguuaaugugucucugacagcuaucgccaaccaggcuaccgugcucauggggcugggaaaaggcuggccucugagcaagauggacauuggggucccccuccuugccaucggauguuauucccaggugaauccuauuacacugaccgcugcccugcuccugcuuguugcgcauuacgccaucaucggccccggccugcaagcuaaagccacgagagaagcucagaagcgggccgccgcggggauuaugaaaaacccuacaguggauggaaucaccgucauugaccucgagccgauccccuacgauccuaaguuugaaaagcagcugggccaggugaugcugcucauucuuugcgucacacaagugcugaugaugcgcaccaccugggcucugugugaggcccucacacuggcuacggggcccaucagcacccuuugggagggaaauccuggcagauucuggaacacaaccaucgccguuucuauggccaauauuuuucggggguccuaucuggcuggagccggccuccuguucagcaucaugaaaaacacaaccaauacgcgcagaggcacagggaacgugggagaaacccugggcgagaaguggaaaucucggcucaacgcgcuugggaaguccgaauuucagauuuacaaaaagagcggaauccaggaggucgaccgcacccuggccaaagagggcauuaagagaggggaaacagaucaccaugcugugucucggggaagcgccaagcugagaugguucguugagcgcaauauggugacccccgaaggcaaagucguggaccucggcugcgggcggggaggcugguccuauuacugugggggacugaagaacgugagagagguuaaaggccuuacaaaagggggaccgggccacgaagaaccuauccccaugucuacguauggcuggaaucugguccgccuccaaagcgggguggauguguucuuuacacccccugagaaaugcgacacccugcugugugauaucggagaauccagccccaacccuaccauugaggcuggccggacacucagaguccuuaaucugguugaaaacuggcugaauaacaauacccaguucugcaucaaggugcucaacccguacaugcccuccgugauugagaagauggaaacgcugcagcgcaaauaugggggagcccuuguccggaauccucugucuagaaacagcacccacgagauguacuggguguccaaugcgacaggcaacaucguuucuagcgugaauaugauuucccgcaugcucaucaaccgguuuaccaugaagcauaaaaaggccacauacgagcccgacgucgaucuggggucuggaaccagaaacaucggcauugaaagcgagaucccuaaucuggacauuaucggcaaacgcauugaaaagaucaagcaggagcacgaaacauccuggcauuaugaccaagaucaccccuacaaaaccugggcuuaucacgggagcuacgagacgaagcagacaggaucugccuccagcauggugaacggcguugugcggcuccuuaccaaaccgugggacgucgugccuauggugacccagauggcuaugacagauacgacccccuucgggcagcaaagagucuuuaaggagaaaguugacacacgcacccaggaaccuaaggagggaacaaagaaacugaugaagauuaccgccgaauggcuguggaaagagcucggcaagaaaaagacacccagaauguguacccgggaggaguucacgcgcaaagugagaucuaaugcugcccugggggcgaucuuuaccgaugagaacaaguggaaguccgcccgggaagcuguggaggacggaagauucugggaacuugucgaucgggagcgcaaucugcaucucgagggcaaaugcgaaacauguguguauaacaugaugggcaagagagagaaaaagcugggggaauuuggaaaagccaagggcagccgggcuaucugguacauguggcugggggcccgcuuccucgaguuugaagcccugggauuccuuaaugaggaccacugguuuucuagaggcaacucccugagcgggguugagggcgaaggacuccaucggcugggcuauauucuucgcgagguggggaagaaagaaggaggcgcgauguacgcugaugacaccgccgggugggauacaagaaucacccuggaggaccucaagaaugaagagauggucacgaaccacaugaaaggagagcauaagaaacuggccgaagcuauuuucaagcugacauaccagaauaaggugguucgggugcagcgcccuacccccagaggcacagucauggacaucauuucccggaaagaucaacgcgggagcggccaggugggaaccuauggccucaacacguucaccaauauggaggcccagcugaucagacaaauggaaggggagggaaucuuuaagucuauucagcaccuuacagcuaccgaggaaaucgccguucagaacuggcuggcgcgggugggccgcgagagacucagccggauggccauuuccggggacgauugcgucgugaaaccgaucgacgauagauucgcuucugcccugacagcucuuaaugacaugggaaagguccgcaaagauauucagcaaugggaaccuagccggggcuggaacgacuggacccaggugcccuuuugcucccaccauuuccacgagcugguuaugaaggaugggagagugcucgucgugcccugucgcaaccaggacgaacugaucggccgggccagaaucucucagggagcgggcuggagccugaaggagacagccugccucgggaaauccuacgcucaaauguggacccugauguauuuucaucgccgggaucuuagacuggccgcuaaugccauuuguucugcugugccuagccacuggguuccgacgucccgcacaaccuggagcauccacgccaagcaugaguggaugaccacagaagacaugcucgcgguguggaaccgggucuggauucaggagaaucccuggauggaagauaaaaccccuguggagucuugggaagagguucccuaccugggaaagagagaggaccaguggugcggcucccuuaucgggcugacaagccgcgccacgugggcuaaaaacauucagaccgccaucaaucaagugcggucucucauuggaaacgaagaguauacagacuacaugccuuccaugaagagauuccggagagaagaggaagaggccggcguccugugguga

SEQ ID NO: 19951 - RNA, 9876 nt, Artificial Sequence
  derived and/or modified CDS sequence (opt5) from DENV-2__EU677141__SS-prME
accgccggagugaucauuaugcugauccccacagcuauggccuuccaccucacgaccagaaauggggaaccucauaugauugugggacggcaggaaaagggcaaaagccugcuuuuuaagacagaagacgggguuaauaugugcacccugauggcgaucgaucucggagaacugugugaggacacaauuaccuacaaaugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgcuacguccugggccggcucaucaccgugaacccuauuguuacagggaaggacagcccggugaacaucgaagccgagcccccuuuuggcgauucuuacauuaucaucggagucgaacccggccagcugaaacuuaauugguucaagaagggguccagcauuggacagauguuugagaccacaaugagaggcgcuaaacgcauggccauccugggggacaccgccugggauuucggaucucucggcgggguguuuacgagcauuggcaaggcucugcaucaaguuuucggagccaucuauggcgcggcuuuuuccggggugucuuggacaaugaaaauucugaucggagucaucauuaccuggaucggcaugaacagccgguccaccagccuuucugugucccucgugcugguuggggucgugacacuguaccucggagugaugguccaggccgacagcggcugugugguuucuuggaagaauaaagagcugaagugcggguccggcauuuucaucaccgauaacgugcacacauggacggaacaguauaaguuucagccugagagccccuccaaacuugccucugcuauucaaaaggcccacgaagagggaaucuguggcaucagaagcgucacccgccuggaaaaucucauguggaaacagauuacaccggagcugaaccauauccuguccgagaaugaagugaaacuuaccauuaugacaggggacaucaaaggaauuaugcaggcuggcaagcggucucucagaccucagcccaccgagcugaaauacagcuggaagacgugggggaaggccaaaaugcuguccaccgaaagccacaaccaaacauuccucaucgauggaccugagaccgcggaaugccccaauacaaaccgcgccuggaacucucuggagguugaggacuauggcuuuggcguguucuccaccaacaucuggcuuaagcugcgggaaaaacaggacgucuuuugugauagcaagcucaugucugcugccauuaaagacaauagagcugugcaugccgauaugggguacuggaucgaguccgcgcugaacgacacauggaagauggaaaaggccagcuucauugagguuaaaucuugccacuggccuaagagccacacccugugguccaauggagugcuugagagcgaaaugaucauucccaaaaacuucgcuggcccggucucucagcauaacuaucgcccuggguaccacacgcagacagccggacccuggcaucucggcaagcuggagauggauuuugacuucugugaagggaccaccgugguggucacagaggauugcggaaaucggggccccucccugagaaccacgacagcuagcggcaaacucaucaccgaauggugcugucgguccugcacacugccuccgcuucgcuacagaggggaggacggauguugguauggcauggagauucggccccugaaggaaaaggaggaaaaccucguuaauucucuggugaccgccgggcacggacaaaucgauaacuuuagccugggcgugcuugggauggcccucuuccuggaggaaaugcugagaacacgcgucggaaccaaacaugcuauccuccugguggcgguuuccuuugugacgcuuauuaccggcaauaugucuuuccgggaccugggcagagucauggugaugguuggggccacaaugaccgaugacaucggaaugggcgugacauaccucgcucugcuggccgccuuuaagguccgcccuaccuucgcugccgggcuucugcucagaaaacugacgagcaaggagcucaugauggcgacaauuggaaucgcucugcuuucccagucuaccauucccgagacaauccuggaacucaccgaugcccuggcccugggcaugauggugcuuaaaaucguucggaacauggagaaguaucagcuggcugugaccauuauggccauccucugcgucccuaaugcggugauucugcaaaacgcuuggaaggugagcuguacaauccucgccgccgucuccguuagcccccugcuucugacgucuucccagcagaaagcugacuggauuccucucgcccugaccaucaaggggcugaaucccacagcuaucuuucuuaccacacugagccgcaccucuaaaaagagauccuggccgcucaacgaagccgugauggcggugggaauggucagcauucuggccucuucccuccugaaaaaugacaucccuaugacgggcccccuuguggcuggcgggcugcugacaguuugcuacgugcucaccggacggagcgccgaucuggagcuugaacgcgcugccgacgucaagugggaggaucaggccgagauuuccggcagcucuccuauccugagcauuaccaucuccgaagacgggucuaugagcauuaaaaacgaggaagaggagcaaacacucaccauccugaucagaacaggacuccuggugauuuccggcguuuuccccgugucuaucccgauuacggcugcggccugguaucuuugggaagucaagaagcagcgggcuggggugcugugggaugucccuucucccccucccgugggaaaagccgagcuggaagacggcgccuaccgcaucaagcagagaggcauuuuuggguauucccagaucggagcuggcguuuacaaagaggggaccuuccacacaauguggcacgugacccggggagccguccucaugcaucgcggcaagagaaucgaacccuccugggcggaugugaaaaaggaccugauuagcuacgggggaggcuggaaacuugagggcgaguggaaagaaggggaggaaguucaagugcuggcucucgagccuggaaagaauccgcgggccguccagacaaaacccggccuguuuaagaccaacacggggaccaucggagccgugucccucgauuucagcccuggcacaucugggucccccauuguggacagaaaaggaaagguugucggccuguauggcaaugggguggugacccgcagcggagcuuacgucucugccaucgcgcagacagaaaaguccauugaggauaacccugagaucgaagacgauaucuuccggaaaaagagacuuaccauuauggaccugcaccccggcgcugggaaaacaaagcgcuaucugccugccaucgugcgggaggccauuaaaagaggacuccgcacgcugauccuugcuccgacccggguuguggccgcugaaauggaggaagcccugagaggccuccccauucgcuaccagaccccugcgauccgggccgagcauaccgggagagagauugucgaccugaugugucacgcuaccuuuacaaugcggcuccugagccccgugcgcguuccuaacuauaaucuuaucaucauggaugaagcccauuucacggaccccgcuuccauugccgccagaggcuacaucucuacccggguggagaugggagaagcugcgggcauuuuuaugacagccaccccgccugggagccgcgaucccuucccccaauccaacgcuccuaucauggacgaggagagagaaauucccgagcggagcuggaacucuggacacgaaugggucacagauuuuaagggcaagaccgugugguucguuccuuccaucaaagccgggaacgacaucgccgcuugccugagaaagaauggcaagaaggugauucagcugagccgcaaaacguuugauucugaguaugucaagacacgggccaacgacugggauuucguggugaccaccgacaucagcgaaaugggcgcgaauuuuagagcugagcgcgucauugauccgcggagauguaugaagcccguuauccucacagacggggaggaacgcgugauucuggccggcccuaugcccgugacccacuccucugccgcucagcggagaggacgcaucggcagaaacccuaaaaaugagaacgaccaauacaucuacaugggggaaccccuugagaaugaugaagacugcgcccauuggaaggaggcgaaaaugcugcucgauaacauuaauacaccggagggaaucauuccuagcauguucgaacccgagcgggaaaaggucgacgccaucgauggcgaguaucgccugagaggggaagcucggaaaaccuuuguggaccugaugcgcagaggagaucucccuguuuggcuugccuaccggguggcugccgagggcauuaacuaugcugacagacgcugguguuucgaugggaucaagaauaaccagauucuggaggaaaacgucgagguggaaaucuggacgaaagagggcgagcggaagaagcugaaacccagauggcucgacgcccgcaucuacuccgauccucuggcgcuuaaggaguucaaagaguuugccgcuggacggaagucucugacacucaaucugauuaccgaaaugggcagacugcccacauucaugacccagaaagcccgggacgcucucgauaaccuugccguucugcacacggccgaggucgggggacgcgcuuauaaucaugcgcugagcgaacucccggagacccuggagacacuucugcuccugacccugcucgccacagucaccggcgggaucuuucuuuuccugauguccggaaagggcauuggcaagaugacacuggggaugugcugcaucauuaccgcuagcauccuccugugguacgcccagauccaaccucacuggauugccgcuucuaucauucuugaauuuuuccugaucgugcuccugauucccgagcccgaaaaacagagaacgccucaggacaaccagcugacauaugucgugaucgccauccucaccguuguggcggccaccauggcuaaugagaugggauuucuugaaaagaccaagaaggaccugggccugggguccauuaucacccaagagagcgaguccaacauucucgauaucgaccugcggccggccucugcuuggacacuuuacgccguggcgacgaccuucgucacacccaugcugcgccacagcauugaaaauuccucuguuaacgugagccucaccgccaucgcuaaucaggccacagugcugaugggacugggcagaggguggccucucuccaaaauggauauuggagucccccuucuggcuaucggcuguuacagccaggugaacccuaucacccugacggccgcucuccugcuucugguugcccauuaugcgauuaucggccccgggcuccaggccaaggcuacccgggaggcccaaaagcgcgcugccgccggaauuaugaaaaauccuacaguggacggcaucaccgucauugaucuggaaccgauccccuacgacccuaaguuugagaaacagcugggacaggugaugcuccuuguccugugcgugacacagguucugaugaugagaaccacgugggcgcucugugaagcucugacacuugccaccggacccaucucuacacugugggagggcaacccugggcgguucuggaauaccaccauugcuguguccauggccaacaucuuucgcggaagcuaucucgccggcgcuggccugcuguucucuauuaugaagaauacaacgaacaccagacgggggacaggaaauaucggcgagacccucggggaaaaauggaaguccagacuuaacgcccugggaaagagcgaguuucaaauuuacaaaaagucuggcauccaggaagucgaucgcacacuggcgaaagaggggaucaagcggggagagaccgaccaccaugccgugagcagaggcuccgcuaaacuccgcugguucguugaacggaacauggugacgcccgagggcaaggucguggaucuggggugcggaagaggcggguggucuuauuacuguggaggccuuaaaaaugugcgcgaaguuaaggggcugacaaagggaggcccgggccacgaggaaccuauucccaugagcaccuauggguggaaccucguccggcugcaguccggaguggacguguucuuuacacccccugagaaaugcgauacacugcucugugacaucggcgagagcucccccaauccuaccauugaagccgggagaacacuucgcguccugaaccugguugagaauuggcucaacaauaacacgcaauucugcaucaaggugcugaauccguacaugcccucugugauugagaagauggagacccuucagcggaaguacggaggcgcucuggucagaaacccucucagccgcaauuccacacaugaaauguauugggugucuaacgccaccgggaauaucguuagcuccgugaacaugaucucucggaugcugauuaauagauuuacaaugaaacacaagaaggcgaccuacgagcccgaugucgaccugggaagcggcacgcgcaacaucggcauugagaacgaaaucccuaaucucgacauuaucgggaaaagaauugagaagaucaaacaggaacacgagaccuccuggcauuaugaucaggaccaccccuacaagacaugggccuaucauggaagcuacgaaaccaaacaaacaggcucugcuuccagcauggugaacgggguugugcggcuucugaccaagccgugggaugucgugccuauggugacacagauggccaugaccgacacgacacccuucggacagcagcgcgucuuuaaggagaaaguugauaccagaacccaagagccuaaggaaggcaccaaaaagcugaugcggaucacggcugaguggcucuggaaagaacuggggaagaagaaaacccccagaauguguacacgggaggaguucacccgcaaggugagaucuaaugccgcucuuggagccauuuuuacagacgaaaacaaauggaaguccgcgcgggaggccguggaagauagccgcuucugggagcuggucgacagagaacggaaucuccaccuggagggcaaaugcgagaccuguguguauaacaugaugggcaagcgcgagaaaaagcugggggaguuuggaaaggcuaaaggcucuagagccaucugguacauguggcucggggcucgguuccuggaauuugaggcccuuggauuccugaaugaagaucacugguuuucccgcggcaacagccucuccgggguugagggcgagggacugcauaaacuuggcuacauucugagagacgugagcaaaaaggaagggggagccauguaugcggaugacacagcuggcugggacacccggaucacgcucgaggaucugaaaaaugaagagauggucaccaaccacaugaagggggaacauaagaaacuggccgaggccauuuucaagcucacauaccagaauaaagugguucgcgugcagagaccuacaccccggggaacagucauggacaucaucucucgcaaggaucagagaggcagcgggcaagugggcaccuauggacugaacacguucacaaauauggaggcucagcuuauucggcagauggaaggcgaggggaucuuuaaauccauucaacaccugaccguuacagaagagaucgccgugcagaacuggcucgcuagagucggacgcgagcggcugucuagaauggccauuagcggcgacgauugcguggucaagccgcuugacgaucgcuucgcguccgcccugaccgcucucaaugacauggggaaggugcggaaagauauccagcagugggaaccuucuagaggauggaacgacuggacgcaaguucccuuuugcagccaucacuuccacgagcuggugaugaaggauggccgcguccugguggugcccugucggaaccaggacgaacucaucgggagagcccgcauuucccagggcgcuggauggucucugaaagagaccgccugccuuggcaagagcuacgcgcagauguggacacugauguauuuucaucggagagaucuccgccuggccgcuaaugccaucuguuccgcuguuccuagccacugggugccgaccucucggacaaccugguccauucaugccaaacacgaauggaugacaaccgaggacaugcuugcugucuggaacagaguguggauccaagagaaucccuggauggaagacaagacgccuguugagagcugggaagaggugcccuaccuggggaagcgggaagaucaguggugcggaucucucauuggccugacauccagagccaccugggcgaaaaacauccagaccgccauuaaucagguccgcagccugaucgggaacgaggaguauacagacuacaugccuuccaugaagcgguucagaaaagaagaggaagaggcuggagugcucugguga

SEQ ID NO: 19952 - RNA, 9876 nt, Artificial Sequence
  derived and/or modified CDS sequence (opt5) from DENV-2__EU677144__SS-prME
accgccggcaugaucauuaugcugauccccacagcuauggccuuccaccucacgaccagaaacggggagccucauaugauugugggacggcaggaaaagggcaaaagccugcuuuuuaagacagaggacggggucaauaugugcacccugauggcgaucgaucucggagaacugugugaggacacaauuaccuacaaaugcccgcuucugcgccaaaacgaacccgaggauaucgacuguuggugcaauuccacaucuaccuggguuacguauggcaccuguacaaccacaggggagcacagacgggaaaagcgcagcguggcucucgugccucaugucggaaugggccuggagaccagaacggaaacauggauguccucugagggcgccuggaaacacgugcagcggaucgagaccuggauucugcgccaucccggguucacaaucauggccgcuauucucgccuacaccaucggaaccacacacuuucagagagcucugauuuucauccuucugacggccguugcgccuagcaugaccaugcggugcauuggcaucuccaaccgcgauuuuguggaaggggucucuggaggcagcuggguggacaucguucucgagcacggguccugugugacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagagcaggacaaacgcuuuauuugcaagcauuccauggucgauagaggcuggggcaacggguguggacuguucggcaaggggggaaucgugacaugcgccauguuuacgugcaaaaagaauauggaaggcaaagugguccucccugagaaccuggaauacaccauuguuaucacaccccacagcggggaggagcaugcggugggaaaugacaccggcaagcacggcaaagaaaucaagauuacaccucagucuuccaucaccgaggccgaacuuacgggguauggaaccgugacaauggaguguagcccccggaccggccuggauuucaacgaaaugguccuccugcagauggaggacaaagcuuggcuugugcaccgccaaugguuucuggaucucccgcugccuuggcugcccggggccgacacacagggacucaauuggauucagaaggagacccugguuacguucaagaacccucaugcuaaaaagcaggacguggucgugcuuggcucucaagaaggggccaugcacacagcccugaccggcgcuacagagauccagauguccagcggaaaucuccuguuuaccggccaucuuaaaugcagacugcggauggauaagcuccagcugaaagggauguccuacucuauguguaccggaaaguucaagauuguuaaagaaaucgcggagacacaacacggcacgaucgugauuagaguccaguaugagggggacggaagccccugcaagauccccuucgaaauuauggaucuggagaaacgcuacgugcucggccggcugaucaccgucaacccuauugugacagaaaaggacuccccgguuaacaucgaggccgaacccccuuuuggggauagcuacauuaucaucggcguggagcccggacagcuuaaacugaauugguucaagaagggcucuuccauugggcagauguuugagaccacaaugagaggagcuaaacgcauggccauccucggcgacaccgccugggauuucgggagccugggaggcgucuuuacgucuauugggaaggcucugcaucaaguguucggcgccaucuauggagcggcuuuuagcggcguuuccuggacaaugaaaauucuuaucggggugaucauuaccuggaucggaaugaacucucggagcaccucccucagcgucucucuggugcuggugggcguugucacacucuaccugggggugauggugcaggccgacuccggaugugucgugagcuggaagaauaaagaacuuaagugcggcucugggauuuucaucaccgauaacguucacacauggacggagcaguauaaguuucagccugaaucccccagcaaacuggccuccgcuauucaaaaggcccacgaggaaggcaucuguggaaucagaucugugacccgccucgagaaucugauguggaaacagauuacaccggagcugaaccauauccuuagcgaaaaugaggucaagcucaccauuaugacaggcgacaucaaagggauuaugcaggcuggaaagcggucccugagaccucagcccaccgaacugaaauacucuuggaagacguggggcaaggccaaaaugcucagcaccgagucccacaaccaaacauuccugaucgaugggccugaaaccgcggagugccccaauacaaaccgcgccuggaauagccuugagguggaagacuauggauuuggcguuuucucuaccaacaucuggcugaagcuccgggagaaacaggacguguuuugugauuccaagcugaugagcgcugccauuaaagacaauagagcuguccaugccgauaugggcuacuggaucgaaucugcgcugaacgacacauggaagauggagaaggccuccuucauugaggugaaaagcugccacuggccuaagucucacacccuuuggagcaaugggguucucgaauccgagaugaucauucccaaaaacuucgcuggaccggugagccagcauaacuaucgcccuggcuaccacacgcagacagccgggcccuggcaucugggaaagcuggaaauggauuuugacuucugugagggcaccaccgucguggugacagaagauugcgggaaucggggacccucucucagaaccacgacagcuuccggcaaacugaucaccgaguggugcugucggagcugcacacuuccuccgcugcgcuacagaggcgaggacggguguugguauggaauggaaauucggccccucaaggagaaggaagagaaccuggucaauucccugguuaccgccggccacgggcaaaucgauaacuuuucucuuggagugcucggcauggcccuguuccuggaagagaugcucagaacacgcguggggaccaaacaugcuauccugcuugucgcggugagcuuuguuacgcugauuaccggaaauauguccuuccgggaccucggcagagugauggucauggugggcgccacaaugaccgaugacaucgggaugggaguuacauaccuggcucugcuugccgccuuuaaggugcgcccuaccuucgcugccggccugcuccugagaaaacucacgucuaaggagcugaugauggcgacaauugggaucgcucuucugagccaguccaccauucccgaaacaauccucgagcugaccgaugcccuggcccuuggaaugaugguccugaaaaucgugcggaacauggaaaaguaucagcucgcuguuaccauuauggccauccugugcgugccuaaugcggucauucuccaaaacgcuuggaaggugucuuguacaauccuggccgccgugagcgucuccccccuucugcucacgagcucucagcagaaagcugacuggauuccucuggcccugaccaucaagggccuuaaucccacagcuaucuuucugaccacacucucccgcaccagcaaaaagagaucuuggccgcugaacgaggccguuauggcgguggggaugguguccauucucgccagcucucugcuuaaaaaugacaucccuaugacgggaccccuggucgcuggcggccugcucacagugugcuacguucugaccgggcgguccgccgaucuugaacuggagcgcgcugccgacgugaagugggaggaucaggccgaaauuagcggauccagcccuauccucucuauuaccaucagcgaggacggcuccaugucuauuaaaaacgaagaggaggaacaaacacugaccauccucaucagaacagggcugcuugucauuagcggaguguuccccguuuccaucccgauuacggcugcggccugguaucugugggaggugaagaagcagcgggcuggcguccugugggaugugccuucucccccucccauggaaaaagccgagcucgaagacggggccuaccgcaucaagcagagaggaauuuuuggcuauagccagaucggcgcuggggucuacaaagagggaaccuuccacacaauguggcacgugacccggggcgccguucugaugcaucgcgggaagagaaucgagcccuccugggcggaugugaaaaaggaccuuauuucuuacggaggcggguggaagcuggaaggagaguggaaagaaggcgaggaaguccaagugcucgcucuggagccuggcaagaauccgcgggccguucagacaaaacccgggcucuuuaagaccaacacgggaaccaucggcgccgugagccuggauuucuccccugggacaagcggaucucccauugucgacagaaaaggcaaggugguggggcuuuauggaaauggcguugucacccgcuccggcgcuuacgugagcgccaucgcgcagacagagaagucuauugaagauaacccugagaucgaagacgauaucuuccggaaaaagagacugaccauuauggaccugcaccccggggcuggaaaaacaaagcgcuaucucccugccaucgugcgggaggccauuaaaagaggccugcgcacgcuuauccuggcuccgacccgggucguggccgcugaaauggaggaggcccucagagggcugcccauucgcuaccagacaccugcgauccgggccgaacauaccggaagagagauuguugaccucaugugucacgcuaccuuuacaaugcggcugcuuucccccgugcgcgucccuaacuauaaucugaucaucauggaugaagcccauuucacggaccccgcuagcauugccgccagaggcuacaucuccacccggguggagaugggggaggcugcgggcauuuuuaugacagccaccccgccuggaucucgcgaucccuucccccaaagcaacgcuccuaucauggacgaagagagagaaauucccgagcgguccuggaauagcggccacgaauggguuacagauuuuaaggggaagaccgugugguucgucccuucuaucaaagccggaaacgacaucgccgcuugccugagaaagaauggcaaaaaggugauucagcucucccgcaaaacguuugauagcgaguauguuaagacacgggccaacgacugggauuucguggucaccaccgacaucucugagaugggggcgaauuuuagagcugaacgcgugauugauccgcggagauguaugaagcccgugauccugacagacggagaggaacgcgucauucuugccggcccuaugcccguuacccacagcuccgccgcucagcggagagggcgcaucggcagaaacccuaaaaaugagaacgaccaauacaucuacaugggagaaccccuggagaaugaugaggacugcgcccauuggaaggaagcgaaaaugcuccuggauaacauuaauacaccggagggcaucauuccuucuauguucgaacccgagcgggaaaagguggacgccaucgauggggaguaucgccugagaggagaggcucggaaaaccuuuguggaccucaugcgcagaggcgaucuuccugucuggcuggccuaccggguggcugccgaagggauuaacuaugcugacagacgcugguguuucgauggaaucaagaauaaccagauucuggaggaaaacguugagguggagaucuggacgaaagaaggcgagcggaagaagcucaaacccagauggcuggacgcccgcaucuacagcgauccucuugcgcugaaggaauucaaagaguuugccgcugggcggaagucccucacacugaaucugauuaccgaaaugggcagacuccccacauucaugacccagaaagcccgggacgcucuugauaaccuggccguccugcacacggccgaggugggaggccgcgcuuauaaucaugcgcucucugagcugccggaaacccuugagacacugcuccugcugacccuccuugccacaguuaccgggggaaucuuucuguuccugaugagcggcaaggggauuggaaagaugacacucggcaugugcugcaucauuaccgcuuccauccugcuuugguacgcccagauccaaccucacuggauugccgcuagcaucauucuggaauuuuuccucaucgugcugcugauucccgagcccgaaaaacagagaacgccucaggacaaccagcucacauaugucgugaucgccauccuuaccgucguggcggccaccauggcuaaugagaugggcuuucuggagaagacaaaaaaggaccuggggcucggaucuauuaucacccaagaauccgagagcaacauucuggauaucgaccuucggccggccuccgcuuggacacuguacgccguugcgacgaccuucgugacacccaugcuccgccacucuauugaaaauagcuccgugaacgucucucugaccgccaucgcuaaucaggccacaguucugaugggccucgggagaggauggccucuuagcaaaauggauauuggcgugccccugcuggcuaucggguguuacucccaggugaacccuaucacccucacggccgcucugcuucugcucgucgcccauuaugcgauuaucggacccggccugcaggccaaggcuacccgggaggcccaaaagcgcgcugccgccggcauuaugaaaaauccuacaguggacgggaucaccguuauugaucuggaaccgauccccuacgacccuaaguuugagaaacagcucggacaggugaugcuucugguccugugcgugacacagguccucaugaugagaaccacgugggcgcugugugaggcucuuacacuggccaccggccccaucagcacacucugggaagggaacccuggacgguucuggaauaccaccauugcugugucuauggccaacaucuuucgcggcuccuaucuggccggggcuggacugcucuucagcauuaugaagaauacaacgaacaccagacggggcacaggcaauaucggggagacccuuggagaaaaauggaagucuagacugaacgcccugggcaaguccgaguuucaaauuuacaaaaagagcgggauccaggagguugaucgcacacucgcgaaagaaggaaucaagcggggcgagaccgaccaccaugccgugucuagagggagcgcuaaacugcgcugguucgucgaacggaacauggugacgcccgagggaaagguuguggaucuuggcugcggcagagggggaugguccuauuacuguggcgggcugaaaaauguccgcgaagugaagggacucacaaagggcgggccgggacacgaggagccuauucccaugucuaccuauggcuggaaccuggugcggcugcagagcggcguugacgucuucuuuacccccccugaaaaaugcgauacacuccuuugugacaucggggaguccagccccaauccuaccauugaagccggaagaacacugcgcgugcugaaccucguggagaauuggcugaacaauaacacgcaauucugcaucaagguccuuaauccguacaugcccuccguuauugaaaaaauggagacccugcagcggaaguacggcggggcucucgugagaaacccucugucucgcaauagcacacaugagauguauuggguguccaacgccaccggaaauaucgucucuagcgugaacaugaucucccggaugcugauuaauagauuuacaaugaaacacaagaaggcgaccuacgaacccgauguugaccucggcucugggacgcgcaacaucggaauugagaacgaaaucccuaaucuugacauuaucggcaaaagaauugagaagaucaaacaggaacacgagaccagcuggcauuaugaucaggaccaccccuacaagacaugggccuaucauggcuccuacgagaccaaacaaacagggagcgcuucuuccauggugaacggagucgugcggcugcugaccaagccgugggauguugugccuauggucacacagauggccaugaccgacacgacacccuucggccagcagcgcguguuuaaggaaaaaguggauaccagaacccaagagccuaaggaagggacaaaaaagcucaugcggaucacggcugaguggcuguggaaagagcuuggaaagaagaaaacccccagaauguguacacgggaagaguucacccgcaaggucagaagcaaugccgcucugggcgccauuuuuacagacgaaaacaaauggaagucugcgcgggaggccguugaagauucccgcuucugggagcucguggacagagagcggaaucugcaccuggaagggaaaugcgagaccuguguguauaacaugaugggaaagcgcgaaaaaaagcucggcgaguuuggcaaggcuaaagggagcagagccaucugguacauguggcugggagcucgguuccuugaauuugaggcccugggcuuccucaaugaggaucacugguuuucucgcgggaacucccugagcggagucgaaggcgaggggcuucauaagcugggcuacauucucagagacguguccaaaaaggaaggaggcgccauguaugcggaugacacagcugggugggacacccggaucacgcuggaggaucugaaaaaugaagagaugguuaccaaccacaugaagggagagcauaagaaacucgccgaagccauuuucaagcugacauaccagaauaaagugguccgcgugcagagaccuaccccccggggcacaguuauggacaucaucagccgcaaggaucagagagggucuggacaagugggcaccuaugggcuuaacacguucacaaauauggaggcucagcugauucggcagauggaaggcgagggaaucuuuaaaagcauucaacaccucaccgucacagaggaaaucgccgugagaaacuggcuggcucgcguuggccgggagagacuuucccgcauggccauuucuggggacgauugcguggucaagccgcuggacgaucgguucgcgagcgcccucaccgcucugaaugacaugggaaaggugagaaaagauauccagcagugggaaccuucccgcggcuggaacgacuggacgcagguccccuuuugcucucaucacuuccacgagcuggugaugaaggaugggcggguucucgugguccccuguagaaaccaagacgaacugaucggacgcgcccggauuagccagggcgcuggguggucccuuaaagagaccgccugccugggcaagucuuacgcgcagauguggacacucauguauuuucauagacgcgaucugcggcuugccgcuaaugccaucuguagcgcugugccuucccacugggugccgaccagcagaacaaccuggucuauucaugccaaacacgaguggaugacaaccgaagacaugcuggcuguuuggaaccggguguggauccaggagaaucccuggauggaagacaagacgccugucgaguccugggaagaggugcccuaccucggaaagagagaggaucaauggugcggcagccugauugggcugacaucucgcgccaccugggcgaaaaacauccagaccgccauuaaucagguucggucccucaucggaaacgaagaguauacagacuacaugccuagcaugaagagauuccgcaaagaagaggaagaggcuggcgugcugugguga

SEQ ID NO: 19953 - RNA, 9876 nt, Artificial Sequence
  derived and/or modified CDS sequence (opt5) from DENV-2__EU677145__SS-prME
accgccggcgugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaaaugcccgcuucugagacaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucauuaccgaaaaggacagcccggugaacaucgaggccgaacccccuuuuggggauucuuacauuaucaucggcgucgagcccggacagcucaaacugaauugguucaagaagggcuccagcauugggcaaauguuugagacaaccaugagaggagcuaaacgcauggccauccuuggcgacacggccugggauuucgggucucugggaggcguguuuacaagcauugggaaggcucuccaccagguuuucggcgccaucuacggagcggcuuuuuccggcgugucuuggaccaugaaaauucugaucggggucaucauuaccuggaucggaaugaacagccgguccacaagccugucugugucccuugugcucguuggcgucgugacccuguaucugggggccauggugcaggccgacagcggaugugucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaagagcuucgccggaccggugucucagcacaacuaccgcccuggcuaucauacccaaaccgcugggcccuggcaccuuggaaagcucgaaauggauuuugacuucugugagggcacaaccgucguggugacggaagauugcgggaaccggggacccucccugagaacaaccacagccagcggcaaacugaucaccgaguggugcugucgguccugcacacucccuccgcugcgcuacagaggcgaggacggguguugguacggaauggaaauucggccccuuaaggagaaggaagagaaucuggucaacucucucguuaccgccggccaugggcagaucgauaauuuuagccugggagugcugggcauggcucuuuuccucgaagagaugcugagaacgcgcguggggaccaaacacgcgauccugcucgucgccguguccuuuguuacacugauuaccggaaacaugucuuuccgggaccuuggcagagugauggucauggugggcgcuacaaugaccgaugacaucgggaugggaguuacguaucuggcccuccuggccgcuuuuaaggugcgcccuacauucgccgcgggccugcuucugagaaaacucaccagcaaggagcugaugauggcuacaauugggaucgcccuccugucccagucuaccaugcccgaaaccauucuugagcugacagaugcccucgcucugggaaugaugguccugaaaaucgugcggaauauggaaaaguaccaacuugccguuacgaucauggcgauuagcugcgugccuaacgcugucauccugcagaaugccuggaagguguccuguaccauucucgccacagugagcgucucuccccugcuccugaccuccagccagcagaaagcugacuggaucccucuugcccugacaauuaagggccucaaccccaccgcuaucuuucugacgacacugucucgcaccuccaaaaagagaagcuggccgcuuaaugaggccaucauggcgguugggauggugucuauucuggccuccagccuccugaaaaacgacaucccuaugaccggaccccucguggcuggcggccugcuuacagucugcuaugugcugaccgggcgguccgccgaucuggaacucgagcgcgcugccgacguuaagugggaggaucaagccgaaauuagcggaucuagcccuauccuguccauuacaaucucugaggacggcagcauguccauuaaaaaugaagaggaggaacagacgcuuaccauccugaucagaacagggcuccuggugauuucuggagucuuccccgugagcaucccgauuaccgcugcggccugguaccucugggagguuaagaagcagcgggcuggcgugcugugggaugucccuucucccccucccguggggaaagccgaacuugaggacggagccuaucgcaucaagcagagaggcauucugggcuacagccaaaucggggcuggagucuauaaagaaggcacauuucacaccauguggcaugugacgagaggggccguucugaugcaccgcggaaagagaaucgagcccagcugggcggaugugaaaaaggaccucauuuccuacggcgggggauggaagcuggagggcgaauggaaagagggcgaagagguccaggugcuugcucuggaaccugggaagaacccgcgggccguucagaccaaacccggaaucuucaagacaaauaccggcacaauuggggccgugagccucgauuuuucuccuggaaccuccggcagccccaucgucgacagaaaagggaagguggugggacuguacggcaacggcguugucacacgcucuggggcuuauguguccgccauugcgcagacggaaaaguccaucgaggauaauccugaaaucgaggacgauauuuuccggaaaaagagacucaccaucauggaccugcaucccggagcuggcaaaacaaagcgcuaccuuccugccauugugcgggaagccaucaaaagagggcugcgcacccugauucucgcuccgacccgggucguggccgcugagauggaagaggcccugagaggacuucccauccgcuaucaaaccccugcgauucgggccgagcacacgggcagagaaaucguugaccugaugugucaugcuaccuucacaaugcggcuccugucccccgugcgcgucccuaacuacaaccucaucauuauggaugaggcccacuuuaccgaccccgcuucuaucgccgccagaggguauauuagcacacggguggaaaugggcgaggcugcgggaaucuucaugaccgccacgccgccuggcucccgcgaucccuuuccccagagcaaugcuccuauuauggacgaggaaagagagauccccgaacggucuuggaacuccgggcacgaguggguuacagauuucaagggaaagaccgugugguuugucccuagcaucaaagccggcaaugacauugccgcuugccugagaaagaacgggaaaaaggugauccagcuuucucgcaaaaccuucgauagcgaauacguuaagacacgggccaaugacugggauuuuguggucaccacagacauuuccgagaugggagcgaacuucaaggcugagagagugaucgauccgcgccgguguaugaaacccgugauucugaccgacggcgaagagagagucauccuggccgggccuaugcccguuacgcauucuagcgccgcucaacgccggggcagaaucggacgcaauccuaagaacgaaaaugaccaguauauuuacaugggcgagccccucgaaaacgaugaggacugcgcccacuggaaagaggcgaagaugcugcuugauaauaucaacacaccggaagggauuaucccuuccauguuugagcccgaaagagagaaaguggacgccauugauggagaauaccggcugcgcggcgaggcuagaaagaccuucguggaccucaugcggcgcggggaucugccugucuggcuggccuauagaguggcugccgagggaaucaauuacgcugaccggaaaugguguuuugauggcauuaagaacaaucagauccucgaagagaacguugaaguggagaucuggacaaaggagggggaacgcaagaaacuuaaaccccgcuggcuggacgcccggauuuauucugauccucuggcgcucaaggaguucaaagaguucgccgcuggcagaaagagccugacccuuaaccugaucacggagaugggacgccuccccaccuuuaugacacagaaggcccggaaugcucuggacaaccuggccguccuccauaccgccgaagcuggcgggagagcguacaaucacgcccuuuccgagcugccggagacacuggaaacccuccugcuucugacacuccuggcuaccgugacgggaggcauuuuccuguuucucaugagcgggaaaggaaucggcaagaugacacuuggcaugugcugcauuaucaccgccucuauccugcugugguaugcccaaauucagccucacuggaucgcugccuccauuauccucgaguucuuucugauuguucuucugauccccgaacccgagaaacagcggaccccucaggauaaccaacucacauacguggucaucgcgauucugaccguggucgccgcuacaauggccaaugaaaugggguuccuggagaagacgaaaaaggaccucggacuuggcagcaucaccacacaggaguccgaaucuaacauucuggacaucgaucugcgcccggcuagcgccuggacccucuaugcgguggccacaaccuuuguuacgcccaugcugagacauuccauugaaaauucuagcgugaacgugucccuuaccgcuaucgccaaucaggcuacaguccugauggggcucggaaagggcuggccucugagcaaaauggacauugggguuccccugcucgccaucggauguuacucucaggugaacccuaucacccuuacagcugcccugcugcuccugguggcgcacuacgccauuaucggccccggccuucaagcuaaggccacccgggaagcucagaaacgcgccgccgcggggauuaugaagaauccuacggucgauggaaucacagugauugaccuggagccgauccccuaugauccuaaauucgaaaagcagcucggccagguuaugcugcugauccucugcgugacccaaguccuuaugaugagaacaaccugggcucugugugaggcccugacccucgcuacagggcccauuuccacgcugugggagggaaacccuggccgguuuuggaauaccacaaucgccgugagcauggccaacauuuuccgcgggucuuaccuugcuggagccggccugcucuuuuccaucaugaagaauaccacaaacaccagacggggcacggggaauauuggagaaacacugggcgagaaauggaaaagccgccugaacgcgcucgggaaaucugaguuccagaucuauaagaaaagcggaauccaggaggucgacagaacccuugccaaggagggcauuaaaagaggggaaaccgaucaucacgcuguguccagaggaucugccaagcugcgcugguuuguugagcggaacauggugacacccgaaggcaaggucguggaccugggcugcgggagaggaggcuggagcuacuauugugggggacucaaaaauguucgcgaggugaagggccugaccaaagggggaccgggccaugaagaaccuguccccauguccacauacggcuggaaccuugugcggcugcaaagcgggguggauguuuucuucacgcccccugagaagugcgacacccuccugugugauaucggagaauccucucccaauccuacaauugaggcuggcagaacccugcgcguccucaaccuuguggaaaauuggcugaacaauaacacacaguuuugcaucaaagugcugaauccguauaugcccagcgucauugagaagauggaaacccuccagcggaaguacgggggagcccugguuagaaacccucuuucccgcaauucuacgcacgagauguacugggugagcaacgcgaccggcaauaucguguccucugucaacaugaucagccggaugcugauuaauagauucacaaugaaacacaagaaagccaccuaugagcccgacguggaucucggguccggaacacgcaacaucggcauugaaagcgagaucccuaaccuggacauuaucggcaagcggauugagaagaucaagcaggagcaugaaaccucuuggcacuacgaccaagaucaucccuauaagacaugggcuuaccacggguccuaugagaccaaacagacgggaagcgccucuuccaugguuaauggcguggucagacugcucacaaagccgugggacgugguuccuauggugacccagauggcuaugaccgauacaacgcccuuugggcagcaacgcgucuucaaagagaagguggacaccagaacacaggaaccuaaagagggaaccaagaaacuuaugaagaucacagccgaauggcuguggaaggagcugggcaaaaagaaaacaccccggauguguacacgcgaggaauuuaccaagaaagugagaagcaacgcugcccucggggcgauuuucacggaugagaauaaguggaagucugcccgggaagcugucgaggacggaagauuuugggaacugguugaucgggagcgcaaccuucaccuggagggcaaaugcgaaaccuguguguacaauaugaugggcaagagagagaaaaagcucggggaguucggaaaagccaagggcucccgggcuaucugguauauguggcugggggcccgcuuucuggaguucgaagcccucggauuucugaacgaggaccauugguucagcagaggcaauucccuuagcgggguggagggcgaaggacugcaccggcucggcuacauucugcgcgaggucgggaagaaagaaggaggcgcgauguacgcugaugacacagccgggugggauaccagaaucacacuugaggaccugaagaacgaagagauggugaccaaucauaugaaaggagagcacaagaaacucgccgaagcuauuuuuaagcugacguaucagaacaagguugugcggguccagcgcccuacacccagaggcaccgugauggacaucaucucucggcgcgaucaaagagggagcggccagguuggaacauacggccugaauaccuucacgaacauggaggcccagcucauucggcaaauggaaggggagggaaucuucaaauccauucagcaucugaccgcuacagaggaaaucgccgugcagaauuggcuugcgcgcgucggcagagagcggcugucuagaauggccauuagcggggacgauugcgugguuaagccgaucgacgaucgcuuugcuuccgcccucaccgcucugaacgacaugggaaaagugcggaaggauauccagcaaugggaaccuucuagaggcuggaaugacuggacacagguccccuucugcagccaccacuuucaugagcuugugaugaaagaugggcgcguccuggugguucccugucggaaccaggacgaacucauuggcagagcccgcaucucccagggagcgggcuggucucugaaggagaccgccugccugggaaagagcuaugcucaaauguggacacucauguacuuccaccggagagaucugcgccuugccgcuaacgccauuuguuccgcugugccuagccauugggucccgaccucucggacgacaugguccauccacgccaaacacgaguggaugaccaccgaagacaugcuggcgguguggaauagaguguggauucaggagaaccccuggauggaagauaagacaccuguugagagcugggaagaggugcccuaucucggaaaacgcgaggaccaguggugcggcucucugaucgggcuuaccucccgggccacaugggcuaagaauauucagacggccaucaaccaagucagaagccugaucggaaaugaagaguacaccgacuauaugccuuccaugaaacgguuuagacgcgaagaggaagaggccggcgugcucugguga

SEQ ID NO: 19954 - RNA, 9876 nt, Artificial Sequence
  derived and/or modified CDS sequence (opt5) from DENV-2__EU677146__SS-prME
accgugggagucaucguuaugcugauucccaccgccauggcuuuccaccucacgacccggaauggggagccucauaugaucgugggacggcaggaaaagggcaagagccugcuuuuuaagacagaggacggggugaauaugugcacccugauggccauugaucucggagaacugugugaggacacaaucaccuacaagugcccgcuucugcgccaaaaugaacccgaggauauugacuguuggugcaauuccacaucuaccugggucacguauggcaccuguacaaccacaggggagcaccggcgggaaaagcgcagcguggcgcucguuccucaugugggaaugggccuggagaccagaacggaaacauggauguccucugagggcgcuuggaagcacguccagcggaucgagaccuggauccugcgccaucccggguucacaauuauggccgccauccucgcuuacaccauuggaaccacacacuuucagagagcccugaucuucauucuucugacggcuguggccccuagcaugaccaugcggugcaucggcauuuccaaccgcgauuuuguugaaggggugucuggaggcagcugggucgacaucgugcucgagcacggguccugugugacaaccauggcgaagaauaagcccacacuggauuucgaacuuaucaaaaccgaggccaagcagccugcuacgcugagaaaauauugcauugaagccaagcucacaaacaccaccacagagagccgguguccgacccaaggagagcccucucugaaugaggaacaggacaaacgcuuuaucugcaagcauuccauggucgauagaggcuggggcaacggguguggacuguucggcaaagggggaauuguuacaugcgcuauguuuacgugcaaaaagaauauggaaggcaaaguggugcucccugagaaccuggaauacaccaucgucauuacaccccacagcggggaggagcaugccgugggaaaugacaccggcaagcacggcaaagaaaucaagaucacaccucagucuuccauuaccgaggcggaacuuacgggguauggaaccguuacaauggaguguagcccccggaccggccuggauuucaacgaaauggugcuccugcagauggaggacaaagccuggcuuguccaccgccaaugguuucuggaucucccgcugccuuggcugcccggggcugacacacagggaucuaauuggauccagaaggagacccucgugacguucaagaacccucaugccaaaaagcaggacguugugguccugggcucccaagaaggggcuaugcacacagcccuuaccggcgccacagagauucagaugagcuccggaaaucugcucuuuaccggccaucugaaaugcagacuucggauggauaagcugcagcucaaagggaugucuuacagcauguguaccggaaaguucaagaucgugaaagaaauugcugagacacaacacggcacgaucgucaucagagugcaguaugagggggacggaucccccugcaagauucccuucgaaaucauggaucuggagaaacgccauguucugggccggcucauuaccgugaacccuaucgucacagaaaaggacagcccggugaacauugaggcggaacccccuuuuggggauucuuacaucauuaucggcguugagcccggacagcugaaacuuaauugguucaagaagggcuccagcaucgggcagauguuugagaccacaaugagaggagccaaacgcauggcuauucugggcgacaccgccugggauuucgggucucucggaggcguguuuacgagcaucgggaaggcccugcaccaagucuucggcgcuauuuacggagccgcguuuuccggcgugucuuggacaaugaaaauccugauuggggugaucaucaccuggauuggaaugaacagccgguccaccagccuuucuguuucccucguccuggugggcguggucacacuguaucucggggugaugguucaggcugacagcggauguguggucucuuggaagaauaaagaacugaagugcggcuccgggaucuucauuaccgauaacgugcacacauggacggagcaguacaaguuucagccugaaagccccuccaaacuugccucugccauccaaaaggcucaugaggaaggcauuuguggaaucagaagcguuacccgccuggagaaucucauguggaaacagaucacaccggagcugaaccacauucuguccgaaaaugaggccaaacuuaccaucaugacaggcgacauuaaagggaucaugcaggcuggaaagcggucucucagaccucagcccaccgaacugaaauauagcuggaagacguggggcaaggccaaaaugcuguccaccgagagccauaaccaaacauuccucauugaugggccugaaaccgcggagugccccaauacaaaccgcgccuggaacucucuggagguggaagacuacggauuuggcgucuucuccaccaacaucuggcuuaagcugcgggagaaacaggacguguuuugugauagcaagcucaugucugcugccaucaaagacaauagagcuguucacgccgauaugggcuauuggauugaauccgcgcugaacgacacauggaagauggagaaggccagcuucaucgagauuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacacacacugaccauccucaucagaacagggcugcucgugauuucuggaguuuuccccgugagcaucccgauuacggcugcggccugguaccugugggaggucaagaagcaacgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccauacaauguggcacgugaccagaggggccguccugaugcaucgcggaaagagaaucgagcccagcugggcggaugugaaaaaggaccucauuuccuacggcgggggauggaagcuggagggcgaauggaaagagggcgaagagguucaggugcuugcucuggaaccugggaagaauccgcgggccguccaaacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaccccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcauaccggcagagaaauugucgaccucaugugucacgcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccagagcaacgcuccuaucauggacgaggaaagagagauucccgaacggucuuggaacuccgggcaugagugggucacagauuuuaagggaaagaccgugugguucguuccuagcaucaaagccggcaacgacaucgccgcuugccuuagaaagaaugggaaaaaggugauucaacugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccacucuagcgccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccaaauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucacacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccagccucauuggauugccgcuuccaucauucuggaguuuuuccuuaucgugcugcucauucccgaacccgagaaacaaagaacgccucaggacaaccagcugacauacgucgugaucgccauccugaccguuguggcggccaccauggcuaaugaaaugggguuucucgagaagaccaagaaggaccuuggacugggcagcauuaccacacaggaguccgaaucuaacauccuggauauugaccuccggccggccagcgcuuggacgcuguaugccguggcgaccacauucgucacccccaugcuucgccacuccaucgaaaauucuagcguuaacgugucccugacagccauugcuaaucaagccaccgugcucauggggcugggaagaggcuggccucugagcaaaauggauaucggggucccccuccuugcuauuggauguuacucucaggugaacccuaucacgcugaccgccgcucugcuccugcuuguugcccauuacgcgaucauuggccccggccugcaggccaaggcuacacgggaagcccagaagcgcaccgcugccgggaucaugaaaaauccuacaguggacggaauuaccgucaucgaucucgagccgauucccuaugacccuaaguuugaaaaacaacugggccaggugaugcugcucguccuuugcgugacgcagguucugaugaugagaacaaccugggcccugugugaggcgcucacacuggcuaccgggcccaucuccacccuuugggagggaaacccuggccgguucuggaauacaacgaucgccgugagcauggcuaacauuuuucgcgggucuuaccuggccggagccggccuccuguucuccaucaugaagaauaccacaaacaccagacggggcacagggaauauuggagaaacccugggcgagaaauggaaaagcagacucaacgcucuugggaagucugaauuucagaucuauaaaaagagcggcauucaagaggucgaucgcacgcuggccaaagagggcaucaagagaggggaaacagaccaccaugcgguguccagaggaucugccaaacugcgcugguucguugagcggaacauggugacccccgaaggcaaggucguggaucucggcugcgggagaggaggcuggagcuacuauugugggggacugaaaaaugugcgcgagguuaagggccuuaccaaagggggaccgggccacgaggagccuauccccauguccacauacggcuggaaccugguccggcuccagagcgggguggacguguucuuuacacccccugagaaaugcgauacacugcugugugacauuggagaauccucucccaauccuacgaucgaggcuggcagaacccuccgcguccuuaaccugguugaaaauuggcugaacaauaacacacaguucugcauuaaggugcucaauccguauaugcccagcgugaucgagaaaauggaaacccugcaacggaaguacgggggagcccuugucagaaacccucugucccgcaauucuacacacgagauguacugggugagcaacgcuaccggcaauauuguuuccucugugaacaugaucagccggaugcucaucaauagauuuacgaugaaacauaagaaggccaccuaugagcccgaugucgaccugggguccggaacacgcaacauuggcaucgaaaacgagauuccuaaucuggacaucauuggcaaaagaaucgaaaagauuaaacaggagcacgaaaccagcuggcauuacgaucaggaccaccccuauaagacaugggcguaccacgggucuuaugagaccaaacagacaggauccgccagcucuauggugaacggcguugugaagcuccuuaccaagccgugggaugucgugccuauggugacgcaaauggcuaugacagacaccacccccuucgggcagcagcgggucuuuaaagagaagguugauacacgcacgcaggaaccuaaagagggaaccaagaaacugaugagaaucacagccgaauggcuguggaaggagcucggcaagaaaaagacaccccggauguguacaagagaggaguucacccggaaagugcgcuccaaugcugcccugggggcuaucuuuacagacgagaacaaguggaaaagcgccagagaagcgguggaggauucucgguucugggaacuugucgaccgcgagagaaaucugcaucucgagggaaagugcgaaaccuguguguacaacaugaugggcaaacgggagaagaagcugggcgaauuugggaaagccaagggaucccgcgcuauuugguauauguggcugggcgccagauuccucgaguuugaagcucugggguuccuuaaugaggaucacugguuuagccggggaaacucccugagcggcguugagggggaaggccuccauaaacugggauacauccuucgcgacgugucuaagaaagagggcggggccauguacgccgaugacacggcgggaugggacaccagaauuacacuggaagaucucaagaaugaggaaauggucaccaaccacaugaagggcgagcauaaaaagcuggcugaggccaucuucaaacugacauaucaaaauaaggugguucgggugcagcgcccuacccccagagggacggucauggacauuaucagccggaaagaucagcgcggauccggccagguggggacauacggccucaacaccuucacaaauauggaagcccaacugaucagacagauggagggagaaggcauuuuuaagucuauccagcggcuuaccguuacggaggagauugcugugcaaaacuggcuggccagagucgggcgcgaacggcucagcagaauggcuaucuccggagacgauugcguggucaagccgcuggacgaucgcuucgccucugcgcuuaccgcccugaaugacaugggcaaagugcggaaggauauucagcagugggagccuagcagaggguggaacgacuggacacagguucccuuuugcucccaccacuuccaugaacucgugaugaaagauggacgcguccugguggugcccugucggaaccaagacgagcugaucggcagagcucgcaucucucagggggccggcuggagccucaaggaaaccgcuugccugggaaaauccuaugcccagauguggacacuuauguacuuucaccggagagaucugcgccucgcggccaaugcuauuuguagcgccguuccuucucauugggugccgaccucccggacaaccuggagcauccacgcuaagcacgaguggaugacgacagaggacaugcuggccgucuggaacagaguguggauucaggaaaaucccuggauggaggacaagaccccuguugaaucuugggaggaagugcccuaucuuggcaaacgggaggaucaauggugcgggucccugaucggacucaccagcagagcuacaugggccaagaacauucagaccgcgaucaaucagguccgcucccugauuggcaacgaggaauacacagacuauaugccuucuaugaaacgguucagaaaggaggaagaggaagccggggugcugugguga

SEQ ID NO: 19955 - RNA, 9876 nt, Artificial Sequence
  derived and/or modified CDS sequence (opt5) from DENV-2__EU687214__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauagcacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccauuaaagacaauagagcugugcacgccgauaugggcuauuggaucgaaucugcgcugaacgacaccuggaagauggagaaggccuccuucauugagaucaaaagcugccacuggccuaagucucauacgcuguggagcaaugggguucuugaauccgagaugauuauccccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauucuccuggucgcggugagcuuuguuacccuuaucacaggaaauauguccuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgaaaccauccuggagcucaccgaugcccuggcccugggaaugaugguccuuaaaauugugcggaacauggaaaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaggccguuauggcgguggggauggugagcauccucgccucuucccugcucaaaaaugacauuccuaugacaggaccccuggucgcuggcggccuucugaccgugugcuauguucugaccgggcggagcgccgaucucgaacuggagcgcgcugccgacgugaagugggaggaucaggccgaaaucuccggaagcucuccuauucuuagcaucacaauuuccgaggacggcucuaugagcaucaaaaacgaagaggaggaacacacccugacaauccucauuagaacggggcugcucgucaucuccggaguguuccccguuucuauuccgaucaccgcugcggccugguaccugugggaggugaagaagcaacgggcuggcguccuuugggaugugccuucucccccucccgucgggaaagccgaacuggaggacggagccuaucgcauuaagcagagaggcaucuuuggcuacucccagaucggggcuggaguguauaaagaaggcacauuccauaccauguggcacguuacaagaggggccgugcugaugcaucgcggaaagagaauugagcccuccugggcggaugucaaaaaggaccucaucagcuacggcgggggauggaagcuggagggcgaauggaaagagggcgaagaggugcagguucuugcucuggaaccugggaagaauccgcgggccgugcaaaccaaacccggacucuuuaagacgaacaccggcacaauuggggccgucucccuggauuucagcccuggaaccucuggcucccccaucguggacagaaaagggaaggugguuggacucuacggcaauggcgucgugacacgcagcggggcuuaugugucugccauugcgcagaccgagaaguccaucgaggauaacccugaaaucgaggacgauauuuuccggaaaaagagacugacaaucauggaccuucaccccggagcuggcaaaacgaagcgcuaccugccugccauuguccgggaagccaucaaaagagggcugcgcacccucauucuggcuccgacacgggugguugccgcugagauggaagaggcccuuagaggacugcccauccgcuaucagaccccugcgauucgggccgagcauaccggcagagaaaucguggaccucaugugucacgcuacauuuacgaugcggcugcucagccccguccgcgugccuaacuacaaucugaucauuauggaugaggcccacuucaccgaccccgcuuccaucgccgccagaggguauauuucuacacggguugaaaugggcgaggcugcgggaaucuuuaugaccgccacaccgccuggcagccgcgaucccuucccccaguccaacgcuccuauuauggacgaggaaagagagauccccgaacggagcuggaacucugggcaugagugggugaccaacuuuaagggaaagacggucugguucgugccuuccaucaaagccggcaaugauauugccgcuugccuuagaaagaacgggaaaaagguuauccaacugagccgcaaaacauuugacucugaauacgugaagacccgggccaaugauugggacuucgucgugaccacagauauuagcgagaugggagcgaacuuuagagcugagcgcgugaucgacccgcggagauguaugaagcccgucauucugaccgauggcgaggaacgcguuauccucgccgggccuaugcccgugacacacuccucugccgcucagcggagaggccgcaucggaagaaauccuaaaaacgaaaaugaccaguauauuuacaugggcgagccccuggaaaacgacgaggauugcgcccauuggaaggaggcgaaaaugcuucuggacaauaucaacaccccggaagggauuaucccuagcauguucgagcccgaacgggagaagguggaugccauugacggagaauaccgccucagaggcgaggcucggaaaacguuugucgaucugaugcgcagaggggaccugccuguguggcucgccuaucggguugcugccgagggaaucaauuacgcugauagacgcugguguuucgacggcauuaagaacaaccaaauccuugaagagaauguggaagucgagaucuggacaaaagagggggaacggaagaagcugaaacccagauggcuggaugcccgcauuuauuccgacccucucgcgcugaaggaguucaaagaauuugccgcuggccggaagucucuuacccugaaccucaucacagagaugggaagacugcccaccuucaugacgcagaaagcccgggaugcucuggacaaucucgccgugcuucacaccgccgaaguuggcgggcgcgcuuacaaccacgcgcugagcgagcugccggagacacucgaaacccugcuucugcucacacugcuggccaccgugacaggaggcauuuuucucuuccuuauguccgggaagggaaucggcaagaugacccugggcaugugcugcauuaucacggcuagcauccugcucugguaugcccagauucagccucauuggaucgccgcuucuauuauccuggaguuuuuccuuauuguccugcucauccccgaacccgagaaacaaagaacaccucaggauaaucagcugaccuacguggucaucgccauucugaccgugguugcggccacaauggcuaacgaaaugggguuucucgagaagaccaaaaaggaccuuggacugggcuccaucacaacgcaggagagcgaauccaauauucuggacaucgaucuccggccggccucugcuuggacccuguaugccguggcgacaaccuucgugacacccaugcuucgccacagcauugagaacuccucugucaauguuagccugaccgccaucgcuaaccaagccacggugcucauggggcugggaagaggcuggccucuguccaaaauggacauuggggugccccuccuugcuaucggauguuacagccaggucaauccuaucacccugacagccgcucugcuccugcuuguggcccauuacgcgauuaucggccccggccugcaggccaaggcuacccgggaagcccagaagcgcacagcugccgggauuaugaaaaacccuaccguugauggaaucacggugauugaccucgagccgauccccuaugauccuaaguuugaaaaacaacugggccaggucaugcugcucgugcuuugcgucacacaggugcugaugaugagaaccacaugggcccugugugaggcgcucacccuggcuaccgggcccaucucuacacuuugggagggaaauccuggccgguucuggaacacgaccauugccguuuccauggcuaauaucuuucgcgggagcuaccuggccggagccggccuccuguucucuauuaugaagaacacaaccaauacaagacggggcaccgggaacaucggagaaacgcugggcgagaaauggaaguccagacucaacgcucuuggaaagagcgaauuucagauuuauaaaaagucuggaauccaagagguggaccgcacacuggccaaagagggcaucaagagaggggaaaccgaucaccaugcggucagcagaggauccgccaaacugcgcugguucguggagcggaauaugguuacccccgaaggcaagguggucgaccucggcugcgggagaggaggcuggucuuacuauugugggggacugaaaaacgugcgcgaggugaagggccuuacaaaagggggaccgggccacgaggaaccuauucccaugagcaccuacggcuggaaucugguucggcuccaguccggggucgauguguucuuuacacccccugagaaaugcgacacgcugcugugugauaucggagaaagcucccccaacccuaccauugaggcuggcagaacacuccgcgugcuuaaucuggucgaaaacuggcugaauaacaauacccaguucugcguuaaggugcucaacccguauaugcccucugugaucgagaaaauggaaacacugcaacggaaguacgggggagcccuugucagaaauccucugagccgcaacuccacccacgagauguacugggugucuaaugcuacgggcaacauuguuagcuccgugaauaugaucucucggaugcucaucaacagauuuaccaugaaacauaagaaggccacauaugagcccgacgucgaucuggggagcggaacccgcaacauuggcaucgaaaaugagauuccuaaccuggacaucauuggcaaaagaaucgaaaagauuaaacaggagcacgaaacauccuggcauuacgaccaggaucaccccuauaagaccugggcguaccacgggagcuaugagacaaaacagaccggaucugccuccagcauggugaauggcguugugaagcuccuuacgaagccgugggacgucgugccuauggugacacaaauggcuaugaccgauaccacacccuucgggcagcagcgggucuuuaaagagaagguugacacgcgcacccaggaaccuaaagagggaacaaagaaacugaugagaaucaccgccgaauggcuguggaaggagcucggcaagaaaaagacaccccggauguguaccagagaggaguucacacggaaagugcgcucuaacgcugcccugggggcuaucuuuaccgaugagaauaaguggaaauccgccagagaagcgguggaggacagccgguucugggaacuugucgaucgcgagagaaaccugcaucucgagggaaagugcgaaacguguguguacaauaugaugggcaaacgggagaagaagcugggcgaauuugggaaagccaagggaucucgcgcuauuugguauauguggcugggcgccagauuccucgaguuugaagcucugggguuccuuaacgaggaccacugguuuucccggggaaauagccuguccggcguugagggggaaggccuccauaaacugggauacauccuucgcgaugugagcaagaaagagggcggggccauguacgccgacgauaccgcgggaugggacacaagaauuacccuggaagaccucaagaacgaggaaauggucacaaaucacaugaagggcgagcauaaaaagcuggcugaggccaucuucaaacugaccuaucaaaacaaggugguucgggugcagcgcccuacgcccagagggacagucauggauauuaucucucggaaagaccagcgcggaagcggccagguggggaccuacggccucaauacauucaccaacauggaagcccaacugaucagacagauggagggagaaggcauuuuuaaguccauccagcggcuuacgguuaccgaggagauugcugugcaaaauuggcuggccagagucgggcgcgaacggcucucuagaauggcuaucagcggagaugacugcguggucaagccgcuggaugaccgcuucgccuccgcgcuuauugcccugaacgauaugggcaaagugcggaaggacauccagcagugggagccuucuagaggguggaacgauuggacacagguucccuuuugcagccaccacuuccaugaacucgugaugaaagacggacgcguccugguggugcccugucggaaucaagaugagcugaucggcagagcucgcauuucccagggggccggcuggucucucaaggaaaccgcuugccugggaaaaagcuaugcccagauguggacacuuauguacuuucaccggagagaccugcgccucgcggccaacgcuaucuguuccgccguuccuagccauugggugccgaccucucggacaaccugguccauucacgcuaagcacgaguggaugacgacagaggauaugcuggccgucuggaauagaguguggauccaggaaaaccccuggauggaggacaagaccccuguugaaagcugggaggaagugcccuaucuuggcaaacgggaggaccaauggugcgggucucugauuggacucaccuccagagcuacaugggccaagaauauccagaccgcgauuaaccagguccgcagccugaucggcaaugaggaauacacagauuauaugccuuccaugaaacgguucagaaaggaggaagaggaagccggggugcugugguga

SEQ ID NO: 19956 - RNA, 9876 nt, Artificial Sequence
  derived and/or modified CDS sequence (opt5) from DENV-2__EU687215__SS-prME
accgccggcgugaucauuaugcugauccccaccgcuauggccuuccaccucacgacccggaacggggagccucauaugauugucggacggcaggaaaagggcaaaagccugcuuuuuaagaccgaggacgggguuaauaugugcacccugauggcgaucgaucucggagaacugugugaggacacgauuaccuacaaaugcccgcuucugcgccaaaacgaacccgaggauaucgacuguuggugcaauagcacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccauuaaagacaauagagcugugcacgccgauaugggcuauuggaucgaaucugcgcugaacgacaccuggaagauggagaaggccuccuucauugagaucaaaagcugccacuggccuaagucucauacgcuguggagcaaugggguucuugaauccgagaugauuauccccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauucuccuggucgcggugagcuuuguuacccuuaucacaggaaauauguccuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgaaaccauccuggagcucaccgaugcccuggcccugggaaugaugguccuuaaaauugugcggaacauggaaaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaggccguuauggcgguggggauggugagcauccucgccucuucccugcucaaaaaugacauuccuaugacaggaccccuggucgcuggcggccuucugaccgugugcuauguucugaccgggcggagcgccgaucucgaacuggagcgcgcugccgacgugaagugggaggaucaggccgaaaucuccggaagcucuccuauucuuagcaucacaauuuccgaggacggcucuaugagcaucaaaaacgaagaggaggaacacacccugacaauccucauuagaacggggcugcucgucaucuccggaguguuccccguuucuauuccgaucaccgcugcggccugguaccugugggaggugaagaagcaacgggcuggcguccuuugggaugugccuucucccccucccgucgggaaagccgaacuggaggacggagccuaucgcauuaagcagagaggcaucuuuggcuacucccagaucggggcuggaguguauaaagaaggcacauuccauaccauguggcacguuacaagaggggccgugcugaugcaucgcggaaagagaauugagcccuccugggcggaugucaaaaaggaccucaucagcuacggcgggggauggaagcuggagggcgaauggaaagagggcgaagaggugcagguucuugcucuggaaccugggaagaauccgcgggccgugcaaaccaaacccggacucuuuaagacgaaaaccggcacaauuggggccgucucccuggauuucagcccuggaaccucuggcucccccaucguggacagaaaggggaaggugguuggacucuacggcaacggcgucgugacacgcagcggggcuuaugugucugccauugcgcagaccgagaaauccaucgaggauaauccugaaaucgaggacgauauuuuccggaagaaaagacugacaaucauggaccuucaccccggagcuggcaagacgaaacgcuaccugccugccauuguccgggaagccaucaagagagggcugcgcacccucauucuggcuccgacacgggugguugccgcugagauggaagaggcccuuagaggacugcccauccgcuaucagaccccugcgauucgggccgagcauaccggcagagaaaucguggaccucaugugucacgcuacauuuacgaugcggcugcucagccccguccgcgugccuaacuacaaccugaucauuauggaugaggcccacuucaccgaccccgcuuccaucgccgccagaggguauauuucuacacggguugaaaugggcgaggcugcgggaaucuuuaugaccgccacaccgccuggcagccgcgaucccuucccccaguccaaugcuccuauuauggacgaggaaagagagauccccgaacggagcuggaacucugggcaugagugggugaccgauuuuaagggaaaaacggucugguucgugccuuccaucaaggccggcaaugacauugccgcuugccuucgcaagaacgggaagaaaguuauccaacugagccgcaagacauuugauucugaauacgugaagacccgggccaaugacugggauuucgucgugaccacagacauuagcgagaugggagcgaacuuuagagcugagcgcgugaucgauccgcggagauguaugaaacccgucauucugaccgacggcgaagaaagaguuauccucgccgggccuaugcccgugacacacuccucugccgcucagcggagaggccgcaucggaagaaauccuaagaacgaaaaugaccaguauauuuacaugggcgagccccuggaaaacgaugaggacugcgcccauuggaaagaggcgaagaugcuucuggauaauaucaacaccccggaagggauuaucccuagcauguucgagcccgaacgggagaaaguggacgccauugauggagaauaccgccucagaggcgaggcucggaagacguuugucgaccugaugcgcagaggggaucugccuguguggcucgccuaucggguugcugccgagggaaucaauuacgcugacagacgcugguguuucgauggcauuaaaaacaaucaaauccuugaagagaacguggaagucgagaucuggacaaaggagggggaacggaagaaacugaagcccagauggcuggacgcccgcauuuauuccgauccucucgcgcugaaagaguucaaggaauuugccgcuggccggaaaucucuuacccugaaccucaucacagagaugggaagacugcccaccuucaugacgcagaaggcccgggacgcucuggauaaucucgccgugcuucacaccgccgaaguuggcgggcgcgcuuacaaccacgcgcugagcgagcugccggagacacucgaaacccugcuucugcucacacugcuggccaccgugacaggaggcauuuuucucuuccuuauguccgggaagggaaucggcaaaaugacccugggcaugugcugcauuaucacggcuagcauccugcucugguaugcccagauucagccucauuggaucgccgcuucuauuauccuggaguuuuuccuuauuguccugcucauccccgaacccgagaagcaaagaacaccucaggacaaucagcugaccuacguggucaucgccauucugaccgugguugcggccacaauggcuaacgaaaugggguuucucgagaaaaccaagaaagaccuuggacugggcuccaucacaacgcaggagagcgaauccaauauucuggauaucgaccuccggccggccucugcuuggacccuguaugccguggcgacagccuucgugacccccaugcuucgccacagcauugagaacuccucugucaauguuagccugacagcuaucgccaaccaagcuaccgugcucauggggcugggaagaggcuggccucuguccaagauggauauuggggugccccuccuugccaucggauguuacagccaggucaauccuaucacgcugaccgcugcccugcuccugcuuguggcgcauuacgccauuaucggccccggccugcaggcuaaggccacacgggaagcucagaaacgcaccgccgccgggauuaugaagaacccuacaguugacggaaucaccgugauugaucucgagccgauccccuaugacccuaaauuugaaaagcaacugggccaggucaugcugcucgugcuuugcgucacacaggugcugaugaugagaacaaccugggcgcugugugaggcucucacacuggccaccgggcccaucucuacccuuugggagggaaauccuggccgguucuggaacacaacgauugcuguuuccauggccaauaucuuucgcgggagcuaccuggccggagcuggccuccuguucucuauuaugaaaaacaccacaaauaccagacggggcacagggaacaucggagaaacccugggcgagaaguggaaguccagacucaaugcccuugggaaaagcgaauuucagauuuauaagaaaucuggaauccaagagguggaucgcacgcuggcgaaggagggcaucaaaagaggggaaacagaccaccaugccgucagcagaggauccgcuaagcugcgcugguucguggagcggaacaugguuacccccgaaggcaaaguggucgaucucggcugcgggagaggaggcuggucuuacuauugugggggacugaagaacgugcgcgaggugaagggccuuaccaaagggggaccgggccacgaggaaccuauucccaugagcacauacggcuggaaucugguucggcuccaguccggggucgacguguucuuuacacccccugagaagugcgauacacugcugugugacaucggagaaagcucccccaacccuacgauugaggccggcagaacccuccgcgugcuuaaucuggucgaaaacuggcugaauaacaauacacaguucugcguuaaagugcucaacccguauaugcccucugugaucgagaagauggaaacccugcaacggaaauacgggggagcucuugucagaaauccucugagccgcaacuccacacacgagauguacugggugucuaaugccaccggcaacauuguuagcuccgugaauaugaucucucggaugcucaucaacagauuuacgaugaagcauaagaaagcgaccuaugagcccgaugucgaccuggggagcggaacacgcaauauuggcaucgaaaacgagauuccuaaccuggacaucauuggcaagagaaucgagaaaauuaagcaggagcacgaaaccuccuggcauuacgaucaggaccaccccuauaaaacaugggccuaccacgggagcuaugagaccaagcagacaggaucugcuuccagcauggugaauggcguugugaagcuccuuaccaaaccgugggaugucgugccuauggugacgcaaauggccaugacagacaccacccccuucgggcagcagcgggucuuuaaggagaaaguugauacacgcacgcaggaaccuaaggagggaaccaaaaagcugaugagaaucacagcugaauggcuguggaaggagcucggcaaaaagaaaacaccccggauguguacaagagaggaguucacccggaaggugcgcucuaacgccgcucugggggccaucuuuacagacgagaauaaauggaaguccgcgagagaagccguggaggauagccgguucugggaacuugucgaccgcgagagaaaccugcaucucgagggaaaaugcgaaaccuguguguacaauaugaugggcaagcgggagaagaaacugggcgaauuugggaaggcuaaaggaucucgcgccauuugguauauguggcugggcgcuagauuccucgaguuugaagcccugggguuccuuaacgaggaucacugguuuucccggggaaauagccuguccggcguugagggggaaggccuccauaagcugggauacauccuucgcgacgugagcaaaaaggagggcggggccauguacgcggaugacacggcuggaugggacaccagaauuacacuggaagaucucaagaacgaggaaauggucaccaaucacaugaaaggcgagcauaagaaacuggccgaggccaucuucaagcugacauaucaaaacaaagugguucgggugcagcgcccuacccccagagggacggucauggacauuaucucucggaaggaucagcgcggaagcggccagguggggacauacggccucaauaccuucacaaacauggaagcucaacugaucagacagauggagggagaaggcauuuuuaaguccauccagcggcuuaccguuacggaggagauugccgugcaaaauuggcuggcuagagucgggcgcgaacggcucucuagaauggccaucagcggagacgauugcguggucaaaccgcuggacgaucgcuucgcguccgcccuuaccgcucugaacgacaugggcaaggugcggaaagauauucagcagugggagccuucuagaggguggaaugacuggacacagguucccuuuugcagccaccacuuccaugaacucgugaugaaggauggacgcguccugguggugcccugucggaaccaagacgagcugaucggcagagcccgcaucucccagggggcuggcuggucucucaaagaaaccgccugccugggaaagagcuaugcgcagauguggacacuuauguacuuucaccggagagaucugcgccucgccgcuaacgccauuuguuccgcuguuccuagccauugggugccgaccucucggacaaccugguccauccacgccaagcacgaguggaugacgacagaggacaugcuggcugucuggaauagaguguggauucaggaaaaccccuggauggaggacaaaaccccuguugaaagcugggaggaagugcccuaucuuggcaagcgggaggaucaauggugcgggucucugaucggacucaccuccagagccacaugggcgaaaaauauucagaccgccaucaaccagguccgcagccugauuggcaaugaggaauacacagacuauaugccuuccaugaagcgguucagaaaagaggaagaggaagcuggggugcugugguga

SEQ ID NO: 19957 - RNA, 9876 nt, Artificial Sequence
  derived and/or modified CDS sequence (opt5) from DENV-2__EU687216__SS-prME
accgccggagugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaagacacaaucaccuacaagugcccgcuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuuaauuucugugagggcaccacggucguggugacagaagacugcgggaaccggggacccucucugagaaccacaaccgccuccggcaaacugauuacagaguggugcugucggagcugcacccucccuccgcugcgcuacagaggcgaggauggguguugguacggaauggaaauccggccccuuaaggagaaggaagagaaucuggucaacucccucguuacggccggccaugggcagauugacaauuuuucucugggagugcugggcauggcucuuuuccucgaagagaugcugagaacccgcguggggacaaaacacgcgauccugcucgucgcccugagcuuugugacccuuaucacaggaaacauguccuuccgggaucugggcagaguuauggugauggucggcgcuaccaugacggacgauauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggacgcccuggcucuuggaaugauggugcugaaaauuguccggaauauggaaaaguaccaacucgccgugaccaucauggcgaucucuugcguuccuaacgcugugauucugcagaaugccuggaaggucagcuguacaauccucgccgcuguguccgugagcccccugcuucugaccucuucccagcagaaagccgauuggauuccucucgcucugacaaucaagggccugaaccccaccgccauuuuucuuacgacacugagccgcaccucuaaaaagagauccuggccgcucaaugaggcgaucauggccgucgggaugguuagcauccuggcuucuucccuccugaaaaacgacauuccuaugaccggaccccuuguggccggcggccugcugacagugugcuauguccucaccgggcggagcgcugaccuggaacuugagcgcgccgccgaugugaagugggaggaccaagcugaaaucuccggaagcucuccuauucugagcaucacaauuuccgaggauggcucuaugagcaucaaaaaugaagaggaggaacagacgcucaccauucugaucagaacagggcuccugguuaucuccggaguguuccccgucucuauuccgaucaccgcggccgcuugguaccuuugggaggugaagaagcagcgggccggcguucugugggacgugccuucucccccucccgucgggaaagccgaacuggaggauggagcuuaucgcauuaagcagagaggcauccucggcuacucccaaauuggggccggaguguauaaagaaggcacauuucacaccauguggcaugucacgagaggggcggugcugaugcaccgcggaaagagaaucgagcccuccugggcugacguuaaaaaggaucuuaucagcuacggcgggggauggaagcuggagggcgaauggaaagagggcgaagaggugcagguccucgcccuggaaccugggaagaacccgcgggccgugcagaccaaacccggaauuuucaagacaaauaccggcacaaucggggcuguuucccucgacuuuagcccuggaaccucuggcucccccauuguggauagaaaagggaaggucgugggacuguacggcaacggcgugguuacacgcagcggggccuaugucucugcgaucgcucagacggagaaguccauugaggacaacccugaaaucgaggaugacaucuuccggaaaaagagacuuaccauuauggaucugcaucccggagccggcaaaacaaagcgcuaccugccugccaucgugcgggaagcuauuaaaagagggcuccgcacccugauccuugccccgacccggguggucgcugccgagauggaagaggcgcugagaggacuccccauucgcuaucaaaccccugccauccgggcugagcacacgggcagagaaauuguggaccugaugugucaugccaccuucacaaugcggcuccugagccccguucgcgugccuaauuacaaccuuaucaucauggacgaggcucacuuuaccgaucccgccuccauugccgcuagaggguauaucucuacacgggucgaaaugggcgaggcggccggaauuuucaugaccgcuacgccgccuggcagccgcgaccccuuuccccaguccaaugccccuaucauggaugaggaaagagagauucccgaacggagcuggaacucugggcacgagugggugacagacuucaagggaaagaccguuugguuugugccuuccaucaaagccggcaaugauaucgcugccugccugagaaagaacgggaaaaaggucauucagcugagccgcaaaaccuucgacucugaauacgugaagacacgggcgaaugauugggacuuuguugugaccacagauaucagcgagaugggagcuaacuucaaggccgagagagucauugacccgcgccgguguaugaaacccgugauccucaccgauggcgaagagagagugauucuggccgggccuaugcccgucacgcauuccucugcugcccaacgccggggcagaaucggacgcaauccuaagaacgaaaaugaccaguauaucuacaugggcgagccccuugaaaacgacgaggauugcgcgcacuggaaagaggccaagaugcugcucgacaauauuaacacaccggaagggaucauuccuagcauguuugagcccgaaagagagaaaguugaugcuaucgacggagaauaccggcugcgcggcgaggccagaaagaccuucguggagcugaugcggcgcggggaucucccuguguggcuugcuuauaaagucgccgcugaaggaauuaauuacgccgacagaaagugguguuuugauggcaucaagaacaaccagauucuggaggaaaauguggagguugagaucuggacaaaagaaggggagcggaagaaacugaagcccagauggcucgacgcgcgcaucuauuccgauccucuggcccuuaaagaguucaaggaguucgcugccggccggaagucucugacccucaaccugauuacggaaaugggaagacugcccaccuuuaugacacagaaagcucgcaaugcccucgacaaccuugccgugcugcauaccgcugaggucggcgggcgggcguacaaucacgcccugagcgagcucccggaaacacuggagacccuucugcuccugacacugcucgcuaccgugacgggaggcaucuuccuuuuucugauguccgggaagggaguuggcaaaaugacacugggcaugugcugcauuaucaccgccagcauucuccugugguaugcccaaauccagccucacuggaucgcugccucuauuauccuugaguucuuucugauugugcuccugauccccgagcccgaaaagcagagaaccccucaggauaaccaacugacauacgucgugauugcgauccucaccgucguggccgcuacaauggccaaugagaugggguuccuugagaaaacgaagaaggaccugggauuuggcuccaucaccacacaggaaagcgaguccaacauucuggauaucgaccuccggccggcuucugccuggacccuguaugcgguugccacaaccuucauuacgcccaugcuucgccauagcaucgaaaauuccucugugaacgugagccugaccgcuauugccaaucaggcuacaguccucauggggcugggaaaaggcuggccucuguccaagauggacaucgggguuccccuccuugccauuggauguuacagccaggugaacccuaucacccugacagcugcccugcuccugcuuguggcgcacuacgccaucauuggccccggccugcaagcuaaagccaccagagaggcucagaagcgggccgccgcggggaucaugaaaaauccuacggucgauggaauuacagugaucgaccucgaaccgauucccuaugauccuaaguuugagaagcagcugggccagguuaugcugcucauccuuugcgugacccaaguccugaugaugcgcacaaccugggcucugugugaggcccucacccuggcuacagggcccaucucuacgcuuugggaaggaaacccuggcagauucuggaauaccacaauugccguguccauggccaacaucuuucgggggagcuaccuggcuggagccggccuccuguucucuauuaugaaaaauaccacaaacacccgcagaggcacggggaacgucggagagacacugggcgaaaaguggaaaucccggcucaaugcgcuuggaaagagcgaguuucagaucuauaaaaagucuggcauucaggagguggaccgcacccuggccaaagaaggcaucaagagaggggagaccgaucaucacgcuguuagccggggauccgccaagcugagaugguucguggaacgcaacauggucacacccgagggcaaagugguugaccucggcugcgggcggggaggcuggucuuacuauugugggggacugaagaaugugagagaagucaaaggccuuaccaaagggggaccgggccaugaggagccuauccccaugagcacauacggcuggaaccuggugcgccuccaauccgggguggauguuuucuuuacgcccccugaaaaaugcgacacccugcugugugauauuggagagagcucccccaauccuacaaucgaagcuggccggacccucagaguccuuaaccugguggagaauuggcugaacaauaacacacaguucugcauuaaggugcucaauccguauaugcccucugucaucgaaaagauggagacccugcagcgcaaauacgggggagcccuuguucggaacccucugagcagaaauuccacgcacgagauguacugggugucuaacgcgaccggcaauauugugagcuccgucaacaugaucucucgcaugcucaucaaccgguuuacaaugaagcacaaaaaggccaccuaugaacccgacguggaucuggggagcggaacaagaaauauuggcaucgaguccgaaauuccuaaccuggacaucauuggcaaacgcaucgagaagauuaagcaggaacaugagaccagcuggcacuacgaucaagaccaucccuauaaaacaugggcuuaccacgggucuuaugagaccaagcagacgggauccgccagcucuaugguuaauggcgugguccggcuccuuacaaaaccgugggacgugguuccuauggugacccagauggcuaugaccgauacaacgcccuucgggcagcaaagagucuuuaaggaaaaaguggacacccgcacacaggagccuaaggaaggaaccaagaaacugaugaagaucacagccgaguggcuguggaaagagcucggcaaggagaagacacccagaauguguacacgggaggaguucacccgcaaggugagauccaacgcugcccugggggcgaucuuuacggaugagaauaaauggaaaagcgcccgggaagcugucgaggacggaagauucugggagcuuguugaucgggaacgcaaccugcaccucgagggcaagugcgaaaccuguguguacaauaugaugggcaaaagagagaagaaacugggggaauuuggaaaggccaaaggcucucgggcuauuugguauauguggcugggggcccgcuuccucgaguuugaggcccugggauuccuuaacgaagaccauugguuuuccagaggcaauagccuguccgggguggagggcgaaggacuccaccggcugggcuacauccuucgcgaggucgggaagaaggaaggaggcgcgauguacgcugaugacacagccgggugggauaccagaauuacacuggaggaccucaaaaacgaggaaauggugaccaaucauaugaagggagagcacaaaaagcuggccgaagcuaucuucaaacugacguaucagaacaagguugugcggguccagcgcccuacacccagaggcaccgugauggauauuaucagccggaaggaccaacgcgggucuggccagguuggaacauacggccucaauaccuucacgaacauggaggcccagcugaucagacaaauggagggggaaggaauuuuuaaaagcauccagcaucuuaccgcuacagaggaaauugccgugcagaauuggcuggcgcgggucggccgcgagagacucucccggauggccaucucuggggacgauugcgugguuaagccgauugacgauagauucgcuagcgcccugaccgcucuuaacgacaugggaaaagugcgcaaggauauccagcaaugggaaccuucccggggcuggaacgacuggacacagguccccuuuugcucucaccacuuccaugagcuggugaugaaagaugggagaguccucgugguucccugucgcaaucaggacgagcugaucggccgggccagaauuagccagggagcgggcuggucccugaaggaaaccgccugccucgggaagucuuaugcucaaauguggacacugauguacuuucaccgccgggaucuuagacuggccgcuaacgccaucuguagcgcugugccuucccauugggucccgaccagccgcacgacauggucuauucacgccaaacacgaguggaugaccaccgaagacaugcucgcgguguggaaucggguguggauccaggagaaccccuggauggaagauaagacaccuguugaguccugggaggaagugcccuaucugggaaaaagagaggaccaguggugcggcagccuuauugggcugaccucucgcgccacaugggcuaagaauauccagacggccauuaaccaaguccggucccucaucggaaaugaagaguacaccgauuauaugccuagcaugaaaagauuccggagagaagaggaggaagccggcgugcugugguga

SEQ ID NO: 19958 - RNA, 9876 nt, Artificial Sequence
  derived and/or modified CDS sequence (opt5) from DENV-2__EU726770__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccauuaaagacaauagagcugugcacgccgauaugggcuauuggaucgaaucugcgcugaacgacaccuggaagauggagaaggccuccuucauugagaucaaaagcugccacuggccuaagucucauacgcuguggagcaaugggguucuugaauccgagaugauuauccccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauucuccuggucgcggugagcuuuguuacccuuaucacaggaaauauguccuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgaaaccauccuggagcucaccgaugcccuggcccugggaaugaugguccuuaaaauugugcggaacauggaaaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaggccguuauggcgguggggauggugagcauccucgccucuucccugcucaaaaaugacauuccuaugacaggaccccuggucgcuggcggccuucugaccgugugcuauguucugaccgggcggagcgccgaucucgaacuggagcgcgcugccgacgugaagugggaggaucaggccgaaaucuccggaagcucuccuauucuuagcaucacaauuuccgaggacggcucuaugagcaucaaaaacgaagaggaggaacacacccugacaauccucauuagaacggggcugcucgucaucuccggaguguuccccguuucuauuccgaucaccgcugcggccugguaccugugggaggugaagaagcaacgggcuggcguccuuugggaugugccuucucccccucccgucgggaaagccgaacuggaggacggagccuaucgcauuaagcagagaggcaucuuuggcuacucccagaucggggcuggaguguauaaagaaggcacauuccauaccauguggcacguuacaagaggggccgugcugaugcaucgcggaaagagaauugagcccuccugggcggaugucaaaaaggaccucaucagcuacggcgggggauggaagcuggagggcgaauggaaagagggcgaagaggugcagguucuugcucuggaaccugggaagaauccgcgggccgugcaaaccaaacccggacucuuuaagacgaacaccggcacaauuggggccgucucccuggauuucagcccuggaaccucuggcucccccaucguggacagaaaagggaaggugguuggacucuacggcaauggcgucgugacacgcagcggggcuuaugugucugccauugcgcagaccgagaaguccaucgaggauaacccugaaaucgaggacgauauuuuccggaaaaagagacugacaaucauggaccuucaccccggagcuggcaaaacgaagcgcuaccugccugccauuguccgggaagccaucaaaagagggcugcgcacccucauucuggcuccgacacgggugguugccgcugagauggaagaggcccuuagaggacugcccauccgcuaucagaccccugcgauucgggccgagcauaccggcagagaaaucguggaccucaugugucacgcuacauuuacgaugcggcugcucagccccguccgcgugccuaacuacaaucugaucauuauggaugaggcccacuucaccgaccccgcuuccaucgccgccagaggguauauuucuacacggguugaaaugggcgaggcugcgggaaucuuuaugaccgccacaccgccuggcagccgcgaucccuucccccaguccaacgcuccuauuauggacgaggaaagagagauccccgaacggagcuggaacucugggcaugagugggugaccgauuuuaagggaaagacggucugguucgugccuuccaucaaagccggcaacgacauugccgcuugccuuagaaagaaugggaaaaagguuauccaacugagccgcaaaacauuugauucugaauacgugaagacccgggccaacgacugggauuucgucgugaccacagacauuagcgagaugggagcgaauuuuagagcugagcgcgugaucgauccgcggagauguaugaagcccgucauucugaccgacggcgaggaacgcguuauccucgccgggccuaugcccgugacacacuccucugccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauaccccggaagggauuaucccuagcauguucgagcccgaacgggagaagguggacgccauugauggagaauaccgccucagaggcgaggcucggaaaacguuugucgaccugaugcgcagaggggaucugccuguguggcucgccuaucggguugcugccgagggaaucaacuacgcugacagacgcugguguuucgauggcauuaagaauaaccaaauccuugaagagaacguggaagucgagaucuggacaaaagagggggaacggaagaagcugaaacccagauggcuggacgcccgcauuuauuccgauccucucgcgcugaaggaguucaaagaauuugccgcuggccggaagucucuuacccugaaucucaucacagagaugggaagacugcccaccuucaugacgcagaaagcccgggacgcucuggauaaccucgccgugcuucacaccgccgaaguuggcgggcgcgcuuacaaucacgcgcugagcgagcugccggagacacucgaaacccugcuucugcucacacugcuggccaccgugacaggaggcauuuuucucuuccuuauguccgggaagggaaucggcaagaugacccugggcaugugcugcauuaucacggcuagcauccugcucugguaugcccagauucagccucauuggaucgccgcuucuauuauccuggaguuuuuccuuauuguccugcucauccccgaacccgagaaacaaagaacaccucaggacaaccagcugaccuacguggucaucgccauucugaccgugguugcggccacaauggcuaaugaaaugggguuucucgagaagaccaaaaaggaccuuggacugggcuccaucacaacgcaggagagcgaauccaacauucuggauaucgaccuccggccggccucugcuuggacccuguaugccguggcgacaaccuucgugacacccaugcuucgccacagcauugaaaauagcucugucaacguuagccugaccgccaucgcuaaucaagccacggugcucauggggcugggaagaggcuggccucuguccaaaauggauauuggggugccccuccuugcuaucggauguuacagccaggucaacccuaucacccugacagccgcucugcuccugcuuguggcccauuacgcgauuaucggccccggccugcaggccaaggcuacccgggaagcccagaagcgcacagcugccgggauuaugaaaaauccuaccguugacggaaucacggugauugaucucgagccgauccccuaugacccuaaguuugaaaaacaacugggccaggucaugcugcucgugcuuugcgucacacaggugcugaugaugagaaccacaugggcccugugugaggcgcucacccuggcuaccgggcccaucucuacacuuugggagggaaacccuggccgguucuggaauacgaccauugccguuuccauggcuaacaucuuucgcgggagcuaccuggccggagccggccuccuguucucuauuaugaagaauacaaccaacacaagacggggcaccgggaauaucggagaaacgcugggcgagaaauggaaguccagacucaacgcucuuggaaagagcgaauuucagauuuauaaaaagucuggaauccaagagguggaucgcacacuggccaaagagggcaucaagagaggggaaaccgaccaccaugcggucagcagaggauccgccaaacugcgcugguucguggagcggaacaugguuacccccgaaggcaagguggucgaucucggcugcgggagaggaggcuggucuuacuauugugggggacugaaaaaugugcgcgaggugaagggccuuacaaaagggggaccgggccacgaggagccuauucccaugagcaccuacggcuggaaccugguucggcuccaguccggggucgacguguucuuuacacccccugagaaaugcgauacgcugcugugugacaucggagaaagcucccccaauccuaccauugaggcuggcagaacacuccgcgugcuuaaccuggucgaaaauuggcugaacaauaacacccaguucugcguuaaggugcucaauccguauaugcccucugugaucgagaaaauggaaacacugcaacggaaguacgggggagcccuugucagaaacccucugagccgcaauuccacccacgagauguacugggugucuaacgcuacgggcaauauuguuagcuccgugaacaugaucucucggaugcucaucaauagauuuaccaugaaacauaagaaggccacauaugagcccgaugucgaccuggggagcggaacccgcaacauuggcaucgaaaacgagauuccuaaucuggacaucauuggcaaaagaaucgaaaagauuaaacaggagcacgaaacauccuggcauuacgaucaggaccaccccuauaagaccugggcguaccacgggagcuaugagacaaaacagaccggaucugccuccagcauggugaacggcguugugaagcuccuuacgaagccgugggaugucgugccuauggugacacaaauggcuaugaccgacaccacacccuucgggcagcagcgggucuuuaaagagaagguugauacgcgcacccaggaaccuaaagagggaacaaagaaacugaugagaaucaccgccgaauggcuguggaaggagcucggcaagaaaaagacaccccggauguguaccagagaggaguucacacggaaagugcgcucuaaugcugcccugggggcuaucuuuaccgacgagaacaaguggaaauccgccagagaagcgguggaggauagccgguucugggaacuugucgaccgcgagagaaaucugcaucucgagggaaagugcgaaacguguguguacaacaugaugggcaaacgggagaagaagcugggcgaauuugggaaagccaagggaucucgcgcuauuugguauauguggcugggcgccagauuccucgaguuugaagcucugggguuccuuaaugaggaucacugguuuucccggggaaacagccuguccggcguugagggggaaggccuccauaaacugggauacauccuucgcgacgugagcaagaaagagggcgggaccauguacgccgaugacacagccggaugggacaccagaauuacacuggaagaucucaagaaugaggaaauggucaccaaccacaugaagggcgagcauaaaaagcuggcggaggcuaucuucaaacugacguaucaaaauaaggugguucgggugcagcgcccuacacccagagggaccgucauggacauuaucucucggaaagaucagcgcggaagcggccagguggggacauacggccucaacaccuucacgaauauggaagcccaacugaucagacagauggagggagaaggcauuuuuaaguccauccagcggcuuaccguuacagaggagauugccgugcaaaacuggcuggcuagagucgggcgcgaacggcucucuagaauggccaucagcggagacgauugcguggucaagccgcuggacgaucgcuucgcuuccgcccuuaccgcgcugaaugacaugggcaaagugcggaaggauauucagcagugggagccuucuagaggguggaacgacuggacacagguucccuuuugcagccaccacuuccaugaacucgugaugaaagauggacgcguccugguggugcccugucggaaccaagacgagcugaucggcagagcccgcaucucccagggggcuggcuggucucucaaggaaaccgccugccugggaaaaagcuaugcucagauguggacacuuauguacuuucaccggagagaucugcgccucgccgcgaaugccauuuguuccgcuguuccuagccauugggugccgaccucucggacgacaugguccauccacgccaagcacgaguggaugaccaccgaggacaugcuggcugucuggaacagaguguggauucaggaaaaucccuggauggaggacaagacaccuguugaaagcugggaggaagugcccuaucuuggcaaacgggaggaucaauggugcgggucucugaucggacucaccuccagagccacaugggcuaagaacauucagacggccaucaaucagguccgcagccugauuggcaacgaggaauacaccgacuauaugccuuccaugaaacgguucagaaaggaggaagaggaagcgggggugcugugguga

SEQ ID NO: 19959 - RNA, 9876 nt, Artificial Sequence
  derived and/or modified CDS sequence (opt5) from DENV-2__EU781135__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccauuaaagacaauagagcugugcacgccgauaugggcuauuggaucgaaucugcgcugaacgacaccuggaagauggagaaggccuccuucauugagaucaaaagcugccacuggccuaagucucauacgcuguggagcaaugggguucuugaauccgagaugauuauccccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauucuccuggucgcggugagcuuuguuacccuuaucacaggaaauauguccuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgaaaccauccuggagcucaccgaugcccuggcccugggaaugaugguccuuaaaauugugcggaacauggaaaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaggccaucauggcgguugggauggugagcauucucgccucuucccugcucaaaaaugacaucccuaugacaggaccccugguggcuggcggccuucugaccgucugcuaugugcugaccgggcggagcgccgaucucgaacuggagcgcgcugccgacguuaagugggaggaucaggccgaaauuuccggaagcucuccuauccuuagcauuacaaucuccgaggacggcucuaugagcaucaaaaacgaagaggaggaacacacccugacaauucucaucagaacggggcugcucgugauuuccggagucuuccccgugucuaucccgauuaccgcugcggccugguaccugugggagguuaagaagcaacgggcuggcgugcuuugggaugucccuucucccccucccguggggaaagccgaacuggaggacggagccuaucgcaucaagcagagaggcaucuuuggcuacucccagauuggggcuggagucuauaaagaaggcacauuccauaccauguggcacgugacaagaggggccguucugaugcaucgcggaaagagaaucgagcccuccugggcggaugugaaaaaggaccucauuagcuacggcgggggauggaagcuggagggcgaauggaaagagggcgaagagguccaggugcuugcucuggaaccugggaagaauccgcgggccguucaaaccaaacccggacucuuuaagacgaacaccggcacaaucggggccgugucccuggauuucagcccuggaaccucuggcucccccauugucgacagaaaagggaagguggugggacucuacggcaauggcguugucacacgcagcggggcuuaugugucugccaucgcgcagaccgagaaguccaucgaggauaacccugaaauugaggacgauaucuuccggaaaaagagacugacaauuauggaccuucaccccggagcuggcaaaacgaagcgcuaccugccugccaucgugcgggaagccauuaaaagagggcugcgcacccucauccuggcuccgacacgggucguggccgcugagauggaagaggcccuuagaggacugcccauucgcuaucagaccccugcgauccgggccgagcauaccggcagagaaaucguugaccucaugugucacgcuacauuuacgaugcggcugcucagccccgugcgcgucccuaacuacaaucugauuaucauggaugaggcccacuucaccgaccccgcuuccauugccgccagaggguauaucucuacacggguggaaaugggcgaggcugcgggaauuuuuaugaccgccacaccgccuggcagccgcgaucccuucccccaguccaacgcuccuaucauggacgaggaaagagagauccccgaacggagcuggaacucugggcaugaguggguuaccgauuuuaagggaaagacggugugguucgucccuuccauuaaagccggcaacgacaucgccgcuugccuuagaaagaaugggaaaaaggugauucaacugagccgcaaaacauuugauucugaauacguuaagacccgggccaacgacugggauuucguggucaccacagacaucagcgagaugggagcgaauuuuagagcugagcgcgugauugauccgcggagauguaugaagcccgugauccugaccgacggcgaggaacgcgucauccucgccgggccuaugcccguuacacacuccucugccgcucagcggagaggccgcauuggaagaaacccuaaaaaugaaaacgaccaguauaucuacaugggcgagccccuggaaaaugaugaggacugcgcccauuggaaggaggcgaaaaugcuucuggauaacauuaauaccccggaagggaucauuccuagcauguucgagcccgaacgggagaagguggacgccaucgauggagaauaccgccucagaggcgaggcucggaaaacguuuguggaccugaugcgcagaggggaucugccugucuggcucgccuaucggguggcugccgagggaauuaacuacgcugacagacgcugguguuucgauggcaucaagaauaaccaaauccuugaagagaacguugaaguggagauuuggacaaaagagggggaacggaagaagcugaaacccagauggcuggacgcccgcaucuauuccgauccucucgcgcugaaggaguucaaagaauuugccgcuggccggaagucucuuacccugaaucucauuacagagaugggaagacugcccaccuucaugacgcagaaagcccgggacgcucuggauaaccucgccguccuucacaccgccgaagugggcgggcgcgcuuacaaucacgcgcugagcgagcugccggagacacucgaaacccugcuucugcucacacugcuggccaccguuacaggaggcaucuuucucuuccuuauguccgggaagggaauuggcaagaugacccugggcaugugcugcaucaucacggcuagcauucugcucugguaugcccagauccagccucauuggauugccgcuucuaucauucuggaguuuuuccuuaucgugcugcucauccccgaacccgagaaacaaagaacaccucaggacaaccagcugaccuacgucgugauugccauccugaccgucguggcggccacaauggcuaaugaaaugggguuucucgagaagaccaaaaaggaccuuggacugggcuccauuacaacgcaggagagcgaauccaacauccuggauauugaccuccggccggccucugcuuggacccuguaugccguugcgacaaccuucgugacacccaugcuucgccacagcaucgaaaauagcucugugaacgucagccugaccgccauugcuaaucaagccacgguucucauggggcugggaagaggcuggccucuguccaaaauggauaucggggugccccuccuugcuaucggauguuacagccaggugaacccuauuacccugacagccgcucugcuccugcuugucgcccauuacgcgaucauuggccccggccugcaggccaaggcuacccgggaagcccagaagcgcacagcugccgggaucaugaaaaauccuaccguggacggaauuacgguuaucgaucucgagccgauccccuaugacccuaaguuugaaaaacaacugggccaggugaugcugcucguccuuugcgugacacagguccugaugaugagaaccacaugggcccugugugaggcgcucacccuggcuaccgggcccauuucuacacuuugggagggaaacccuggccgguucuggaauacgaccaucgccguguccauggcuaacauuuuucgcgggagcuaccuggccggagccggccuccuguucucuaucaugaagaauacaaccaacacaagacggggcaccgggaauauuggagaaacgcugggcgagaaauggaaguccagacucaacgcucuuggaaagagcgaauuucagaucuauaaaaagucuggaauccaagagguugaucgcacacuggccaaagagggcauuaagagaggggaaaccgaccaccaugcggugagcagaggauccgccaaacugcgcugguucgucgagcggaacauggugacccccgaaggcaagguuguggaucucggcugcgggagaggaggcuggucuuacuauugugggggacugaaaaauguccgcgaggugaagggccuuacaaaagggggaccgggccacgaggagccuauccccaugagcaccuacggcuggaaccuggugcggcuccaguccgggguugacgucuucuuuacacccccugagaaaugcgauacgcugcugugugacauuggagaaagcucccccaauccuaccaucgaggcuggcagaacacuccgcgugcuuaaccugguggaaaauuggcugaacaauaacacccaguucugcgucaagguucucaauccguauaugcccucugugauugagaaaauggaaacacugcaacggaaguacgggggagcccuugugagaaacccucugagccgcaauuccacccacgagauguacugggucucuaacgcuacgggcaauaucgugagcuccguuaacaugaucucucggaugcucauuaauagauuuaccaugaaacauaagaaggccacauaugagcccgauguggaccuggggagcggaacccgcaacaucggcauugaaaacgagaucccuaaucuggacauuaucggcaaaagaauugaaaagaucaaacaggagcacgaaacauccuggcauuacgaucaggaccaccccuauaagaccugggcguaccacgggagcuaugagacaaaacagaccggaucugccuccagcauggucaacggcgugguuaagcuccuuacgaagccgugggauguggucccuauggugacacaaauggcuaugaccgacaccacacccuucgggcagcagcggguguuuaaagagaaggucgauacgcgcacccaggaaccuaaagagggaacaaagaaacugaugagaaucaccgccgaauggcuguggaaggagcucggcaagaaaaagacaccccggauguguaccagagaggaguucacacggaaaguucgcucuaaugcugcccugggggcuauuuuuaccgacgagaacaaguggaaauccgccagagaagcgguggaggauagccgguucugggaacuuguggaccgcgagagaaaucugcaucucgagggaaagugcgaaacgugugucuacaacaugaugggcaaacgggagaagaagcugggcgaauuugggaaagccaagggaucucgcgcuaucugguauauguggcugggcgccagauuccucgaguuugaagcucugggguuccuuaaugaggaucacugguuuucccggggaaacagccuguccggcguggagggggaaggccuccauaaacugggauacauucuucgcgacguuagcaagaaagagggcggggccauguacgccgaugacaccgcgggaugggacacaagaaucacccuggaagaucucaagaaugaggaaauggugacaaaccacaugaagggcgagcauaaaaagcuggcugaggccauuuucaaacugaccuaucaaaauaaggucgugcggguucagcgcccuacgcccagagggacagugauggacaucaucucucggaaagaucagcgcggaagcggccaggucgggaccuacggccucaacacauucaccaauauggaagcccaacugauuagacagauggagggagaaggcaucuuuaaguccauucagcggcuuacggugaccgaggagaucgcuguucaaaacuggcuggccagaguggggcgcgaacggcucucuagaauggcuauuagcggagacgauugcgucgugaagccgcuggacgaucgcuucgccuccgcgcuuacagcccugaaugacaugggcaaaguccggaaggauauccagcagugggagccuucuagaggguggaacgacuggacccaggugcccuuuugcagccaccacuuccaugaacucguuaugaaagauggacgcgugcuggucgugcccugucggaaccaagacgagcugaucggcagagcucgcauuucccagggggccggcuggucucucaaggaaacagcuugccugggaaaaagcuaugcccagauguggacccuuauguacuuucaccggagagaucugcgccucgcggccaaugcuaucuguuccgccgugccuagccauuggguuccgacaucucggaccacgugguccauucacgcuaagcacgaguggaugacaaccgaggacaugcuggccguguggaacagagucuggauccaggaaaaucccuggauggaggacaagaccccuguggaaagcugggaggaaguucccuaucuuggcaaacgggaggaucaauggugcgggucucugauuggacucacauccagagcuaccugggccaagaacauccagacagcgauuaaucaggugcgcagccugaucggcaacgaggaauacacggacuauaugccuuccaugaaacgguucagaaaggaggaagaggaagccgggguccugugguga

SEQ ID NO: 19960 - RNA, 9876 nt, Artificial Sequence
  derived and/or modified CDS sequence (opt5) from DENV-2__EU687222__SS-prME
accgccggcgugaucauuaugcugauccccaccgcuauggccuuccaccucacgacccggaauggggagccucauaugauugucggacggcaggaaaagggcaagagccugcuuuuuaagacggaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagaucaaaucuugccacuggccuaagagccauacccugugguccaaugggguucuugaaagcgagaugauuauccccaaaaacuucgcuggaccggugucucagcacaacuaccgcccuggcuaucauacgcagacagccgggcccuggcaccucggaaagcuggaaauggauuuugacuucugugagggcaccaccgucguggugacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucgucaauucucugguuaccgccggccaugggcaaaucgauaacuuuagccugggagugcuuggcauggcccucuuccuggaagagaugcugagaacacgcguggggaccaaacacgcuauucuccuggucgcgguguccuuuguuacgcuuaucaccggaaauaugucuuuccgggaccugggcagagugauggucauggugggcgccacaaugaccgaugacauugggaugggaguuacauaucucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauccuggagcucaccgaugcccuggcccugggaaugaugguccuuaaaauugugcggaacauggaaaaguaccagcuggcuguuaccaucauggccauuagcugcgugccuaaugcggucauccuccaaaacgcuuggaagguguccuguacaauucuggccgccgugagcgucucuccccuccugcuuacguccagccagcagaaagcugacuggaucccucuggcccucaccaucaagggccugaaucccacagcuauuuuucugaccacacuuucucgcaccuccaaaaagagaagcuggccgcugaacgaggccguuauggcgguggggauggugucuauccucgccuccagccugcucaaaaaugacauuccuaugacgggaccccuggucgcuggcggccuucugacagugugcuauguucugaccgggcgguccgccgaucucgaacuggagcgcgcugccgacgugaagugggaggaucaggccgaaaucagcggaucuagcccuauucuuuccaucaccauuucugaggacggcagcauguccaucaaaaacgaagaggaggaacacacacugaccauccucauuagaacagggcugcucgucaucucuggaguguuccccguuagcauuccgaucacggcugcggccugguaccugugggaggugaagaagcaacgggcuggcguccuuugggaugugccuucucccccucccgucgggaaagccgaacuggaggacggagccuaucgcauuaagcagagaggcaucuuuggcuacagccagaucggggcuggaguguauaaagaaggcaccuuccauacaauguggcacguuaccagaggggccgugcugaugcaucgcggaaagagaauugagcccagcugggcggaugucaaaaaggaccucaucuccuacggcgggggauggaagcuggagggcgaauggaaagagggcgaagaggugcagguucuugcucuggaaccugggaagaauccgcgggccgugcaaacaaaacccggacucuuuaagaccaacacgggcaccauuggggccgucagccuggauuucucuccuggaacauccggcagccccaucguggacagaaaagggaaggugguuggacucuacggcaauggcgucgugacccgcucuggggcuuauguguccgccauugcgcagacagaaaagagcaucgaggauaacccugaaaucgaggacgauauuuuccggaaaaagagacugaccaucauggaccuucaccccggagcuggcaaaacaaagcgcuaccugccugccauuguccgggaagccaucaaaagagggcugcgcacgcucauucuggcuccgacccgggugguugccgcugagauggaagaggcccuuagaggacugcccauccgcuaucagaccccugcgauucgggccgagcauaccggcagagaaaucguggaccucaugugucacgcuaccuuuacaaugcggcugcucucccccguccgcgugccuaacuacaaucugaucauuauggaugaggcccacuucacggaccccgcuucuaucgccgccagaggguauauuagcacccggguugaaaugggcgaggcugcgggaaucuuuaugacagccaccccgccuggcucccgcgaucccuucccccagagcaacgcuccuauuauggacgaggaaagagagauccccgaacggucuuggaacuccgggcaugagugggugacagauuuuaagggaaagaccgucugguucgugccuagcaucaaagccggcaacgacauugccgcuugccuuagaaagaaugggaaaaagguuauccaacugucucgcaaaacguuugauagcgaauacgugaagacacgggccaacgacugggauuucgucgugaccaccgacauuuccgagaugggagcgaauuuuagagcugagcgcgugaucgauccgcggagauguaugaagcccgucauucugacagacggcgaggaacgcguuauccucgccgggccuaugcccgugacccacucuagcgccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauacaccggaagggauuaucccuuccauguucgagcccgaacgggagaagguggacgccauugauggagaauaccgccucagaggcgaggcucggaaaaccuuugucgaccugaugcgcagaggggaucugccuguguggcucgccuaucggguugcugccgagggaaucaacuacgcugacagacgcugguguuucgauggcauuaagaauaaccaaauccuugaagagaacguggaagucgagaucuggacgaaagagggggaacggaagaagcugaaacccagauggcuggacgcccgcauuuauucugauccucucgcgcugaaggaguucaaagaauuugccgcuggccggaagucccuuacacugaaucucaucaccgagaugggaagacugcccacauucaugacccagaaagcccgggacgcucuggauaaccucgccgugcuucacacggccgaaguuggcgggcgcgcuuacaaucacgcgcuguccgagcugccggagacccucgaaacacugcuucugcucacccugcuggccacagugaccggaggcauuuuucucuuccuuaugagcgggaagggaaucggcaagaugacacugggcaugugcugcauuaucaccgcuucuauccugcucugguaugcccagauucagccucauuggaucgccgcuuccauuauccuggaguuuuuccuuauuguccugcucauccccgaacccgagaaacaaagaacgccucaggacaaccagcugacauacguggucaucgccauucugaccgugguugcggccaccauggcuaaugaaaugggguuucucgagaagaccaagaaggaccuuggacugggcagcaucaccacacaggaguccgaaucuaacauucuggauaucgaccuccggccggccagcgcuuggacgcuguaugccguggcgaccacauucgugacccccaugcuucgccacuccauugaaaauucuagcgucaacguuucccugacagccaucgcuaaucaagccaccgugcucauggggcugggaagaggcuggccucugagcaaaauggauauuggggugccccuccuugcuaucggauguuacucucaggucaacccuaucacgcugaccgccgcucugcuccugcuuguggcccauuacgcgauuaucggccccggccugcaggccaaggcuacacgggaagcccagaagcgcaccgcugccgggauuaugaaaaauccuacaguugacggaaucaccgugauugaucucgagccgauccccuaugacccuaaguuugaaaaacaacugggccaggucaugcugcucgugcuuugcgucacacaggugcugaugaugagaacaaccugggcccugugugaggcgcucacacuggcuaccgggcccaucuccacccuuugggagggaaacccuggccgguucuggaauacaacgauugccguuagcauggcuaacaucuuucgcgggucuuaccuggccggagccggccuccuguucuccauuaugaagaauaccacaaacaccagacggggcacagggaauaucggagaaacccugggcgagaaauggaaaagcagacucaacgcucuugggaagucugaauuucagauuuauaaaaagagcggaauccaagagguggaucgcacgcuggccaaagagggcaucaagagaggggaaacagaccaccaugcggucuccagaggaucugccaaacugcgcugguucguggagcggaacaugguuacccccgaaggcaagguggucgaucucggcugcgggagaggaggcuggagcuacuauugugggggacugaaaaaugugcgcgaggugaagggccuuaccaaagggggaccgggccacgaggagccuauucccauguccacauacggcuggaaccugguucggcuccagagcggggucgacguguucuuuacacccccugagaaaugcgauacacugcugugugacaucggagaauccucucccaauccuacgauugaggcuggcagaacccuccgcgugcuuaaccuggucgaaaauuggcugaacaauaacacacaguucugcaucaagguucucaauccguauaugcccagcgugauugagaaaauggaaacccugcaacggaaguacgggggagcccuugugagaaacccucugucccgcaauucuacacacgagauguacugggucagcaacgcuaccggcaauaucguguccucuguuaacaugaucagccggaugcucauuaauagauuuacgaugaaacauaagaaggccaccuaugagcccgauguggaccugggguccggaacacgcaacaucggcauugaaaacgagaucccuaaucuggacauuaucggcaaaagaauugaaaagaucaaacaggagcacgaaaccagcuggcauuacgaucaggaccaccccuauaagacaugggcguaccacgggucuuaugagaccaaacagacaggauccgccagcucuauggucaacggcgugguuaagcuccuuaccaagccgugggauguggucccuauggugacgcaaauggcuaugacagacaccacccccuucgggcagcagcggguguuuaaagagaaggucgauacacgcacgcaggaaccuaaagagggaaccaagaaacugaugagaaucacagccgaauggcuguggaaggagcucggcaagaaaaagacaccccggauguguacaagagaggaguucacccggaaaguucgcuccaaugcugcccugggggcuauuuuuacagacgagaacaaguggaaaagcgccagagaagcgguggaggauucucgguucugggaacuuguggaccgcgagagaaaucugcaucucgagggaaagugcgaaaccugugucuacaacaugaugggcaaacgggagaagaagcugggcgaauuugggaaagccaagggaucccgcgcuaucugguauauguggcugggcgccagauuccucgaguuugaagcucugggguuccuuaaugaggaucacugguuuagccggggaaacucccugagcggcguggagggggaaggccuccauaaacugggauacauucuucgcgacguuucuaagaaagagggcggggccauguacgccgaugacacggcgggaugggacaccagaaucacacuggaagaucucaagaaugaggaaauggugaccaaccacaugaagggcgagcauaaaaagcuggcugaggccauuuucaaacugacauaucaaaauaaggucgugcggguucagcgcccuacccccagagggacggugauggacaucaucagccggaaagaucagcgcggauccggccaggucgggacauacggccucaacaccuucacaaauauggaagcccaacugauuagacagauggagggagaaggcaucuuuaagucuauucagcggcuuaccgugacggaggagaucgcuguucaaaacuggcuggccagaguggggcgcgaacggcucagcagaauggcuauuuccggagacgauugcgucgugaagccgcuggacgaucgcuucgccucugcgcuuaccgcccugaaugacaugggcaaaguccggaaggauauccagcagugggagccuagcagaggguggaacgacuggacacaggugcccuuuugcucccaccacuuccaugaacucguuaugaaagauggacgcgugcuggucgugcccugucggaaccaagacgagcugaucggcagagcucgcauuucucagggggccggcuggagccucaaggaaaccgcuugccugggaaaauccuaugcccagauguggacacuuauguacuuucaccggagagaucugcgccucgcggccaaugcuaucuguagcgccgugccuucucauuggguuccgaccucccggacaaccuggagcauucacgcuaagcacgaguggaugacgacagaggacaugcuggccguguggaacagagucuggauccaggaaaaucccuggauggaggacaagaccccuguggaaucuugggaggaaguucccuaucuuggcaaacgggaggaucaauggugcgggucccugauuggacucaccagcagagcuacaugggccaagaacauccagaccgcgauuaaucaggugcgcucccugaucggcaacgaggaauacacagacuauaugccuucuaugaaacgguucagaaaggaggaagaggaagccgggguccugugguga

SEQ ID NO: 19961 - RNA, 9876 nt, Artificial Sequence
  derived and/or modified CDS sequence (opt5) from DENV-2__EU687223__SS-prME
accgccggagugaucauuaugcugauccccaccgcuauggccuuccaccucacgaccagaaauggggaaccucauaugauugugggacggcaggaaaagggcaaaagccugcuuuuuaagacagaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagggaaggacagcccggugaacaucgaagccgagcccccuuuuggcgauucuuacauuaucaucggagucgaacccggccagcugaaacuuaauugguucaagaagggguccagcauuggacagauguuugagaccacaaugagaggcgcuaaacgcauggccauccugggggacaccgccugggauuucggaucucucggcgggguguuuacgagcauuggcaaggcucugcaccaaguuuucggagccaucuacggcgcggcuuuuuccggggugucuuggacaaugaaaauucugaucggagucaucauuaccuggaucggcaugaacagccgguccaccagccuuucugugucccucgugcugguuggggucgugacacuguaucucggagugaugguccaggccgacagcggcugugugguuucuuggaagaauaaagagcugaagugcggguccggcauuuucaucaccgauaacgugcacacauggacggaacaguacaaguuucagccugagagccccuccaaacuugccucugcuauucaaaaggcccaugaagagggaaucuguggcaucagaagcgucacccgccuggaaaaucucauguggaaacagauuacaccggagcugaaccacauccuguccgagaaugaagugaaacuuaccauuaugacaggggacaucaaaggaauuaugcaggcuggcaagcggucucucagaccucagcccaccgagcugaaauauagcuggaagacgugggggaaggccaaaaugcuguccaccgaaagccauaaccaaacauuccucaucgauggaccugagaccgcggaaugccccaauacaaaccgcgccuggaacucucuggagguugaggacuacggcuuuggcguguucuccaccaacaucuggcuuaagcugcgggaaaaacaggacgucuuuugugauagcaagcucaugucugcugccauuaaagacaauagagcugugcacgccgauaugggguauuggaucgaguccgcgcugaacgacacauggaagauggaaaaggccagcuucauugagaucaaaucuugccacuggccuaagagccauacccugugguccaauggaguucuugagagcgaaaugauuauccccaaaaacuucgcuggcccggugucucagcacaacuaccgcccuggguaucauacgcagacagccggacccuggcaccucggcaagcuggagauggauuuugacuucugugaagggaccaccgucguggugacagaggauugcggaaaucggggccccucccugagaaccacgacagcuagcggcaaacucauuaccgaauggugcugucgguccugcacacugccuccgcuucgcuacagaggggaggacggauguugguacggcauggagauccggccccugaaggaaaaggaggaaaaccucgucaauucucugguuaccgccgggcauggacaaaucgauaacuuuagccugggcgugcuugggauggcccucuuccuggaggaaaugcugagaacacgcgugggaaccaaacacgcuauucuccuggucgcgguguccuuuguuacgcuuaucaccggcaauaugucuuuccgggaccugggcagagugauggucauggugggggccacaaugaccgaugacauuggaaugggcguuacauaucucgcucugcuggccgccuuuaaggugcgcccuaccuucgcugccgggcuucugcucagaaaacugacgagcaaggagcucaugauggcgacaaucggaauugcucugcuuucccagucuaccauccccgagacaauccuggaacucaccgaugcccuggcccugggcaugaugguccuuaaaauugugcggaacauggagaaguaccagcuggcuguuaccaucauggccauuagcugcgugccuaaugcggucauccuccaaaacgcuuggaagguguccuguacaauucuggccgccgugagcgucucuccccuccugcuuacguccagccagcagaaagcugacuggaucccucuggcccucaccaucaaggggcugaaucccacagcuauuuuucugaccacacuuucucgcaccuccaaaaagagaagcuggccgcugaacgaagccguuauggcggugggaauggugucuauccucgccuccagccugcucaaaaaugacauuccuaugacgggcccccuggucgcuggcgggcuucugacagugugcuauguucugaccggacgguccgccgaucucgagcuggaacgcgcugccgacgugaagugggaggaucaggccgagaucagcggcucuagcccuauucuuuccaucaccauuucugaagacgggagcauguccaucaaaaacgaggaagaggagcacacacugaccauccucauuagaacaggacugcucgucaucucuggcgcuuuccccgugagcauuccgaucacggcggccgcuugguaccugugggaaguuaagaagcaacgggccggggugcuuugggaugucccuucucccccucccgugggaaaagccgagcuggaagacggcgcuuaucgcauuaagcagagaggcaucuuuggguacagccagaucggagccggcgucuauaaagaggggaccuuccauacaauguggcacgugacccggggagcgguucugaugcaucgcggcaagagaauugaacccagcugggcugaugugaaaaaggaccucaucuccuacgggggaggcuggaagcuggagggcgaguggaaagaaggggaggaaguccaggugcuugcccuggagccuggaaagaauccgcgggccguucaaacaaaacccggccucuuuaagaccaacacggggaccauuggagcugugagccuggauuucucuccuggcacauccgggagccccaucgucgacagaaaaggaaagguggugggccucuacggcaaugggguugucacccgcucuggagccuauguguccgcgauugcucagacagaaaagagcaucgaggauaacccugagaucgaagacgauauuuuccggaaaaagagacugaccaucauggaccuucaccccggcgccgggaaaacaaagcgcuaccugccugccauugugcgggaggcuaucaaaagaggacugcgcacgcucauucuggccccgacccgggucguggcugccgaaauggaggaagcgcuuagaggccugcccauccgcuaucagaccccugccauucgggcugagcauaccgggagagagaucguugaccucaugugucacgccaccuuuacaaugcggcugcucucccccgugcgcgucccuaacuacaaucugaucauuauggaugaagcucacuucacggaccccgccucuaucgccgcuagaggcuauauuagcacccggguggagaugggagaagcggccggcaucuuuaugacagcuaccccgccugggucccgcgaucccuucccccagagcaacgccccuauuauggacgaggagagagaaauccccgagcggucuuggaacuccggacaugaauggguuacagauuuuaagggcaagaccgugugguucgucccuagcaucaaagccgggaacgacauugcugccugccuuagaaagaauggcaagaaggugauccaacugucucgcaaaacguuugauagcgaguacguuaagacacgggcgaacgacugggauuucguggucaccaccgacauuuccgaaaugggcgcuaauuuuagagccgagcgcgugaucgauccgcggagauguaugaagcccgugauucugacagacggggaggaacgcgucauccucgccggcccuaugcccguuacccacucuagcgcugcccagcggagaggacgcaucggcagaaacccuaaaaaugagaacgaccaguauauuuacaugggggaaccccuggagaaugaugaagacugcgcgcauuggaaggaggccaaaaugcuucuggauaacaucaauacaccggagggaauuaucccuuccauguucgaacccgagcgggaaaagguggacgcuauugauggcgaguaccgccucagaggggaagcccggaaaaccuuuguggaccugaugcgcagaggagaucugccugucuggcucgcuuaucggguggccgcugagggcaucaacuacgccgacagacgcugguguuucgaugggauuaagaauaaccaaauccuugaggaaaacguugagguggaaaucuggacgaaagagggcgagcggaagaagcugaaacccagauggcuggacgcgcgcauuuauucugauccucucgcccugaaggaguucaaagaguuugcugccggaagaaagagccuuacacugaaucucaucaccgaaaugggccggcugcccacauucaugacccagaaagcucgggacgcccuggauaaccucgccguccuucacacggcugaggucggcgggcgcgcguacaaucacgcccuguccgaacugccggagacccucgagacacugcuucugcucacccugcuggcuacaguuaccggagggauuuuucucuuccuuaugagcgggaagggcaucggcaagaugacacuggggaugugcugcauuaucaccgccucuauccugcucugguaugcccagauucagccucauuggaucgcugccuccauuauccuggaauuuuuccuuauugugcugcucauccccgagcccgaaaaacaaagaacgccucaggacaaccagcugacauacgucgugaucgcgauucugaccgucguggccgcuaccauggccaaugagaugggauuucucgaaaagaccaaaaaggaccuuggccuggggagcaucaccacacaggaguccgagucuaacauucuggauaucgaccuccggccggcuagcgccuggacgcuguaugcgguugccaccacauucgugacccccaugcuucgccacuccauugaaaauucuagcgugaacgucucccugacagcuaucgccaaucaagcuaccguucucaugggacugggcagaggguggccucugagcaaaauggauauuggagugccccuccuugccaucggcuguuacucucaggugaacccuaucacgcugaccgcugcccugcuccugcuugucgcgcauuacgccauuaucggccccgggcugcaggcuaaggccacacgggaggcucagaagcgcaccgccgccggaauuaugaaaaauccuacaguggacggcaucaccguuauugaucucgaaccgauccccuaugacccuaaguuugagaaacaacugggacaggugaugcugcucguccuuugcgugacgcagguccugaugaugagaacaaccugggcgcugugugaagcucucacacuggccaccggacccaucuccacccuuugggagggcaacccugggcgguucuggaauacaacgauugcugugagcauggccaacaucuuucgcggaucuuaccuggccggcgcuggccuccuguucuccauuaugaagaauaccacaaacaccagacgggggacaggaaauaucggcgagacccugggggaaaaauggaaguccagacucaacgcccuuggaaagucugaguuucagauuuauaaaaagagcggcauccaagaaguugaucgcacgcuggcgaaagaggggaucaagcggggagagacagaccaccaugccguguccagaggcucugcuaaacugcgcugguucgucgaacggaacauggugacccccgagggcaagguuguggaucucgggugcggaagaggcggguggagcuacuauuguggaggccugaaaaauguccgcgaagugaaggggcuuaccaagggaggcccgggccacgaggaaccuauucccauguccacauacggguggaaccuggugcggcuccagagcggaguugacgucuucuuuacacccccugagaaaugcgauacacugcugugugacaucggcgaguccucucccaauccuacgauugaagccgggagaacccuccgcgugcuuaaccugguggagaauuggcugaacaauaacacacaguucugcaucaagguccucaauccguauaugcccagcguuauugagaaaauggagacccugcaacggaaguacggaggcgcucuugugagaaacccucugucccgcaauucuacacacgaaauguacugggugagcaacgccaccgggaauaucgucuccucugugaacaugaucagccggaugcucauuaauagauuuacgaugaaacauaagaaggcgaccuaugagcccgauguugaccugggauccggcacacgcaacaucggcauugagaacgaaaucccuaaucuggacauuaucgggaaaagaauugagaagaucaaacaggaacacgagaccagcuggcauuacgaucaggaccaccccuauaagacaugggccuaccacggaucuuaugaaaccaaacagacaggcuccgcuagcucuauggugaacggggucgugaagcuccuuaccaagccgugggauguugugccuauggucacgcaaauggccaugacagacaccacccccuucggacagcagcggguguuuaaagagaagguggauacacgcacgcaggagccuaaagaaggcaccaagaaacugaugagaaucacagcugaguggcuguggaaggaacucgggaagaaaaagacaccccggauguguacaagagaggaguucacccggaaaguccgcuccaaugccgcucugggagccauuuuuacagacgaaaacaaguggaaaagcgcgagagaggccguugaagauucucgguucugggagcuuguggaccgcgaaagaaaucugcaucucgagggcaagugcgagaccuguguguacaacaugaugggcaaacgggaaaagaagcugggggaguuuggaaaagcuaagggcucccgcgccaucugguauauguggcugggggcuagauuccucgaauuugaggcccugggauuccuuaaugaagaucacugguuuagccggggcaacucccugagcggggucgagggcgagggacuccauaaacugggcuacauucuucgcgacgugucuaagaaagaagggggagccauguacgcggaugacacggcuggcugggacaccagaaucacacuggaggaucucaagaaugaagagaugguuaccaaccacaugaagggggaacauaaaaagcuggccgaggccauuuucaaacugacauaucaaaauaaggugguccgggugcagcgcccuacccccagaggaacgguuauggacaucaucagccggaaagaucagcgcggcuccggacaggugggcacauacggacucaacaccuucacaaauauggaggcucaacugauuagacagauggaaggcgaggggaucuuuaagucuauucagcggcuuaccgucacggaagagaucgccgugcaaaacuggcuggcuagaguuggacgcgagcggcucagcagaauggccauuuccggcgacgauugcguggucaagccgcuggacgaucgcuucgcgucugcccuuaccgcucugaaugacauggggaaagugcggaaggauauccagcagugggaaccuagcagaggauggaacgacuggacacagguccccuuuugcucccaccacuuccaugagcucgugaugaaagauggccgcguucuggugguccccugucggaaccaagacgaacugaucgggagagcccgcauuucucagggcgcuggauggagccucaaggagaccgccugccugggcaaauccuaugcgcagauguggacacuuauguacuuucaccggagagaucugcgccucgccgcuaaugccaucuguagcgcugugccuucucauugggugccgaccucccggacaaccuggagcauucacgccaagcacgaauggaugacgacagaggacaugcuggcuguuuggaacagaguguggauccaggagaaucccuggauggaagacaagaccccugucgagucuugggaagaggugcccuaucuugggaaacgggaagaucaauggugcggaucccugauuggccucaccagcagagccacaugggcgaagaacauccagaccgccauuaaucagguucgcucccugaucgggaacgaggaguacacagacuauaugccuucuaugaaacgguucagaaaggaagaggaagaggcuggagugcugugguga

SEQ ID NO: 19962 - RNA, 9876 nt, Artificial Sequence
  derived and/or modified CDS sequence (opt5) from DENV-2__EU687227__SS-prME
accgccggcgugaucauuaugcugauccccaccgcuauggccuuccaccucacgacccggaauggggagccucauaugauugucggacggcaggaaaagggcaagagccugcuuuuuaagacggaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagaucaaaucuugccacuggccuaagagccauacccugugguccaaugggguucuugaaagcgagaugauuauccccaaaaacuucgcuggaccggugucucagcacaacuaccgcccuggcuaucauacgcagacagccgggcccuggcaccucggaaagcuggaaauggauuuugacuucugugagggcaccaccgucguggugacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucgucaauucucugguuaccgccggccaugggcaaaucgauaacuuuagccugggagugcuuggcauggcccucuuccuggaagagaugcugagaacacgcguggggaccaaacacgcuauucuccuggucgcgguguccuuuguuacgcuuaucaccggaaauaugucuuuccgggaccugggcagagugauggucauggugggcgccacaaugaccgaugacauugggaugggaguuacauaucucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauccuggagcucaccgaugcccuggcccugggaaugaugguccuuaaaauugugcggaacauggaaaaguaccagcuggcuguuaccaucauggccauuagcugcgugccuaaugcggucauccuccaaaacgcuuggaagguguccuguacaauucuggccgccgugagcgucucuccccuccugcuuacguccagccagcagaaagcugacuggaucccucuggcccucaccaucaagggccugaaucccacagcuauuuuucugaccacacuuucucgcaccuccaaaaagagaagcuggccgcugaacgaggccguuauggcgguggggauggugucuauccucgccuccagccugcucaaaaaugacauuccuaugacgggaccccuggucgcuggcggccuucugacagugugcuauguucugaccgggcgguccgccgaucucgaacuggagcgcgcugccgacgugaagugggaggaucaggccgaaaucagcggaucuagcccuauucuuuccaucaccauuucugaggacggcagcauguccaucaaaaacgaagaggaggaacacacacugaccauccucauuagaacagggcugcucgucaucucuggaguguuccccguuagcauuccgaucacggcugcggccugguaccugugggaggugaagaagcaacgggcuggcguccuuugggaugugccuucucccccucccgucgggaaagccgaacuggaggacggagccuaucgcauuaagcagagaggcaucuuuggcuacagccagaucggggcuggaguguauaaagaaggcaccuuccauacaauguggcacguuaccagaggggccgugcugaugcaucgcggaaagagaauugagcccagcugggcggaugucaaaaaggaccucaucuccuacggcgggggauggaagcuggagggcgaauggaaagagggcgaagaggugcagguucuugcucuggaaccugggaagaauccgcgggccgugcaaacaaaacccggacucuuuaagaccaacacgggcaccauuggggccgucagccuggauuucucuccuggaacauccggcagccccaucguggacagaaaagggaaggugguuggacucuacggcaauggcgucgugacccgcucuggggcuuauguguccgccauugcgcagacagaaaagagcaucgaggauaacccugaaaucgaggacgauauuuuccggaaaaagagacugaccaucauggaccuucaccccggagcuggcaaaacaaagcgcuaccugccugccauuguccgggaagccaucaaaagagggcugcgcacgcucauucuggcuccgacccgggugguugccgcugagauggaagaggcccuuagaggacugcccauccgcuaucagaccccugcgauucgggccgagcauaccggcagagaaaucguggaccucaugugucacgcuaccuuuacaaugcggcugcucucccccguccgcgugccuaacuacaaucugaucauuauggaugaggcccacuucacggaccccgcuucuaucgccgccagaggguauauuagcacccggguugaaaugggcgaggcugcgggaaucuuuaugacagccaccccgccuggcucccgcgaucccuucccccagagcaacgcuccuauuauggacgaggaaagagagauccccgaacggucuuggaacuccgggcaugagugggugacagauuuuaagggaaagaccgucugguucgugccuagcaucaaagccggcaacgacauugccgcuugccuuagaaagaaugggaaaaagguuauccaacugucucgcaaaacguuugauagcgaauacgugaagacacgggccaacgacugggauuucgucgugaccaccgacauuuccgagaugggagcgaauuuuagagcugagcgcgugaucgauccgcggagauguaugaagcccgucauucugacagacggcgaggaacgcguuauccucgccgggccuaugcccgugacccacucuagcgccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauacaccggaagggauuaucccuuccauguucgagcccgaacgggagaagguggacgccauugauggagaauaccgccucagaggcgaggcucggaaaaccuuugucgaccugaugcgcagaggggaucugccuguguggcucgccuaucggguugcugccgagggaaucaacuacgcugacagacgcugguguuucgauggcauuaagaauaaccaaauccuugaagagaacguggaagucgagaucuggacgaaagagggggaacggaagaagcugaaacccagauggcuggacgcccgcauuuauucugauccucucgcgcugaaggaguucaaagaauuugccgcuggccggaagucccuuacacugaaucucaucaccgagaugggaagacugcccacauucaugacccagaaagcccgggacgcucuggauaaccucgccgugcuucacacggccgaaguuggcgggcgcgcuuacaaucacgcgcuguccgagcugccggagacccucgaaacacugcuucugcucacccugcuggccacagugaccggaggcauuuuucucuuccuuaugagcgggaagggaaucggcaagaugacacugggcaugugcugcauuaucaccgcuucuauccugcucugguaugcccagauucagccucauuggaucgccgcuuccauuauccuggaguuuuuccuuauuguccugcucauccccgaacccgagaaacaaagaacgccucaggacaaccagcugacauacguggucaucgccauucugaccgugguugcggccaccauggcuaaugaaaugggguuucucgagaagaccaagaaggaccuuggacugggcagcaucaccacacaggaguccgaaucuaacauucuggauaucgaccuccggccggccagcgcuuggacgcuguaugccguggcgaccacauucgugacccccaugcuucgccacuccauugaaaauucuagcgucaacguuucccugacagccaucgcuaaucaagccaccgugcucauggggcugggaagaggcuggccucugagcaaaauggauauuggggugccccuccuugcuaucggauguuacucucaggucaacccuaucacgcugaccgccgcucugcuccugcuuguggcccauuacgcgauuaucggccccggccugcaggccaaggcuacacgggaagcccagaagcgcaccgcugccgggauuaugaaaaauccuacaguugacggaaucaccgugauugaucucgagccgauccccuaugacccuaaguuugaaaaacaacugggccaggucaugcugcucgugcuuugcgucacacaggugcugaugaugagaacaaccugggcccugugugaggcgcucacacuggcuaccgggcccaucuccacccuuugggagggaaacccuggccgguucuggaauacaacgauugccguuagcauggcuaacaucuuucgcgggucuuaccuggccggagccggccuccuguucuccauuaugaagaauaccacaaacaccagacggggcacagggaauaucggagaaacccugggcgagaaauggaaaagcagacucaacgcucuugggaagucugaauuucagauuuauaaaaagagcggaauccaagagguggaucgcacgcuggccaaagagggcaucaagagaggggaaacagaccaccaugcggucuccagaggaucugccaaacugcgcugguucguggagcggaacaugguuacccccgaaggcaagguggucgaucucggcugcgggagaggaggcuggagcuacuauugugggggacugaaaaaugugcgcgaggugaagggccuuaccaaagggggaccgggccacgaggagccuauucccauguccacauacggcuggaaccugguucggcuccagagcggggucgacguguucuuuacacccccugagaaaugcgauacacugcugugugacaucggagaauccucucccaauccuacgauugaggcuggcagaacccuccgcgugcuuaaccuggucgaaaauuggcugaacaauaacacacaguucugcaucaagguucucaauccguauaugcccagcgugauugagaaaauggaaacccugcaacggaaguacgggggagcccuugugagaaacccucugucccgcaauucuacacacgagauguacugggucagcaacgcuaccggcaauaucguguccucuguuaacaugaucagccggaugcucauuaauagauuuacgaugaaacauaagaaggccaccuaugagcccgauguggaccugggguccggaacacgcaacaucggcauugaaaacgagaucccuaaucuggacauuaucggcaaaagaauugaaaagaucaaacaggagcacgaaaccagcuggcauuacgaucaggaccaccccuauaagacaugggcguaccacgggucuuaugagaccaaacagacaggauccgccagcucuauggucaacggcgugguuaagcuccuuaccaagccgugggauguggucccuauggugacgcaaauggcuaugacagacaccacccccuucgggcagcagcggguguuuaaagagaaggucgauacacgcacgcaggaaccuaaagagggaaccaagaaacugaugagaaucacagccgaauggcuguggaaggagcucggcaagaaaaagacaccccggauguguacaagagaggaguucacccggaaaguucgcuccaaugcugcccugggggcuauuuuuacagacgagaacaaguggaaaagcgccagagaagcgguggaggauucucgguucugggaacuuguggaccgcgagagaaaucugcaucucgagggaaagugcgaaaccugugucuacaacaugaugggcaaacgggagaagaagcugggcgaauuugggaaagccaagggaucccgcgcuaucugguauauguggcugggcgccagauuccucgaguuugaagcucugggguuccuuaaugaggaucacugguuuagccggggaaacucccugagcggcguggagggggaaggccuccauaaacugggauacauucuucgcgacguuucuaagaaagagggcggggccauguacgccgaugacacggcgggaugggacaccagaaucacacuggaagaucucaagaaugaggaaauggugaccaaccaaaugaagggcgagcacaaaaagcuggcugaggccauuuucaaacugacauaucagaauaaggucgugcggguucagcgcccuacccccagagggacggugauggacaucaucagccggaaagaucagcgcggauccggccaagucgggacauacggccucaacaccuucacaaauauggaagcccagcugauuagacagauggagggagaaggcaucuuuaagucuauucaacggcuuaccgugacggaggagaucgcuguucagaacuggcuggccagaguggggcgcgaacggcucagcagaauggcuauuuccggagacgauugcgucgugaagccgcuggacgaucgcuucgccucugcgcuuaccgcccugaaugacaugggcaaaguccggaaggauauccagcagugggagccuagcagaggguggaacgacuggacacaagugcccuuuugcucccaucacuuccacgaacucguuaugaaagauggacgcgugcuggucgugcccugucggaaccaggacgagcugaucggcagagcucgcauuucucagggggccggcuggagccucaaggaaaccgcuugccugggaaaauccuaugcccagauguggacacuuauguacuuucaucggagagaucugcgccucgcggccaaugcuaucuguagcgccgugccuucucacuggguuccgaccucccggacaaccuggagcauucaugcuaagcacgaguggaugacgacagaggacaugcuggccguguggaacagagucuggauccaagaaaaucccuggauggaggacaagaccccuguggaaucuugggaggaaguucccuaucuuggcaaacgggaggaucaguggugcgggucccugauuggacucaccagcagagcuacaugggccaagaacauccagaccgcgauuaaucaggugcgcucccugaucggcaacgaggaauacacagacuauaugccuucuaugaaacgguucagaaaggaggaagaggaagccgggguccugugguga

SEQ ID NO: 19963 - RNA, 9876 nt, Artificial Sequence
  derived and/or modified CDS sequence (opt5) from DENV-2__EU687228__SS-prME
accgccggcgugaucauuaugcugauccccaccgcuauggccuuccaccucacgacccggaacggggagccucauaugauugucggacggcaggaaaagggcaagagccugcuuuuuaagacggaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaacgaaaucaaaauuacaccucagucuuccaucaccgaggccgaacuuacgggguauggaaccgucacaauggaguguagcccccggaccggccuggauuucaaugaaauggugcuccugcagauggaggacaaggcuuggcuuguucaccgccaaugguuucuggaucucccgcugccuuggcugcccggggccgacacacagggaucuaacuggauucagaaagagacccucgugacguucaagaauccucaugcuaagaaacaggacgucgugguucugggcucccaagaaggggccaugcacacagcccuuaccggcgcuacagagauccagaugagcuccggaaaccugcucuuuaccggccaucugaagugcagacuucggauggauaaacugcagcucaaggggaugucuuacagcauguguaccggaaaauucaagauugugaaggaaaucgcggagacacaacacggcacgaucgucauuagagugcaguaugagggggacggaucccccugcaaaauccccuucgaaauuauggaucuggagaagcgccauguccugggccggcucaucaccgugaacccuauuguuacagaaaaagacagcccggugaauaucgaggccgaacccccuuuuggggauucuuacauuaucaucggcgucgagcccggacagcugaaacuuaacugguucaaaaagggcuccagcauugggcagauguuugagaccacaaugagaggagcuaagcgcauggccauccugggcgacaccgccugggauuucgggucucucggaggcguguuuacgagcauugggaaagcucugcaccaaguuuucggcgccaucuacggagcggcuuuuuccggcgugucuuggacaaugaagauucugaucggggucaucauuaccuggaucggaaugaauagccgguccaccagccuuucugugucccucgugcugguuggcgucgugacacuguaucucggggugaugguccaggccgacagcggaugugugguuucuuggaaaaacaaggaacugaaaugcggcuccgggauuuucaucaccgauaaugugcacacauggacggagcaguacaaguuucagccugaaagccccuccaaacuugccucugcuauucaaaaagcccaugaggaaggcaucuguggaaucagaagcgucacccgccuggagaaccucauguggaagcagauuacaccggagcugaaucacauccuguccgaaaacgaggugaaacuuaccauuaugacaggcgacaucaaggggauuaugcaggcuggaaaacggucucucagaccucagcccaccgaacugaaguauagcuggaaaacguggggcaaggccaagaugcuguccaccgagagccauaaucaaacauuccucaucgaugggccugaaaccgcggagugccccaacacaaaucgcgccuggaacucucuggagguugaagacuacggauuuggcguguucuccaccaauaucuggcuuaaacugcgggagaagcaggacgucuuuugugauagcaaacucaugucugcugccauuaaggacaacagagcugugcacgccgauaugggcuauuggaucgaauccgcgcugaaugacacauggaaaauggagaaggccagcuucauugagaucaagucuugccacuggccuaaaagccauacccugugguccaacgggguucuugaaagcgagaugauuauccccaagaacuucgcuggaccggugucucagcacaauuaccgcccuggcuaucauacgcagacagccgggcccuggcaccucggaaaacuggaaauggauuuugacuucugugagggcaccaccgucguggugacagaagauugcgggaaccggggacccucccugagaaccacgacagcuagcggcaagcucauuaccgaguggugcugucgguccugcacacugccuccgcuucgcuacagaggcgaggacggguguugguacggaauggaaauccggccccugaaagagaaggaagagaaucucgucaacucucugguuaccgccggccaugggcaaaucgauaauuuuagccugggagugcuuggcauggcccucuuccuggaagagaugcugagaacacgcguggggaccaagcacgcuauucuccuggucgcgguguccuuuguuacgcuuaucaccggaaacaugucuuuccgggaccugggcagagugauggucauggugggcgccacaaugaccgaugacauugggaugggaguuacauaucucgcucugcuggccgccuuuaaagugcgcccuaccuucgcugccggccuucugcucagaaagcugacgagcaaagagcucaugauggcgacaaucgggauugcucugcuuucccagucuaccauccccgaaacaauccuggagcucaccgaugcccuggcccugggaaugaugguccuuaagauugugcggaauauggaaaaauaccagcuggcuguuaccaucauggccauuagcugcgugccuaacgcggucauccuccaaaaugcuuggaagguguccuguacaauucuggccgccgugagcgucucuccccuccugcuuacguccagccagcagaaggcugacuggaucccucuggcccucaccaucaaaggccugaaccccacagcuauuuuucugaccacacuuucucgcaccuccaagaaaagaagcuggccgcugaaugaggccguuauggcgguggggauggugucuauccucgccuccagccugcucaagaacgacauuccuaugacgggaccccuggucgcuggcggccuucugacagugugcuauguucugaccgggcgguccgccgaucucgaacuggagcgcgcugccgacgugaaaugggaggaucaggccgaaaucagcggaucuagcccuauucuuuccaucaccauuucugaggacggcagcauguccaucaagaaugaagaggaggaacacacacugaccauccucauuagaacagggcugcucgucaucucuggaguguuccccguuagcauuccgaucacggcugcggccugguaccugugggaggugaaaaagcaacgggcuggcguccuuugggaugugccuucucccccucccgucgggaaggccgaacuggaggacggagccuaucgcauuaaacagagaggcaucuuuggcuacagccagaucggggcuggaguguauaaggaaggcaccuuccauacaauguggcacguuaccagaggggccgugcugaugcaucgcggaaaaagaauugagcccagcugggcggaugucaagaaagaccucaucuccuacggcgggggauggaagcuggagggcgaauggaaggagggcgaagaggugcagguucuugcucuggaaccugggaaaaacccgcgggccgugcaaacaaagcccggacucuuuaaaaccaauacgggcaccauuggggccgucagccuggauuucucuccuggaacauccggcagccccaucguggacagaaaggggaaagugguuggacucuacggcaacggcgucgugacccgcucuggggcuuauguguccgccauugcgcagacagaaaagagcaucgaggauaacccugaaaucgaggacgauauuuuccggaagaaaagacugaccaucauggaccuucaccccggagcuggcaagacaaaacgcuaccugccugccauuguccgggaagccaucaagagagggcugcgcacgcucauucuggcuccgacccgggugguugccgcugagauggaagaggcccuuagaggacugcccauccgcuaucagaccccugcgauucgggccgagcauaccggcagagaaaucguggaccucaugugucacgcuaccuuuacaaugcggcugcucucccccguccgcgugccuaauuacaaccugaucauuauggaugaggcccacuucacggaccccgcuucuaucgccgccagaggguauauuagcacccggguugaaaugggcgaggcugcgggaaucuuuaugacagccaccccgccuggcucccgcgaucccuucccccagagcaaugcuccuauuauggacgaggaaagagagauccccgaacggucuuggaacuccgggcaugagugggugacagauuuuaaaggaaagaccgucugguucgugccuagcaucaaggccggcaaugacauugccgcuugccuucgcaagaacgggaagaaaguuauccaacugucucgcaagacguuugauagcgaauacgugaaaacacgggccaaugacugggauuucgucgugaccaccgacauuuccgagaugggagcgaacuuuagagcugagcgcgugaucgauccgcggagauguaugaagcccgucauucugacagacggcgaagaaagaguuauccucgccgggccuaugcccgugacccacucuagcgccgcucagcggagaggccgcaucggaagaaauccuaagaacgaaaaugaccaguauauuuacaugggcgagccccuggaaaacgaugaggacugcgcccauuggaaagaggcgaagaugcuucuggauaauaucaacacaccggaagggauuaucccuuccauguucgagcccgaacgggagaaaguggacgccauugauggagaauaccgccucagaggcgaggcucggaagaccuuugucgaccugaugcgcagaggggaucugccuguguggcucgccuaucggguugcugccgagggaaucaauuacgcugacagacgcugguguuucgauggcauuaaaaacaaccaaauccuugaagagaauguggaagucgagaucuggacgaaggagggggaacggaaaaagcugaagcccagauggcuggacgcccgcauuuauucugauccucucgcgcugaaagaguucaaggaauuugccgcuggccggaaaagccuuacacugaaccucaucaccgagaugggaagacugcccacauucaugacccagaaggcccgggacgcucuggauaaucucgccgugcuucacacggccgaaguuggcgggcgcgcuuacaaccacgcgcuguccgagcugccggagacccucgaaacacugcuucugcucacccugcuggccacagugaccggaggcauuuuucucuuccuuaugagcgggaaaggaaucggcaagaugacacugggcaugugcugcauuaucaccgcuucuauccugcucugguaugcccagauucagccucauuggaucgccgcuuccauuauccuggaguuuuuccuuauuguccugcucauccccgaacccgagaagcaaagaacgccucaggacaaucagcugacauacguggucaucgccauucugaccgugguugcggccaccauggcuaacgaaaugggguuucucgagaaaacaaagaaagaccuuggacugggcagcaucaccacacaggaguccgaaucuaauauucuggauaucgaccuccggccggccagcgcuuggacgcuguaugccguggcgaccacauucgugacccccaugcuucgccacuccauugagaacucuagcgucaauguuucccugacagccaucgcuaaccaagccaccgugcucauggggcugggaagaggcuggccucugagcaagauggauauuggggugccccuccuugcuaucggauguuacucucaggucaauccuaucacgcugaccgccgcucugcuccugcuuguggcccauuacgcgauuaucggccccggccugcaggccaaagcuacacgggaagcccagaagcgcaccgcugccgggauuaugaagaacccuacaguugacggaaucaccgugauugaucucgagccgauccccuaugacccuaaauuugaaaagcaacugggccaggucaugcugcucgugcuuugcgucacacaggugcugaugaugagaacaaccugggcccugugugaggcgcucacacuggcuaccgggcccaucuccacccuuugggagggaaauccuggccgguucuggaacacaacgauugccguuagcauggcuaauaucuuucgcgggucuuaccuggccggagccggccuccuguucuccauuaugaaaaacaccacaaauaccagacggggcacagggaacaucggagaaacccugggcgagaaguggaaaagcagacucaacgcucuugggaagucugaauuucagauuuauaagaaaagcggaauccaagagguggaucgcacgcuggccaaggagggcaucaaaagaggggaaacagaccaccaugcggucuccagaggaucugccaagcugcgcugguucguggagcggaauaugguuacccccgaaggcaaaguggucgaucucggcugcgggagaggaggcuggagcuacuauugugggggacugaagaacgugcgcgaggugaaaggccuuaccaaagggggaccgggccacgaggagccuauucccauguccacauacggcuggaaucugguucggcuccagagcggggucgacguguucuuuacacccccugagaagugcgauacacugcugugugacaucggagaauccucucccaacccuacgauugaggcuggcagaacccuccgcgugcuuaaucuggucgaaaacuggcugaauaacaauacacaguucugcaucaaaguucucaacccguauaugcccagcgugauugagaagauggaaacccugcaacggaaauacgggggagcccuugugagaaauccucugucccgcaacucuacacacgagauguacugggucagcaaugcuaccggcaacaucguguccucuguuaauaugaucagccggaugcucauuaacagauuuacgaugaagcauaaaaaggccaccuaugagcccgauguggaccugggguccggaacacgcaacaucggcauugaaaaugagaucccuaaccuggacauuaucggcaagagaauugagaagaucaagcaggagcacgaaaccagcuggcauuacgaucaggaccaccccuauaaaacaugggcguaccacgggucuuaugagaccaagcagacaggauccgccagcucuauggucaauggcgugguuaaacuccuuaccaagccgugggauguggucccuauggugacgcaaauggcuaugacagacaccacccccuucgggcagcagcggguguuuaaggagaaagucgauacacgcacgcaggaaccuaaggagggaaccaaaaagcugaugagaaucacagccgaauggcuguggaaagagcucggcaagaagaaaacaccccggauguguacaagagaggaguucacccggaagguucgcuccaacgcugcccugggggcuauuuuuacagacgagaauaaauggaaguccgccagagaagcgguggaggauucucgguucugggaacuuguggaccgcgagagaaaccugcaucucgagggaaaaugcgaaaccugugucuacaauaugaugggcaagcgggagaaaaagcugggcgaauuugggaaggccaaaggaucccgcgcuaucugguauauguggcugggcgccagauuccucgaguuugaagcucugggguuccuuaacgaggaucacugguuuagccggggaaauucccugagcggcguggagggggaaggccuccauaagcugggauacauucuucgcgacguuucuaaaaaggagggcggggccauguacgccgaugacacggcgggaugggacaccagaaucacacuggaagaucucaaaaacgaggaaauggugaccaaucacaugaagggcgagcauaagaaacuggcugaggccauuuucaagcugacauaucaaaacaaagucgugcggguucagcgcccuacccccagagggacggugauggacaucaucagccggaaggaucagcgcggauccggccaggucgggacauacggccucaauaccuucacaaacauggaagcccaacugauuagacagauggagggagaaggcaucuuuaaaucuauucagcggcuuaccgugacggaggagaucgcuguucaaaauuggcuggccagaguggggcgcgaacggcucagcagaauggcuauuuccggagacgauugcgucgugaagccgcuggacgaucgcuucgccucugcgcuuaccgcccugaacgacaugggcaagguccggaaagauauccagcagugggagccuagcagaggguggaacgacuggacacaggugcccuuuugcucccaccacuuccaugaacucguuaugaaggauggacgcgugcuggucgugcccugucggaaucaagacgagcugaucggcagagcucgcauuucucagggggccggcuggagccucaaagaaaccgcuugccugggaaaguccuaugcccagauguggacacuuauguacuuucaccggagagaucugcgccucgcggccaacgcuaucuguagcgccgugccuucucauuggguuccgaccucccggacaaccuggagcauucacgcuaaacacgaguggaugacgacagaggacaugcuggccguguggaauagagucuggauccaggaaaaccccuggauggaggacaagaccccuguggaaucuugggaggaaguucccuaucuuggcaagcgggaggaucaauggugcgggucccugauuggacucaccagcagagcuacaugggccaaaaauauccagaccgcgauuaaccaggugcgcucccugaucggcaaugaggaauacacagacuauaugccuucuaugaagcgguucagaaaagaggaagaggaagccgggguccugugguga

SEQ ID NO: 19964 - RNA, 9876 nt, Artificial Sequence
  derived and/or modified CDS sequence (opt5) from DENV-2__EU687230__SS-prME
accgccggagugaucauuaugcugauccccaccgcuauggccuuccaccucacgaccagaaauggggagccucauaugauugucggacggcaggaaaagggcaaaagccugcuuuuuaagacggaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccggggcaccucccuuagcgugucucucgugcugguuggggucgugacacuguaucucggagugaugguccaggccgacuccggcugugugguuagcuggaagaauaaagaacugaagugcgggucuggcauuuucaucaccgauaacgugcacacauggacggagcaguacaaguuucagccugaaucccccagcaaacuugccuccgcuauucaaaaggcccaugaggaaggaaucuguggcaucagaucugucacccgccuggagaaucucauguggaaacagauuacaccggagcugaaccacauccugagcgaaaaugaggugaaacuuaccauuaugacaggggacaucaaaggaauuaugcaggcuggcaagcggucccucagaccucagcccaccgaacugaaauauucuuggaagacgugggggaaggccaaaaugcugagcaccgagucccauaaccaaacauuccucaucgauggaccugaaaccgcggagugccccaauacaaaccgcgccuggaauagccuggagguugaagacuacggcuuuggcguguucucuaccaacaucuggcuuaagcugcgggagaaacaggacgucuuuugugauuccaagcucaugagcgcugccauuaaagacaauagagcugugcacgccgauaugggguauuggaucgaaucugcgcugaacgacacauggaagauggagaaggccuccuucauugagaucaaaagcugccacuggccuaagucucauacccuguggagcaauggaguucuugaauccgagaugauuauccccaaaaacuucgcuggcccggugagccagcacaacuaccgcccuggguaucauacgcagacagccggacccuggcaccucggcaagcuggaaauggauuuugacuucugugaggggaccaccgucguggugacagaagauugcggaaaucggggccccucucugagaaccacgacagcuuccggcaaacucauuaccgaguggugcugucggagcugcacacugccuccgcuucgcuacagaggggaggacggauguugguacggcauggaaauccggccccugaaggagaaggaagagaaccucgucaauucccugguuaccgccgggcauggacaaaucgauaacuuuucucugggcgugcuugggauggcccucuuccuggaagagaugcugagaacacgcgugggaaccaaacacgcuauucuccuggucgcggugagcuuuguuacgcuuaucaccggcaauauguccuuccgggaccugggcagagugauggucauggugggggccacaaugaccgaugacauuggaaugggcguuacauaucucgcucugcuggccgccuuuaaggugcgcccuaccuucgcugccgggcuucugcucagaaaacugacgucuaaggagcucaugauggcgacaaucggaauugcucugcuuagccaguccaccauccccgaaacaauccuggagcucaccgaugcccuggcccugggcaugaugguccuuaaaauugugcggaacauggaaaaguaccagcuggcuguuaccaucauggccauuucuugcgugccuaaugcggucauccuccaaaacgcuuggaaggugagcuguacaauucuggccgccguguccgucagcccccuccugcuuacgucuucccagcagaaagcugacuggaucccucuggcccucaccaucaaggggcugaaucccacagcuauuuuucugaccacacuuagccgcaccucuaaaaagagauccuggccgcugaacgaggccguuauggcggugggaauggugagcauccucgccucuucccugcucaaaaaugacauuccuaugacgggcccccuggucgcuggcgggcuucugacagugugcuauguucugaccggacggagcgccgaucucgaacuggagcgcgcugccgacgugaagugggaggaucaggccgaaaucuccggcagcucuccuauucuuagcaucaccauuuccgaggacgggucuaugagcaucaaaaacgaagaggaggaacacacacugaccauccucauuagaacaggacugcucgucaucuccggcguguuccccguuucuauuccgaucacggcugcggccugguaccugugggaggugaagaagcaacgggcugggguccuuugggaugugccuucucccccucccgucggaaaagccgaacuggaggacggcgccuaucgcauuaagcagagaggcaucuuuggguacucccagaucggagcuggcguguauaaagaagggaccuuccauacaauguggcacguuacccggggagccgugcugaugcaucgcggcaagagaauugagcccuccugggcggaugucaaaaaggaccucaucagcuacgggggaggcuggaagcuggagggcgaauggaaagagggggaagaggugcagguucuugcucuggaaccuggaaagaauccgcgggccgugcaaacaaaacccggccucuuuaagaccaacacggggaccauuggagccgucucccuggauuucagcccuggcacaucugggucccccaucguggacagaaaaggaaaggugguuggccucuacggcaauggggucgugacccgcagcggagcuuaugugucugccauugcgcagacagagaaguccaucgaggauaacccugaaaucgaggacgauauuuuccggaaaaagagacugaccaucauggaccuucaccccggcgcugggaaaacaaagcgcuaccugccugccauuguccgggaagccaucaaaagaggacugcgcacgcucauucuggcuccgacccgggugguugccgcugagauggaagaggcccuuagaggccugcccauccgcuaucagaccccugcgauucgggccgagcauaccgggagagaaaucguggaccucaugugucacgcuaccuuuacaaugcggcugcucagccccguccgcgugccuaacuacaaucugaucauuauggaugaggcccacuucacggaccccgcuuccaucgccgccagaggcuauauuucuacccggguugaaaugggagaggcugcgggcaucuuuaugacagccaccccgccugggagccgcgaucccuucccccaguccaacgcuccuauuauggacgaggaaagagagauccccgaacggagcuggaacucuggacaugagugggugacagauuuuaagggcaagaccgucugguucgugccuuccaucaaagccgggaacgacauugccgcuugccuuagaaagaauggcaagaagguuauccaacugagccgcaaaacguuugauucugaauacgugaagacacgggccaacgacugggauuucgucgugaccaccgacauuagcgagaugggcgcgaauuuuagagcugagcgcgugaucgauccgcggagauguaugaagcccgucauucugacagacggggaggaacgcguuauccucgccggcccuaugcccgugacccacuccucugccgcucagcggagaggacgcaucggcagaaacccuaaaaaugaaaacgaccaguauauuuacaugggggagccccuggaaaaugaugaggacugcgcccauuggaaggaggcgaaaaugcuucuggauaacaucaauacaccggaaggaauuaucccuagcauguucgagcccgaacgggagaagguggacgccauugauggcgaauaccgccucagaggggaggcucggaaaaccuuugucgaccugaugcgcagaggagaucugccuguguggcucgccuaucggguugcugccgagggcaucaacuacgcugacagacgcugguguuucgaugggauuaagaauaaccaaauccuugaagagaacguggaagucgagaucuggacgaaagagggcgaacggaagaagcugaaacccagauggcuggacgcccgcauuuauuccgauccucucgcgcugaaggaguucaaagaauuugccgcuggacggaagucucuuacacugaaucucaucaccgagaugggcagacugcccacauucaugacccagaaagcccgggacgcucuggauaaccucgccgugcuucacacggccgaaguugggggacgcgcuuacaaucacgcgcugagcgagcugccggagacccucgaaacacugcuucugcucacccugcuggccacagugaccggcgggauuuuucucuuccuuauguccggaaagggcaucggcaagaugacacuggggaugugcugcauuaucaccgcuagcauccugcucugguaugcccagauucagccucauuggaucgccgcuucuauuauccuggaguuuuuccuuauuguccugcucauccccgaacccgagaaacaaagaacgccucaggacaaccagcugacauacguggucaucgccauucugaccgugguugcggccaccauggcuaaugaaaugggauuucucgagaagaccaaaaaggaccuuggccugggguccaucaccacacaggagagcgaauccaacauucuggauaucgaccuccggccggccucugcuuggacgcuguaugccguggcgaccacauucgugacccccaugcuucgccacagcauugaaaauagcucugucaacguuagccugacagccaucgcuaaucaagccaccgugcucaugggacugggcagaggguggccucuguccaaaauggauauuggagugccccuccuugcuaucggcuguuacagccaggucaacccuaucacgcugaccgccgcucugcuccugcuuguggcccauuacgcgauuaucggccccgggcugcaggccaaggcuacacgggaagcccagaagcgcaccgcugccggaauuaugaaaaauccuacaguugacggcaucaccgugauugaucucgagccgauccccuaugacccuaaguuugaaaaacaacuggggcaggucaugcugcucgugcuuugcgucacacaggugcugaugaugagaacaaccugggcccugugugaggcgcucacacuggcuaccggacccaucucuacccuuugggagggcaacccugggcgguucuggaauacaacgauugccguuuccauggcuaacaucuuucgcggaagcuaccuggccggcgccggccuccuguucucuauuaugaagaauaccacaaacaccagacgggggacaggaaauaucggcgaaacccugggggagaaauggaaguccagacucaacgcucuuggaaagagcgaauuucagauuuauaaaaagucuggcauccaagagguggaucgcacgcuggccaaagaggggaucaagcggggagaaacagaccaccaugcggucagcagaggcuccgccaaacugcgcugguucguggagcggaacaugguuacccccgaaggcaagguggucgaucucgggugcggaagaggcggguggucuuacuauuguggaggccugaaaaaugugcgcgaggugaaggggcuuaccaagggaggcccgggccacgaggagccuauucccaugagcacauacggguggaaccugguucggcuccaguccggagucgacguguucuuuacacccccugagaaaugcgauacacugcugugugacaucggcgaaagcucccccaauccuacgauugaggcugggagaacccuccgcgugcuuaaccuggucgaaaauuggcugaacaauaacacacaguucugcaucaagguucucaauccguauaugcccucugugauugagaaaauggaaacccugcaacggaaguacggaggcgcccuugugagaaacccucugagccgcaauuccacacacgagauguacugggucucuaacgcuaccgggaauaucgugagcuccguuaacaugaucucucggaugcucauuaauagauuuacgaugaaacauaagaaggccaccuaugagcccgauguggaccugggaagcggcacacgcaacaucggcauugaaaacgagaucccuaaucuggacauuaucgggaaaagaauugaaaagaucaaacaggagcacgaaaccuccuggcauuacgaucaggaccaccccuauaagacaugggcguaccacggaagcuaugagaccaaacagacaggcucugccuccagcauggucaacggggugguuaagcuccuuaccaagccgugggauguggucccuauggugacgcaaauggcuaugacagacaccacccccuucggacagcagcggguguuuaaagagaaggucgauacacgcacgcaggaaccuaaagagggcaccaagaaacugaugagaaucacagccgaauggcuguggaaggagcucgggaagaaaaagacaccccggauguguacaagagaggaguucacccggaaaguucgcucuaaugcugcccugggagcuauuuuuacagacgagaacaaguggaaauccgccagagaagcgguggaggauagccgguucugggaacuuguggaccgcgagagaaaucugcaucucgagggcaagugcgaaaccugugucuacaacaugaugggcaaacgggagaagaagcugggggaauuuggaaaagccaagggcucucgcgcuaucugguauauguggcugggggccagauuccucgaguuugaagcucugggauuccuuaaugaggaucacugguuuucccggggcaacagccuguccgggguggagggcgaaggacuccauaaacugggcuacauucuucgcgacguuagcaagaaagaagggggagccauguacgccgaugacacggcgggcugggacaccagaaucacacuggaagaucucaagaaugaggaaauggugaccaaccacaugaagggggagcauaaaaagcuggcugaggccauuuucaaacugacauaucaaaauaaggucgugcggguucagcgcccuacccccagaggaacggugauggacaucaucucucggaaagaucagcgcggcagcgggcaggucggcacauacggacucaacaccuucacaaauauggaagcccaacugauuagacagauggagggcgaagggaucuuuaaguccauucagcggcuuaccgugacggaggagaucgcuguucaaaacuggcuggccagagugggacgcgaacggcucucuagaauggcuauuagcggcgacgauugcgucgugaagccgcuggacgaucgcuucgccuccgcgcuuaccgcccugaaugacauggggaaaguccggaaggauauccagcagugggagccuucuagaggauggaacgacuggacacaggugcccuuuugcagccaccacuuccaugaacucguuaugaaagauggccgcgugcuggucgugcccugucggaaccaagacgagcugaucgggagagcucgcauuucccagggcgccggauggucucucaaggaaaccgcuugccugggcaaaagcuaugcccagauguggacacuuauguacuuucaccggagagaucugcgccucgcggccaaugcuaucuguuccgccgugccuagccauuggguuccgaccucucggacaaccugguccauucacgcuaagcacgaguggaugacgacagaggacaugcuggccguguggaacagagucuggauccaggaaaaucccuggauggaggacaagaccccuguggaaagcugggaggaaguucccuaucuugggaaacgggaggaucaauggugcggaucucugauuggccucaccuccagagcuacaugggccaagaacauccagaccgcgauuaaucaggugcgcagccugaucgggaacgaggaauacacagacuauaugccuuccaugaaacgguucagaaaggaggaagaggaagccggaguccugugguga

SEQ ID NO: 19965 - RNA, 9876 nt, Artificial Sequence
  derived and/or modified CDS sequence (opt5) from DENV-2__EU687231__SS-prME
accgccggcgugaucauuaugcugauccccaccgcuauggccuuccaccucacgacccggaauggggagccucauaugauugucggacggcaggaaaagggcaagagccugcuuuuuaagacggaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagaucaaaucuugccacuggccuaagagccauacccugugguccaaugggguucuugaaagcgagaugauuauccccaaaaacuucgcuggaccggugucucagcacaacuaccgcccuggcuaucauacgcagacagccgggcccuggcaccucggaaagcuggaaauggauuuugacuucugugagggcaccaccgucguggugacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucgucaauucucugguuaccgccggccaugggcaaaucgauaacuuuagccugggagugcuuggcauggcccucuuccuggaagagaugcugagaacacgcguggggaccaaacacgcuauucuccuggucgcgguguccuuuguuacgcuuaucaccggaaauaugucuuuccgggaccugggcagagugauggucauggugggcgccacaaugaccgaugacauugggaugggaguuacauaucucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauccuggagcucaccgaugcccuggcccugggaaugaugguccuuaaaauugugcggaacauggaaaaguaccagcuggcuguuaccaucauggccauuagcugcgugccuaaugcggucauccuccaaaacgcuuggaagguguccuguacaauucuggccgccgugagcgucucuccccuccugcuuacguccagccagcagaaagcugacuggaucccucuggcccucaccaucaagggccugaaucccacagcuauuuuucugaccacacuuucucgcaccuccaaaaagagaagcuggccgcugaacgaggccguuauggcgguggggauggugucuauccucgccuccagccugcucaaaaaugacauuccuaugacgggaccccuggucgcuggcggccuucugacagugugcuauguucugaccgggcgguccgccgaucucgaacuggagcgcgcugccgacgugaagugggaggaucaggccgaaaucagcggaucuagcccuauucuuuccaucaccauuucugaggacggcagcauguccaucaaaaacgaagaggaggaacacacacugaccauccucauuagaacagggcugcucgucaucucuggaguguuccccguuagcauuccgaucacggcugcggccugguaccugugggaggugaagaagcaacgggcuggcguccuuugggaugugccuucucccccucccgucgggaaagccgaacuggaggacggagccuaucgcauuaagcagagaggcaucuuuggcuacagccagaucggggcuggaguguauaaagaaggcaccuuccauacaauguggcacguuaccagaggggccgugcugaugcaucgcggaaagagaauugagcccagcugggcggaugucaaaaaggaccucaucuccuacggcgggggauggaagcuggagggcgaauggaaagagggcgaagaggugcagguucuugcucuggaaccugggaagaauccgcgggccgugcaaacaaaacccggacucuuuaagaccaacacgggcaccauuggggccgucagccuggauuucucuccuggaacauccggcagccccaucguggacagaaaagggaaggugguuggacucuacggcaauggcgucgugacccgcucuggggcuuauguguccgccauugcgcagacagaaaagagcaucgaggauaacccugaaaucgaggacgauauuuuccggaaaaagagacugaccaucauggaccuucaccccggagcuggcaaaacaaagcgcuaccugccugccauuguccgggaagccaucaaaagagggcugcgcacgcucauucuggcuccgacccgggugguugccgcugagauggaagaggcccuuagaggacugcccauccgcuaucagaccccugcgauucgggccgagcauaccggcagagaaaucguggaccucaugugucacgcuaccuuuacaaugcggcugcucucccccguccgcgugccuaacuacaaucugaucauuauggaugaggcccacuucacggaccccgcuucuaucgccgccagaggguauauuagcacccggguugaaaugggcgaggcugcgggaaucuuuaugacagccaccccgccuggcucccgcgaucccuucccccagagcaacgcuccuauuauggacgaggaaagagagauccccgaacggucuuggaacuccgggcaugagugggugacagauuuuaagggaaagaccgucugguucgugccuagcaucaaagccggcaacgacauugccgcuugccuuagaaagaaugggaaaaagguuauccaacugucucgcaaaacguuugauagcgaauacgugaagacacgggccaacgacugggauuucgucgugaccaccgacauuuccgagaugggagcgaauuuuagagcugagcgcgugaucgauccgcggagauguaugaagcccgucauucugacagacggcgaggaacgcguuauccucgccgggccuaugcccgugacccacucuagcgccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauacaccggaagggauuaucccuuccauguucgagcccgaacgggagaagguggacgccauugauggagaauaccgccucagaggcgaggcucggaaaaccuuugucgaccugaugcgcagaggggaucugccuguguggcucgccuaucggguugcugccgagggaaucaacuacgcugacagacgcugguguuucgauggcauuaagaauaaccaaauccuugaagagaacguggaagucgagaucuggacgaaagagggggaacggaagaagcugaaacccagauggcuggacgcccgcauuuauucugauccucucgcgcugaaggaguucaaagaauuugccgcuggccggaagucccuuacacugaaucucaucaccgagaugggaagacugcccacauucaugacccagaaagcccgggacgcucuggauaaccucgccgugcuucacacggccgaaguuggcgggcgcgcuuacaaucacgcgcuguccgagcugccggagacccucgaaacacugcuucugcucacccugcuggccacagugaccggaggcauuuuucucuuccuuaugagcgggaagggaaucggcaagaugacacugggcaugugcugcauuaucaccgcuucuauccugcucugguaugcccagauucagccucauuggaucgccgcuuccauuauccuggaguuuuuccuuauuguccugcucauccccgaacccgagaaacaaagaacgccucaggacaaccagcugacauacguggucaucgccauucugaccgugguugcggccaccauggcuaaugaaaugggguuucucgagaagaccaagaaggaccuuggacugggcagcaucaccacacaggaguccgaaucuaacauucuggauaucgaccuccggccggccagcgcuuggacgcuguaugccguggcgaccacauucgugacccccaugcuucgccacuccauugaaaauucuagcgucaacguuucccugacagccaucgcuaaucaagccaccgugcucauggggcugggaagaggcuggccucugagcaaaauggauauuggggugccccuccuugcuaucggauguuacucucaggucaacccuaucacgcugaccgccgcucugcuccugcuuguggcccauuacgcgauuaucggccccggccugcaggccaaggcuacacgggaagcccagaagcgcaccgcugccgggauuaugaaaaauccuacaguugacggaaucaccgugauugaucucgagccgauccccuaugacccuaaguuugaaaaacaacugggccaggucaugcugcucgugcuuugcgucacacaggugcugaugaugagaacaaccugggcccugugugaggcgcucacacuggcuaccgggcccaucuccacccuuugggagggaaacccuggccgguucuggaauacaacgauugccguuagcauggcuaacaucuuucgcgggucuuaccuggccggagccggccuccuguucuccauuaugaagaauaccacaaacaccagacggggcacagggaauaucggagaaacccugggcgagaaauggaaaagcagacucaacgcucuugggaagucugaauuucagauuuauaaaaagagcggaauccaagagguggaucgcacgcuggccaaagagggcaucaagagaggggaaacagaccaccaugcggucuccagaggaucugccaaacugcgcugguucguggagcggaacaugguuacccccgaaggcaagguggucgaucucggcugcgggagaggaggcuggagcuacuauugugggggacugaaaaaugugcgcgaggugaagggccuuaccaaagggggaccgggccacgaggagccuauucccauguccacauacggcuggaaccugguucggcuccagagcggggucgacguguucuuuacacccccugagaaaugcgauacacugcugugugacaucggagaauccucucccaauccuacgauugaggcuggcagaacccuccgcgugcuuaaccuggucgaaaauuggcugaacaauaacacacaguucugcaucaagguucucaauccguauaugcccagcgugauugagaaaauggaaacccugcaacggaaguacgggggagcccuugugagaaacccucugucccgcaauucuacacacgagauguacugggucagcaacgcuaccggcaauaucguguccucuguuaacaugaucagccggaugcucauuaauagauuuacgaugaaacauaagaaggccaccuaugagcccgauguggaccugggguccggaacacgcaacaucggcauugaaaacgagaucccuaaucuggacauuaucggcaaaagaauugaaaacaucaagcaggagcacgaaaccagcuggcauuacgaucaggaccaccccuauaaaacaugggcguaccacgggucuuaugagaccaagcagacaggauccgccagcucuauggucaauggcgugguuaaacuccuuaccaagccgugggauguggucccuauggugacgcaaauggcuaugacagacaccacccccuucgggcagcagcggguguuuaaggagaaagucgauacacgcacgcaggaaccuaaggagggaaccaaaaagcugaugagaaucacagccgaauggcuguggaaagagcucggcaagaagaaaacaccccggauguguacaagagaggaguucacccggaagguucgcuccaacgcugcccugggggcuauuuuuacagacgagaauaaauggaaaagcgccagagaagcgguggaggauucucgguucugggaacuuguggaccgcgagagaaaccugcaucucgagggaaaaugcgaaaccugugucuacaauaugaugggcaagcgggagaaaaagcugggcgaauuugggaaggccaaaggaucccgcgcuaucugguauauguggcugggcgccagauuccucgaguuugaagcucugggguuccuuaacgaggaucacugguuuagccggggaaauucccugagcggcguggagggggaaggccuccauaagcugggauacauucuucgcgacguuucuaaaaaggagggcggggccauguacgccgaugacacggcgggaugggacaccagaaucacacuggaagaucucaaaaacgaggaaauggugaccaaucacaugaagggcgagcauaagaaacuggcugaggccauuuucaagcugacauaucaaaacaaagucgugcggguucagcgcccuacccccagagggacggugauggacaucaucagccggaaggaucagcgcggauccggccaggucgggacauacggccucaauaccuucacaaacauggaagcccaacugauuagacagauggagggagaaggcaucuuuaaaucuauucagcggcuuaccgugacggaggagaucgcuguucaaaauuggcuggccagaguggggcgcgaacggcucagcagaauggcuauuuccggagacgauugcgucgugaagccgcuggacgaucgcuucgccucugcgcuuaccgcccugaacgacaugggcaagguccggaaagauauccagcagugggagccuagcagaggguggaacgacuggacacaggugcccuuuugcucccaccacuuccaugaacucguuaugaaggauggacgcgugcuggucgugcccugucggaaucaagacgagcugaucggcagagcucgcauuucucagggggccggcuggagccucaaagaaaccgcuugccugggaaaguccuaugcccagauguggacacuuauguacuuucaccggagagaucugcgccucgcggccaacgcuaucuguagcgccgugccuucucauuggguuccgaccucccggacaaccuggagcauucacgcuaaacacgaguggaugacgacagaggacaugcuggccguguggaauagagucuggauccaggaaaaccccuggauggaggacaagaccccuguggaaucuugggaggaaguucccuaucuuggcaagcgggaggaucaauggugcgggucccugauuggacucaccagcagagcuacaugggccaaaaauauccagaccgcgauuaaccaggugcgcucccugaucggcaaugaggaauacacagacuauaugccuucuaugaagcgguucagaaaagaggaagaggaagccgggguccugugguga

SEQ ID NO: 19966 - RNA, 9876 nt, Artificial Sequence
  derived and/or modified CDS sequence (opt5) from DENV-2__EU687199__SS-prME
accgccggagugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaaugauggaucuggagaaacgccauguccugggccggcucauuaccgugaacccuaucguuacagaaaaggacagcccggugaacauugaggccgaacccccuuuuggggauucuuacaucauuaucggcgucgagcccggacagcugaaacuuaauugguucaagaagggcuccagcaucgggcagauguuugagaccacaaugagaggagcuaaacgcauggccauucugggcgacaccgccugggauuucgggucucucggaggcguguuuacgagcaucgggaaggcucugcaccaaguuuucggcgccauuuacggagcggcuuuuuccggcgugucuuggacaaugaaaauccugauuggggucaucaucaccuggauuggaaugaacagccgguccaccagccuuucugugucccucgugcugguuggcgucgugacacuguaucucggggugaugguccaggccgacaccggaugugugguuagcuggaagaauaaagaacugaagugcggcucugggaucuucauuacagauaacgugcacacguggaccgagcaguacaaguuucagccugaaucccccagcaaacuugccuccgcuauccaaaaggcccaugaggaaggcauuuguggaaucagaucugucacacgccuggagaaucucauguggaaacagaucaccccggagcugaaccacauucugagcgaaaaugaggugaaacuuacaaucaugaccggcgacauuaaagggaucaugcaggcuggaaagcggucccucagaccucagcccacggaacugaaauauucuuggaagaccuggggcaaggccaaaaugcugagcacagagucccauaaccaaaccuuccucauugaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccaucaaagacaauagagcugugcacgccgauaugggcuauuggauugaaucugcgcugaacgacaccuggaagauggagaaggccuccuucaucgagauuaaaagcugccacuggccuaagucucauacgcuguggagcaaugggguucuugaauccgagaugaucauucccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucaucacagaguggugcugucggagcugcacccugccuccgcuucgcuacagaggcgaggacggguguugguacggaauggaaauucggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauccuccuggucgcggugagcuuuguuacccuuauuacaggaaauauguccuuccgggaccugggcagagugauggucauggugggcgccaccaugacagaugacaucgggaugggaguuaccuaucucgcucugcuggccgccuuuaaggugcgcccuacguucgcugccggccuucugcucagaaaacugacaucuaaggagcucaugauggcgaccauugggaucgcucugcuuagccaguccacaauucccgaaaccauccuggagcucaccgaugcccuggcccugggaaugaugguccuuaaaaucgugcggaacauggaaaaguaccagcuggcuguuacaauuauggccaucucuugcgugccuaaugcggucauucuccaaaacgcuuggaaggugagcuguacgauccuggccgccguguccgucagcccccuccugcuuaccucuucccagcagaaagcugacuggauuccucuggcccucacaaucaagggccugaaucccaccgcuaucuuucugacaacccuuagccgcacgucuaaaaagagauccuggccgcugaacgaggccguuauggcgguggggauggugagcauucucgccucuucccugcucaaaaaugacaucccuaugacaggaccccuggucgcuggcggccuucugaccgugugcuauguucugaccgggcggagcgccgaucucgaacuggagcgcgcugccgacgugaagugggaggaucaggccgaaauuuccggaagcucuccuauccuuagcauuacaaucuccgaggacggcucuaugagcauuaaaaacgaagaggaggaacacacccugacaauccucaucagaacggggcugcucgucauuuccggaguguuccccguuucuaucccgauuaccgcugcggccugguaccugugggaggugaagaagcaacgggcuggcguccuuugggaugugccuucucccccucccgucgggaaagccgaacuggaggacggagccuaucgcaucaagcagagaggcauuuuuggcuacucccagaucggggcuggaguguauaaagaaggcacauuccauaccauguggcacguuacaagaggggccgugcugaugcaucgcggaaagagaaucgagcccuccugggcggaugucaaaaaggaccucauuagcuacggcgggggauggaagcuggagggcgaauggaaagagggcgaagaggugcagguucuugcucuggaaccugggaagaauccgcgggccgugcaaaccaaacccggacucuuuaagacgaacaccggcacaaucggggccgucucccuggauuucagcccuggaaccucuggcucccccauuguggacagaaaagggaaggugguuggacucuacggcaauggcgucgugacacgcagcggggcuuaugugucugccaucgcgcagaccgagaaguccauugaggauaacccugaaaucgaggacgauaucuuccggaaaaagagacugacaauuauggaccuucaccccggagcuggcaaaacgaagcgcuaccugccugccaucguccgggaagccauuaaaagagggcugcgcacccucauccuggcuccgacacgggugguugccgcugagauggaagaggcccuuagaggacugcccauucgcuaucagaccccugcgauccgggccgagcauaccggcagagaaauuguggaccucaugugucacgcuacauuuacgaugcggcugcucagccccguccgcgugccuaacuacaaucugaucaucauggaugaggcccacuucaccgaccccgcuuccauugccgccagaggguauaucucuacacggguugaaaugggcgaggcugcgggaauuuuuaugaccgccacaccgccuggcagccgcgaucccuucccccaguccaacgcuccuaucauggacgaggaaagagagauucccgaacggagcuggaacucugggcaugagugggugaccgauuuuaagggaaagacggucugguucgugccuuccaucaaagccggcaacgacaucgccgcuugccuuagaaagaaugggaaaaagguuauucaacugagccgcaaaacauuugauucugaauacgugaagacccgggccaacgacugggauuucgucgugaccacagacaucagcgagaugggagcgaauuuuagagcugagcgcgugauugauccgcggagauguaugaagcccgucauccugaccgacggcgaggaacgcguuauucucgccgggccuaugcccgugacacacuccucugccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauaccccggaagggaucauuccuagcauguucgagcccgaacgggagaagguggacgccaucgauggagaauaccgccucagaggcgaggcucggaaaacguuugucgaccugaugcgcagaggggaucugccuguguggcucgccuaucggguugcugccgagggaauuaacuacgcugacagacgcugguguuucgauggcaucaagaauaaccaaauucuugaagagaacguggaagucgagaucuggacaaaagagggggaacggaagaagcugaaacccagauggcuggacgcccgcaucuauuccgauccucucgcgcugaaggaguucaaagaauuugccgcuggccggaagucucuuacccugaaucucauuacagagaugggaagacugcccaccuucaugacgcagaaagcccgggacgcucuggauaaccucgccgugcuucacaccgccgaaguuggcgggcgcgcuuacaaucacgcgcugagcgagcugccggagacacucgaaacccugcuucugcucacacugcuggccaccgugacaggaggcaucuuucucuuccuuauguccgggaagggaauuggcaagaugacccugggcaugugcugcaucauuacggcuagcauccugcucugguaugcccagauccagccucauuggauugccgcuucuaucauucuggaguuuuuccuuaucguccugcucauucccgaacccgagaaacaaagaacaccucaggacaaccagcugaccuacguggucaucgccauccugaccgugguugcggccacaauggcuaaugaaaugggguuucucgagaagaccaaaaaggaccuuggacugggcuccauuacaacgcaggagagcgaauccaacauccuggauauugaccuccggccggccucugcuuggacccuguaugccguggcgacaaccuucgugacacccaugcuucgccacagcaucgaaaauagcucugucaacguuagccugaccgccauugcuaaucaagccacggugcucauggggcugggaagaggcuggccucuguccaaaauggauaucggggugccccuccuugcuauuggauguuacagccaggucaacccuaucacccugacagccgcucugcuccugcuuguggcccauuacgcgaucauuggccccggccugcaggccaaggcuacccgggaagcccagaagcgcacagcugccgggaucaugaaaaauccuaccguugacggaauuacggugaucgaucucgagccgauucccuaugacccuaaguuugaaaaacaacugggccaggucaugcugcucgugcuuugcgucacacaggugcugaugaugagaaccacaugggcccugugugaggcgcucacccuggcuaccgggcccaucucuacacuuugggagggaaacccuggccgguucuggaauacgaccaucgccguuuccauggcuaacauuuuucgcgggagcuaccuggccggagccggccuccuguucucuaucaugaagaauacaaccaacacaagacggggcaccgggaauauuggagaaacgcugggcgagaaauggaaguccagacucaacgcucuuggaaagagcgaauuucagaucuauaaaaagucuggcauucaagagguggaucgcacacuggccaaagagggcaucaagagaggggaaaccgaccaccaugcggucagcagaggauccgccaaacugcgcugguucguggagcggaacaugguuacccccgaaggcaagguggucgaucucggcugcgggagaggaggcuggucuuacuauugugggggacugaaaaaugugcgcgaggugaagggccuuacaaaagggggaccgggccacgaggagccuauccccaugagcaccuacggcuggaaccugguucggcuccaguccggggucgacguguucuuuacacccccugagaaaugcgauacgcugcugugugacauuggagaaagcucccccaauccuaccaucgaggcuggcagaacacuccgcgugcuuaaccuggucgaaaauuggcugaacaauaacacccaguucugcguuaaggugcucaauccguauaugcccucugugauugagaaaauggaaacacugcaacggaaguacgggggagcccuugucagaaacccucugagccgcaauuccacccacgagauguacugggugucuaacgcuacgggcaauaucguuagcuccgugaacaugauuucucggaugcucaucaauagauuuaccaugaaacauaagaaggccacauaugagcccgaugucgaccuggggagcggaacccgcaacaucggcauugaaaacgagaucccuaaucuggacauuaucggcaaaagaauugaaaagaucaaacaggagcacgaaacauccuggcauuacgaucaggaccaccccuauaagaccugggcguaccacgggagcuaugagacaaaacagaccggaucugccuccagcauggugaacggcguugugaagcuccuuacgaagccgugggaugucgugccuauggugacacaaauggcuaugaccgacaccacacccuucgggcagcagcgggucuuuaaagagaagguugauacgcgcacccaggaaccuaaagagggaacaaagaaacugaugagaauuaccgccgaauggcuguggaaggagcucggcaagaaaaagacaccccggauguguaccagagaggaguucacacggaaagugcgcucuaaugcugcccugggggcuaucuuuaccgacgagaacaaguggaaauccgccagagaagcgguggaggauagccgguucugggaacuugucgaccgcgagagaaaucugcaucucgagggaaagugcgaaacguguguguacaacaugaugggcaaacgggagaagaagcugggcgaauuugggaaagccaagggaucucgcgcuaucugguauauguggcugggcgccagauuccucgaguuugaagcucugggguuccuuaaugaggaucacugguuuucccggggaaacagccuguccggcguugagggggaaggccuccauaaacugggauacauucuucgcgacgugagcaagaaagagggcggggccauguacgccgaugacaccgcgggaugggacacaagaaucacccuggaagaucucaagaaugaggaaauggucacaaaccacaugaagggcgagcauaaaaagcuggcugaggccauuuucaaacugaccuaucaaaauaaggugguucgggugcagcgcccuacgcccagagggacagucauggacaucauuucucggaaagaucagcgcggaagcggccagguggggaccuacggccucaacacauucaccaauauggaagcccaacugaucagacagauggagggagaaggcaucuuuaaguccauucagcggcuuacgguuaccgaggagaucgcugugcaaaacuggcuggccagagucgggcgcgaacggcucucuagaauggcuauuagcggagacgauugcguggucaagccgcuggacgaucgcuucgccuccgcgcuuacagcccugaaugacaugggcaaagugcggaaggauauccagcagugggagccuucuagaggguggaacgacuggacccagguucccuuuugcagccaccacuuccaugaacucgugaugaaagauggacgcguccugguggugcccugucggaaccaagacgagcugauuggcagagcucgcaucucccagggggccggcuggucucucaaggaaacagcuugccugggaaaaagcuaugcccagauguggacccuuauguacuuucaccggagagaucugcgccucgcggccaaugcuaucuguuccgccguuccuagccauugggugccgacaucucggaccacgugguccauucacgcuaagcacgaguggaugacaaccgaggacaugcuggccgucuggaacagaguguggauccaggaaaaucccuggauggaggacaagaccccuguugaaagcugggaggaagugcccuaucuuggcaaacgggaggaucaauggugcgggucucugauuggacucacauccagagcuaccugggccaagaacauccagacagcgauuaaucagguccgcagccugaucggcaacgaggaauacacggacuauaugccuuccaugaaacgguucagaaaggaggaagaggaagccggggugcugugguga

SEQ ID NO: 19967 - RNA, 9876 nt, Artificial Sequence
  derived and/or modified CDS sequence (opt5) from DENV-2__EU687235__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccccuucugcgccaaaacgaacccgaggauaucgacuguuggugcaauagcacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagacagccgguguccgacccaaggagagcccucucugaaugaggaacaggauaaacgcuuuauuugcaagcauuccaugguggacagaggcuggggcaacggguguggacuguucggcaaaggcgggaucgugacaugcgccauguuuacgugcaaaaagaauauggaggggaaagucguucucccugaaaaccuggaguacaccauugugaucacaccccacagcggggaagaacaugcggugggaaaugauaccggcaagcacggcaaagagaucaagauuacaccucagucuuccaucaccgaagccgagcuuacgggguauggaaccgucacaauggaauguagcccccggaccggccuggacuucaacgagauggugcuccugcagauggaagauaaggcuuggcuuguucaccgccaaugguuucuggaccucccgcugccuuggcugcccggggccgacacacagggaucuaauuggauucagaaggagacccucgugacguucaagaacccucaugcuaaaaagcaggaugucgugguucugggcucccaagagggggccaugcacacagcccuuaccggcgcuacagaaauccagaugagcuccggaaaucugcucuuuaccggccaucugaaaugcagacuucggauggacaagcugcagcucaaagggaugucuuacagcauguguaccggaaaguucaagauugugaaagagaucgcggaaacacaacacggcacgaucgucauuagagugcaguaugagggggauggaucccccugcaagauccccuucgagauuauggaccuggaaaaacgccauguccugggccggcucaucaccgugaacccuauuguuacagagaaggauagcccggugaacaucgaagccgagcccccuuuuggggacucuuacauuaucaucggcgucgaacccggacagcugaaacuuaauugguucaagaagggcuccagcauugggcagauguuugagaccacaaugagaggagcuaaacgcauggccauccugggcgauaccgccugggacuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgauaccggaugugugguuagcuggaagaauaaagagcugaagugcggcucugggauuuucaucacagacaacgugcacacguggaccgaacaguacaaguuucagccugagucccccagcaaacuugccuccgcuauucaaaaggcccaugaagagggcaucuguggaaucagaucugucacacgccuggaaaaucucauguggaaacagauuaccccggagcugaaccacauccugagcgagaaugaagugaaacuuacaauuaugaccggcgauaucaaagggauuaugcaggcuggaaagcggucccucagaccucagcccacggagcugaaauauucuuggaagaccuggggcaaggccaaaaugcugagcacagaaucccauaaccaaaccuuccucaucgacgggccugagacagcggaaugccccaauaccaaccgcgccuggaauagccuggagguugaggacuacggauuuggcguguucucuacaaacaucuggcuuaagcugcgggaaaaacaggaugucuuuugugacuccaagcucaugagcgcugccauuaaagauaauagagcugugcacgccgacaugggcuauuggaucgagucugcgcugaacgauaccuggaagauggaaaaggccuccuucauugagaucaaaagcugccacuggccuaagucucauacgcuguggagcaaugggguucuugaguccgaaaugauuauccccaaaaacuucgcuggaccggugagccagcacaacuaccgcccuggcuaucauacacagaccgccgggcccuggcaccucggaaagcuggagauggacuuugauuucugugaaggcaccacagucguggugaccgaggacugcgggaaucggggacccucucugagaacgacaaccgcuuccggcaaacucauuacagaauggugcugucggagcugcacccugccuccgcuucgcuacagaggcgaggauggguguugguacggaauggagauccggccccugaaggaaaaggaggaaaaccucgucaauucccugguuacagccggccaugggcaaaucgacaacuuuucucugggagugcuuggcauggcccucuuccuggaggaaaugcugagaacccgcguggggacgaaacacgcuauucuccuggucgcggugagcuuuguuacccuuaucacaggaaauauguccuuccgggaucugggcagagugauggucauggugggcgccaccaugacagacgauauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgagaccauccuggaacucaccgacgcccuggcccugggaaugaugguccuuaaaauugugcggaacauggagaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaagccguuauggcgguggggauggugagcauccucgccucuucccugcucaaaaaugauauuccuaugacaggaccccuggucgcuggcggccuucugaccgugugcuauguucugaccgggcggagcgccgaccucgagcuggaacgcgcugccgaugugaagugggaggaccaggccgagaucuccggaagcucuccuauucuuagcaucacaauuuccgaagauggcucuaugagcaucaaaaacgaggaagaggagcacacccugacaauccucauuagaacggggcugcucgucaucuccggaguguuccccguuucuauuccgaucaccgcugcggccugguaccugugggaagugaagaagcaacgggcuggcguccuuugggacgugccuucucccccucuggucgggaaagccgagcuggaagauggagccuaucgcauuaagcagagaggcaucuuuggcuacucccagaucggggcuggaguguauaaagagggcacauuccauaccauguggcacguuacaagaggggccgugcucaugcaucgcggaaagagaauugaacccuccugggcggacgucaaaaaggaucugaucagcuacggcgggggauggaaacuugagggcgaguggaaagaaggcgaggaagugcagguucuggcucucgagcccgggaagaauccucgggccgugcaaaccaaaccgggacuguuuaagacgaacaccggcacaauuggggccgucucccucgacuucagccccggaaccucuggcuccccuaucguggauagaaaagggaaggugguuggacuguacggcaauggcgucgugacacgcagcggggcuuaugugucugccauugcgcagaccgaaaaguccaucgaggacaaccccgagaucgaagaugacauuuuccggaaaaagagacuuacaaucauggaccugcacccuggagcuggcaaaacgaagcgcuaccugcccgccauuguccgggaggccaucaaaagagggcuccgcacccugauucuugcuccuacacgggugguugccgcugaaauggaggaagcccugagaggacucccgauccgcuaucagacccccgcgauucgggccgagcauaccggcagagagaucguggaucugaugugucacgcuacauuuacgaugcggcuccugagcccuguccgcgugcccaacuacaaucuuaucauuauggacgaagcccacuucaccgauccugcuuccaucgccgccagaggguauauuucuacacggguugagaugggcgaagcugcgggaaucuuuaugaccgccacacccccgggcagccgcgacccuuucccccaguccaacgcucccauuauggaugaggagagagaaaucccugagcggagcuggaacucugggcaugaaugggugaccgacuuuaagggaaagacggucugguucgugcccuccaucaaagccggcaacgauauugccgcuugccugagaaagaaugggaaaaagguuauccaacugagccgcaaaacauuugacucugaguacgugaagacccgggccaacgauugggacuucgucgugaccacagauauuagcgaaaugggagcgaauuuuagagcugagcgcgugaucgacccucggagauguaugaagccggucauucucaccgacggcgaggaacgcguuauccuggccgggcccaugccugugacacacuccucugccgcucagcggagaggccgcaucggaagaaaccccaaaaaugagaacgaucaguauauuuacaugggcgaaccucuugagaaugacgaagauugcgcccauuggaaggaggcgaaaaugcugcucgacaacaucaauacccccgaggggauuaucccgagcauguucgaaccugagcgggaaaagguggaugccauugacggagaguaccgccugagaggcgaagcucggaaaacguuugucgaucugaugcgcagaggggaccuccccguguggcuugccuaucggguugcugccgagggaaucaacuacgcugauagacgcugguguuucgacggcauuaagaauaaccaaauccuggaggaaaacguggaggucgaaaucuggacaaaagagggggagcggaagaagcugaaaccuagauggcucgaugcccgcauuuauuccgacccccuggcgcuuaaggaguucaaagaguuugccgcuggccggaagucucugacccucaaucugaucacagaaaugggaagacugccuaccuucaugacgcagaaagcccgggaugcucucgacaaccuugccgugcugcacaccgccgagguuggcgggcgcgcuuacaaucacgcgcugagcgaacuccccgagacacuggagacccuucugcuccugacacugcucgccaccgugacaggaggcauuuuucuuuuccugauguccgggaagggaaucggcaagaugacccugggcaugugcugcauuaucacggcuagcauccuccugugguaugcccagauucagccgcauuggaucgccgcuucuauuauccuugaauuuuuccugauuguccuccugaucccugagcccgaaaaacaaagaacaccccaggacaaccagcugaccuacguggucaucgccauucucaccgugguugcggccacaauggcuaaugagaugggguuucuugaaaagaccaaaaaggaucugggacugggcuccaucacaacgcaggagagcgaguccaacauucucgacaucgaucugcggccugccucugcuuggacccuuuaugccguggcgacaaccuucgugacaccgaugcugcgccacagcauugaaaauuccucugucaacguuagccucaccgccaucgcuaaucaagccacggugcugauggggcugggaagaggcuggccccucuccaaaauggacauuggggugccucuucuggcuaucggauguuacagccaggucaaccccaucacccugacagccgcucuccugcuucugguggcccauuacgcgauuaucggcccuggccuccaggccaaggcuacccgggaggcccagaagcgcacagcugccgggauuaugaaaaaucccaccguugauggaaucacggugauugaccuggaaccuaucccguaugaucccaaguuugagaaacaacugggccaggucaugcuccuugugcugugcgucacacaggugcugaugaugagaaccacaugggcccucugugaagcgcugacccuugcuaccgggccuaucucuacacugugggagggaaaccccggccgguucuggaauacgaccauugccguuuccauggcuaacaucuuucgcgggagcuaccucgccggagccggccugcuguucucuauuaugaagaauacaaccaacacaagacggggcaccgggaauaucggagagacgcucggcgaaaaauggaaguccagacuuaacgcucugggaaagagcgaguuucagauuuauaaaaagucuggaauccaagaaguggaccgcacacuggccaaagagggcaucaagagaggggaaaccgaucaccaugcggucagcagaggauccgccaaacuccgcugguucguggaacggaacaugguuaccccugagggcaagguggucgaccugggcugcgggagaggaggcuggucuuacuauugugggggacuuaaaaaugugcgcgaagugaagggccugacaaaagggggacccggccacgaggaaccgauuccuaugagcaccuacggcuggaaccucguucggcugcaguccggggucgauguguucuuuacaccgcccgagaaaugcgacacgcugcucugugauaucggagagagcuccccuaaucccaccauugaagcuggcagaacacuucgcgugcugaaccuggucgagaauuggcucaacaauaacacccaguucugcguuaaggugcugaauccuuauaugccgucugugaucgagaagauggagacacuucaacggaaguacgggggagcccuggucagaaacccccucagccgcaauuccacccacgaaauguacugggugucuaacgcuacgggcaauauuguuagcuccgugaacaugaucucucggaugcugaucaauagauuuaccaugaaacauaagaaggccacauaugagccugacgucgaccuggggagcggaacccgcaacauuggcaucgagaacgaaauucccaaucucgauaucauuggcaaaagaaucgagaagauuaaacaggaacacgagacauccuggcauuacgaccaggaucacccuuauaagaccugggcguaccacgggagcuaugaaacaaaacagaccggaucugccuccagcauggugaacggcguugugaaacuucugacgaagcccugggacgucgugccgauggugacacaaauggcuaugaccgauaccacaccuuucgggcagcagcgggucuuuaaagagaagguugacacgcgcacccaggagcccaaagaaggaacaaagaaacugaugagaaucaccgccgaguggcucuggaaggaacugggcaagaaaaagacaccucggauguguaccagagaggaguucacacggaaagugcgcucuaaugcugcccuuggggcuaucuuuaccgaugaaaacaaguggaaauccgccagagaggcgguggaagacagccgguucugggagcuggucgaucgcgaaagaaaucuccaucuggagggaaagugcgagacguguguguacaacaugaugggcaaacgggaaaagaagcugggcgaguuugggaaagccaagggaucucgcgcuauuugguauauguggcucggcgccagauuccuggaauuugaggcucuuggguuccugaaugaagaccacugguuuucccggggaaacagccucuccggcguugagggggagggccugcauaaacuuggauacauccugcgcgaugugagcaagaaagaaggcggggccauguacgccgacgacaccgcgggaugggauacaagaauuacccucgaggaccugaagaaugaagagauggucacaaaccacaugaagggcgaacauaaaaagcuggcugaggccaucuucaaacucaccuaucaaaauaaggugguucgggugcagcgccccacgccuagagggacagucauggauauuaucucucggaaagaccagcgcggaagcggccagguggggaccuacggccugaacacauucaccaauauggaggcccaacuuaucagacagauggaaggagagggcauuuuuaaguccauccagcggcugacgguuaccgaagagauugcugugcaaaacuggcucgccagagucgggcgcgagcggcugucuagaauggcuaucagcggagaugacugcguggucaagccccuugaugaccgcuucgccuccgcgcugacagcccucaaugauaugggcaaagugcggaaggacauucagcagugggaaccgucuagaggguggaacgauuggacccagguuccuuuuugcagccaccacuuccaugagcuggugaugaaagacggacgcguccugguggugcccugucggaaccaagaugaacucaucggcagagcucgcaucucccagggggccggcuggucucugaaggagacagcuugccuuggaaaaagcuaugcccagauguggacccugauguacuuucaccggagagaccuccgccuggcggccaaugcuauuuguuccgccguucccagccauugggugccuacaucucggaccacgugguccauccacgcuaagcacgaauggaugacaaccgaggacaugcuugccgucuggaacagaguguggauucaggagaauccguggauggaagauaagacccccguugagagcugggaagaggugccuuaucugggcaaacgggaagaccaauggugcgggucucucaucggacugacauccagagcuaccugggccaagaacauucagacagcgaucaaucagguccgcagccugauuggcaacgaggaguacacggauuauaugcccuccaugaaacgguucagaaaggaagaggaagaggccggggugcucugguga

SEQ ID NO: 19968 - RNA, 9876 nt, Artificial Sequence
  derived and/or modified CDS sequence (opt5) from DENV-2__EU687236__SS-prME
acagccggcgugaucauuaugcugauccccacagcuauggccuuccaccucacgaccagaaauggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccauuaaagacaauagagcugugcacgccgauaugggcuauuggaucgaaucugcgcugaacgacaccuggaagauggagaaggccuccuucauugagaucaaaagcugccacuggccuaagucucauacgcuguggagcaaugggguucuugaauccgagaugauuauccccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauucuccuggucgcggugagcuuuguuacccuuaucacaggaaauauguccuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgaaaccauccuggagcucaccgaugcccuggcccugggaaugaugguccuuaaaauugugcggaacauggaaaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaggccguuauggcgguggggauggugagcauccucgccucuucccugcucaaaaaugacauuccuaugacaggaccccuggucgcuggcggccuucugaccgugugcuauguucugaccgggcggagcgccgaucucgaacuggagaaggcugccgacgugaaaugggaggaucaggccgaaaucuccggaagcucuccuauucuuagcaucacaauuuccgaggacggcucuaugagcaucaagaacgaagaggaggaacacacccugacaauccucauucgcacggggcugcucgucaucuccggaguguuccccguuucuauuccgaucaccgcugcggccugguaccugugggaggugaagaaacaaagagcuggcguccuuugggaugugccuucucccccucccgucgggaaggccgaacuggaggacggagccuaucggauuaaacagcgcggcaucuuuggcuacucccagaucggggcuggaguguauaaggaaggcacauuccauaccauguggcacguuacaagaggggccgugcugaugcaucggggaaaacgcauugagcccuccugggcggaugucaagaaggaccucaucagcuacggcgggggauggaaacuggagggcgaauggaaggagggcgaagaggugcagguucuugcucuggaaccugggaaaaauccgagagccgugcaaaccaagcccggacucuuuaaaacgaacaccggcacaauuggggccgucucccuggauuucagcccuggaaccucuggcucccccaucguggaccggaaggggaaggugguuggacucuacggcaauggcgucgugacaagaagcggggcuuaugugucugccauugcgcagaccgagaaauccaucgaggauaacccugaaaucgaggacgauauuuuccgcaagaaacggcugacaaucauggaccuucaccccggagcuggcaagacgaaaagauaccugccugccauuguccgcgaagccaucaagcgggggcugagaacccucauucuggcuccgacacgcgugguugccgcugagauggaagaggcccuucggggacugcccaucagauaucagaccccugcgauucgcgccgagcauaccggccgggaaaucguggaccucaugugucacgcuacauuuacgaugagacugcucagccccguccgggugccuaacuacaaucugaucauuauggaugaggcccacuucaccgaccccgcuuccaucgccgcccgcggguauauuucuacaagaguugaaaugggcgaggcugcgggaaucuuuaugaccgccacaccgccuggcagccgggaucccuucccccaguccaacgcuccuauuauggacgaggaacgcgagauccccgaaagaagcuggaacucugggcaugagugggugaccgauuuuaagggaaaaacggucugguucgugccuuccaucaaggccggcaacgacauugccgcuugccuucggaaaaaugggaagaaaguuauccaacugagcagaaagacauuugauucugaauacgugaagacccgcgccaacgacugggauuucgucgugaccacagacauuagcgagaugggagcgaauuuucgggcugagagagugaucgauccgcgccgguguaugaaacccgucauucugaccgacggcgaagagagaguuauccucgccgggccuaugcccgugacacacuccucugccgcucagcgccggggcagaaucggacgcaacccuaagaaugaaaacgaccaguauauuuacaugggcgagccccuggaaaaugaugaggacugcgcccauuggaaagaggcgaagaugcuucuggauaacaucaauaccccggaagggauuaucccuagcauguucgagcccgaaagagagaaaguggacgccauugauggagaauaccggcuccgcggcgaggcuagaaagacguuugucgaccugaugcggcgcggggaucugccuguguggcucgccuauagaguugcugccgagggaaucaacuacgcugaccggagaugguguuucgauggcauuaaaaauaaccaaauccuugaagagaacguggaagucgagaucuggacaaaggagggggaacgcaagaaacugaagccccgguggcuggacgccagaauuuauuccgauccucucgcgcugaaagaguucaaggaauuugccgcuggccgcaaaucucuuacccugaaucucaucacagagaugggacggcugcccaccuucaugacgcagaaggccagagacgcucuggauaaccucgccgugcuucacaccgccgaaguuggcgggcgggcuuacaaucacgcgcugagcgagcugccggagacacucgaaacccugcuucugcucacacugcuggccaccgugacaggaggcauuuuucucuuccuuauguccgggaagggaaucggcaaaaugacccugggcaugugcugcauuaucacggcuagcauccugcucugguaugcccagauucagccucauuggaucgccgcuucuauuauccuggaguuuuuccuuauuguccugcucauccccgaacccgagaagcaacgcacaccucaggacaaccagcugaccuacguggucaucgccauucugaccgugguugcggccacaauggcuaaugaaaugggguuucucgagaaaaccaagaaagaccuuggacugggcuccaucacaacgcaggagagcgaauccaacauucuggauaucgaccucagaccggccucugcuuggacccuguaugccguggcgacaaccuucgugacacccaugcuucggcacagcauugaaaauagcucugucaacguuagccugaccgccaucgcuaaucaagccacggugcucauggggcugggacgcggcuggccucuguccaagauggauauuggggugccccuccuugcuaucggauguuacagccaggucaacccuaucacccugacagccgcucugcuccugcuuguggcccauuacgcgauuaucggccccggccugcaggccaaggcuaccagagaagcccagaaacggacagcugccgggauuaugaagaauccuaccguugacggaaucacggugauugaucucgagccgauccccuaugacccuaaauuugaaaagcaacugggccaggucaugcugcucgugcuuugcgucacacaggugcugaugaugcgcaccacaugggcccugugugaggcgcucacccuggcuaccgggcccaucucuacacuuugggagggaaacccuggcagauucuggaauacgaccauugccguuuccauggcuaacaucuuucgggggagcuaccuggccggagccggccuccuguucucuauuaugaaaaauacaaccaacacacgcagaggcaccgggaauaucggagaaacgcugggcgagaaguggaagucccggcucaacgcucuugggaaaagcgaauuucagauuuauaagaaaucuggaauccaagagguggauagaacacuggccaaggagggcaucaaacgcggggaaaccgaccaccaugcggucagccggggauccgccaagcugagaugguucguggagcgcaacaugguuacccccgaaggcaaaguggucgaucucggcugcgggcggggaggcuggucuuacuauugugggggacugaagaaugugagagaggugaagggccuuacaaaagggggaccgggccacgaggaaccuauucccaugagcaccuacggcuggaaccugguucgccuccaguccggggucgacguguucuuuacacccccugagaagugcgauacgcugcugugugacaucggagaaagcucccccaauccuaccauugaggcuggccggacacucagagugcuuaaccuggucgaaaauuggcugaacaauaacacccaguucugcguuaaagugcucaauccguauaugcccucugugaucgagaagauggaaacacugcaacgcaaauacgggggagcccuuguccggaacccucugagcagaaauuccacccacgagauguacugggugucuaacgcuacgggcaauauuguuagcuccgugaacaugaucucucgcaugcucaucaaucgguuuaccaugaagcauaagaaagccacauaugagcccgaugucgaccuggggagcggaaccagaaacauuggcaucgaaaacgagauuccuaaucuggacaucauuggcaagcgcaucgagaagauuaagcaggagcacgaaacauccuggcauuacgaucaggaccaccccuauaaaaccugggcguaccacgggagcuaugagacaaagcagaccggaucugccuccagcauggugaacggcguugugaagcuccuuacgaaaccgugggaugucgugccuauggugacacaaauggcuaugaccgacaccacacccuucgggcagcagagagucuuuaaggagaaaguugauacgcggacccaggaaccuaaggagggaaccaaaaagcugaugcgcaucaccgccgaauggcuguggaaggagcucggcaaaaagaaaacacccagaauguguacccgggaggaguucacaaagaaagugagaucuaaugcugcccugggggcuaucuuuaccgacgagaacaaguggaaauccgcccgggaagcgguggaggauagccgcuucugggaacuugucgacagagagcggaaucugcaucucgagggaaagugcgaaacguguguguacaacaugaugggcaagcgcgagaaaaagcugggcgaauuugggaaagccaagggaucuagagcuauuugguauauguggcugggcgcccgguuccucgaguuugaagcucugggguuccuuaaugaggaucacugguuuucccgcggaaacagccuguccggcguugagggggaaggccuccauaaacugggauacauccuuagagacgugagcaagaaggagggcggggccauguacgccgaugacaccgcgggaugggacacacggauuacccuggaagaucucaaaaaugaggaaauggucacaaaccacaugaagggcgagcauaaaaagcuggcugaggccaucuucaaacugaccuaucaaaauaaggugguucgcgugcagagaccuacgccccgggggacagucauggacauuaucucucgcaaggaucagagaggaagcggccagguggggaccuacggccucaacacauucaccaauauggaagcccaacugauccggcagauggagggagaaggcauuuuuaaauccauccagcgccuuacgguuaccgaggagauugcugugcaaaacuggcuggccagagucgggcgggaaagacucucucgcauggcuaucagcggagacgauugcguggucaagccgcuggacgaucgguucgccuccgcgcuuacagcccugaaugacaugggcaaagugagaaaggauauucagcagugggagccuucucgcggguggaacgacuggacccagguucccuuuugcagccaccacuuccaugaacucgugaugaaagauggacggguccugguggugcccuguagaaaccaagacgagcugaucggccgcgcucggaucucccagggggccggcuggucucucaaggaaacagcuugccugggaaagagcuaugcccagauguggacccuuauguacuuucacagacgcgaucugcggcucgcggccaaugcuauuuguuccgccguuccuagccauugggugccgacaucuagaaccacgugguccauccacgcuaaacacgaguggaugacaaccgaggacaugcuggccgucuggaaccgcguguggauucaggaaaaucccuggauggaggacaagaccccuguugaaagcugggaggaagugcccuaucuuggcaaacgggaggaucaauggugcgggucucugaucggacucacauccagagcuaccugggccaagaacauucagacagcgaucaaucagguccggagccugauuggcaacgaggaauacacggacuauaugccuuccaugaaaagauuccgcaaggaggaagaggaagccggggugcugugguga

SEQ ID NO: 19969 - RNA, 9876 nt, Artificial Sequence
  derived and/or modified CDS sequence (opt5) from DENV-2__EU687237__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccauuaaagacaauagagcugugcacgccgauaugggcuauuggaucgaaucugcgcugaacgacaccuggaagauggagaaggccuccuucauugagaucaaaagcugccacuggccuaagucucauacgcuguggagcaaugggguucuugaauccgagaugauuauccccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauucuccuggucgcggugagcuuuguuacccuuaucacaggaaauauguccuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgaaaccauccuggagcucaccgaugcccuggcccugggaaugaugguccuuaaaauugugcggaacauggaaaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaggccguuauggcgguggggauggugagcauccucgccucuucccugcucaaaaaugacauuccuaugacaggaccccuggucgcuggcggccuucugaccgugugcuauguucugaccgggcggagcgccgaucucgaacuggagcgcgcugccgacgugaagugggaggaucaggccgaaaucuccggaagcucuccuauucuuagcaucacaauuuccgaggacggcucuaugagcaucaaaaacgaagaggaggaacacacccugacaauccucauuagaacggggcugcucgucaucuccggaguguuccccguuucuauuccgaucaccgcugcggccugguaccugugggaggugaagaagcaacgggcuggcguccuuugggaugugccuucucccccucccgucgggaaagccgaacuggaggacggagccuaucgcauuaagcagagaggcaucuuuggcuacucccagaucggggcuggaguguauaaagaaggcacauuccauaccauguggcacguuacaagaggggccgugcugaugcaucgcggaaagagaauugagcccuccugggcggaugucaaaaaggaccucaucagcuacggcgggggauggaagcuggagggcgaauggaaagagggcgaagaggugcagguucuugcucuggaaccugggaagaauccgcgggccgugcaaaccaaacccggacucuuuaagacgaacaccggcacaauuggggccgucucccuggauuucagcccuggaaccucuggcucccccaucguggacagaaaagggaaggugguuggacucuacggcaauggcgucgugacacgcagcggggcuuaugugucugccauugcgcagaccgagaaguccaucgaggauaacccugaaaucgaggacgauauuuuccggaaaaagagacugacaaucauggaccuucaccccggagcuggcaaaacgaagcgcuaccugccugccauuguccgggaagccaucaaaagagggcugcgcacccucauucuggcuccgacacgggugguugccgcugagauggaagaggcccuuagaggacugcccauccgcuaucagaccccugcgauucgggccgagcauaccggcagagaaaucguggaccucaugugucacgcuacauuuacgaugcggcugcucagccccguccgcgugccuaacuacaaucugaucauuauggaugaggcccacuucaccgaccccgcuuccaucgccgccagaggguauauuucuacacggguugaaaugggcgaggcugcgggaaucuuuaugaccgccacaccgccuggcagccgcgaucccuucccccaguccaacgcuccuauuauggacgaggaaagagagauccccgaacggagcuggaacucugggcaugagugggugaccgauuuuaagggaaagacggucugguucgugccuuccaucaaagccggcaacgacauugccgcuugccuuagaaagaaugggaaaaagguuauccaacugagccgcaaaacauuugauucugaauacgugaagacccgggccaacgacugggauuucgucgugaccacagacauuagcgagaugggagcgaauuuuagagcugagcgcgugaucgauccgcggagauguaugaagcccgucauucugaccgacggcgaggaacgcguuauccucgccgggccuaugcccgugacacacuccucugccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauaccccggaagggauuaucccuagcauguucgagcccgaacgggagaagguggacgccauugauggagaauaccgccucagaggcgaggcucggaaaacguuugucgaccugaugcgcagaggggaucugccuguguggcucgccuaucggguugcugccgagggaaucaacuacgcugacagacgcugguguuucgauggcauuaagaauaaccaaauccuugaagagaacguggaagucgagaucuggacaaaagagggggaacggaagaagcugaaacccagauggcuggacgcccgcauuuauuccgauccucucgcgcugaaggaguucaaagaauuugccgcuggccggaagucucuuacccugaaucucaucacagagaugggaagacugcccaccuucaugacgcagaaagcccgggacgcucuggauaaccucgccgugcuucacaccgccgaaguuggcgggcgcgcuuacaaucacgcgcugagcgagcugccggagacacucgaaacccugcuucugcucacacugcuggccaccgugacaggaggcauuuuucucuuccuuauguccgggaagggaaucggcaagaugacccugggcaugugcugcauuaucacggcuagcauccugcucugguaugcccagauucagccucauuggaucgccgcuucuauuauccuggaguuuuuccuuauuguccugcucauccccgaacccgagaaacaaagaacaccucaggacaaccagcugaccuacguggucaucgccauucugaccgugguugcggccacaauggcuaaugaaaugggguuucucgagaagaccaaaaaggaccuuggacugggcuccaucacaacgcaggagagcgaauccaacauucuggauaucgaccuccggccggccucugcuuggacccuguaugccguggcgacaaccuucgugacacccaugcuucgccacagcauugaaaauagcucugucaacguuagccugaccgccaucgcuaaucaagccacggugcucauggggcugggaagaggcuggccucuguccaaaauggauauuggggugccccuccuugcuaucggauguuacagccaggucaacccuaucacccugacagccgcucugcuccugcuuguggcccauuacgcgauuaucggccccggccugcaggccaaggcuacccgggaagcccagaagcgcacagcugccgggauuaugaaaaauccuaccguugacggaaucacggugauugaucucgagccgauccccuaugacccuaaguuugaaaaacaacugggccaggucaugcugcucgugcuuugcgucacacaggugcugaugaugagaaccacaugggcccugugugaggcgcucacccuggcuaccgggcccaucucuacacuuugggagggaaacccuggccgguucuggaauacgaccauugccguuuccauggcuaacaucuuucgcgggagcuaccuggccggagccggccuccuguucucuauuaugaagaauacaaccaacacaagacggggcaccgggaauaucggagaaacgcugggcgagaaauggaaguccagacucaacgcucuuggaaagagcgaauuucagauuuauaaaaagucuggaauccaagagguggaucgcacacuggccaaagagggcaucaagagaggggaaaccgaccaccaugcggucagcagaggauccgccaaacugcgcugguucguggagcggaacaugguuacccccgaaggcaagguggucgaucucggcugcgggagaggaggcuggucuuacuauugugggggacugaaaaaugugcgcgaggugaagggccuuacaaaagggggaccgggccacgaggagccuauucccaugagcaccuacggcuggaaccugguucggcuccaguccggggucgacguguucuuuacacccccugagaaaugcgauacgcugcugugugacaucggagaaagcucccccaauccuaccauugaggcuggcagaacacuccgcgugcuuaaccuggucgaaaauuggcugaacaauaacacccaguucugcguuaaggugcucaauccguauaugcccucugugaucgagaaaauggaaacacugcaacggaaguacgggggagcccuugucagaaacccucugagccgcaauuccacccacgagauguacugggugucuaacgcuacgggcaauauuguuagcuccgugaacaugaucucucggaugcucaucaauagauuuaccaugaaacauaagaaggccacauaugagcccgaugucgaccuggggagcggaacccgcaacauuggcaucgaaaacgagauuccuaaucuggacaucauuggcaaaagaaucgaaaagauuaaacaggagcacgaaacauccuggcauuacgaucaggaccaccccuauaagaccugggcguaccacgggagcuaugagacaaaacagaccggaucugccuccagcauggugaacggcguugugaagcuccuuacgaagccgugggaugucgugccuauggugacacaaauggcuaugaccgacaccacacccuucgggcagcagcgggucuuuaaagagaagguugauacgcgcacccaggaaccuaaagagggaacaaagaaacugaugagaaucaccgccgaauggcuguggaaggagcucggcaagaaaaagacaccccggauguguaccagagaggaguucacacggaaagugcgcucuaaugcugcccugggggcuaucuuuaccgacgagaacaaguggaaauccgccagagaagcgguggaggauagccgguucugggaacuugucgaccgcgagagaaaucugcaucucgagggaaagugcgaaacguguguguacaacaugaugggcaaacgggagaagaagcugggcgaauuugggaaagccaagggaucucgcgcuauuugguauauguggcugggcgccagauuccucgaguuugaagcucugggguuccuuaaugaggaucacugguuuucccggggaaacagccuguccggcguugagggggaaggccuccauaaacugggauacauccuucgcgacgugagcaagaaagagggcggggccauguacgccgaugacaccgcgggaugggacacaagaauuacccuggaagaucucaagaaugaggaaauggucacaaaccacaugaagggcgagcauaaaaagcuggcugaggccaucuucaaacugaccuaucaaaauaaggugguucgggugcagcgcccuacgcccagagggacagucauggacauuaucucucggaaagaucagcgcggaagcggccagguggggaccuacggccucaacacauucaccaauauggaagcccaacugaucagacagauggagggagaaggcauuuuuaaguccauccagcggcuuacgguuaccgaggagauugcugugcaaaacuggcuggccagagucgggcgcgaacggcucucuagaauggcuaucagcggagacgauugcguggucaagccgcuggacgaucgcuucgccuccgcgcuuacagcccugaaugacaugggcaaagugcggaaggauauucagcagugggagccuucuagaggguggaacgacuggacccagguucccuuuugcagccaccacuuccaugaacucgugaugaaagauggacgcguccugguggugcccugucggaaccaagacgagcugaucggcagagcucgcaucucccagggggccggcuggucucucaaggaaacagcuugccugggaaaaagcuaugcccagauguggacccuuauguacuuucaccggagagaucugcgccucgcggccaaugcuauuuguuccgccguuccuagccauugggugccgacaucucggaccacgugguccauccacgcuaagcacgaguggaugacaaccgaggacaugcuggccgucuggaacagaguguggauucaggaaaaucccuggauggaggacaagaccccuguugaaagcugggaggaagugcccuaucuuggcaaacgggaggaucaauggugcgggucucugaucggacucacauccagagcuaccugggccaagaacauucagacagcgaucaaucagguccgcagccugauuggcaacgaggaauacacggacuauaugccuuccaugaaacgguucagaaaggaggaagaggaagccggggugcugugguga

SEQ ID NO: 19970 - RNA, 9876 nt, Artificial Sequence
  derived and/or modified CDS sequence (opt5) from DENV-2__EU687238__SS-prME
accgccggagugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaccaucaccuggauuggaaugaacagccgguccacaagccuuucugugucccucgugcugguuggcgucgugacccuguaucucggggugaugguccaggccgacacaggaugugugguuagcuggaagaauaaagaacugaagugcggcucugggaucuucauuacggauaacgugcacaccuggacagagcaguacaaguuucagccugaaucccccagcaaacuugccuccgcuauccaaaaggcccaugaggaaggcauuuguggaaucagaucugucacccgccuggagaaucucauguggaaacagaucacaccggagcugaaccacauucugagcgaaaaugaggugaaacuuaccaucaugacgggcgacauuaaagggaucaugcaggcuggaaagcggucccucagaccucagcccaccgaacugaaauauucuuggaagacauggggcaaggccaaaaugcugagcaccgagucccauaaccaaacauuccucauugaugggccugaaaccgcggagugccccaauacaaaccgcgccuggaauagccuggagguugaagacuacggauuuggcguguucucuaccaacaucuggcuuaagcugcgggagaaacaggacgucuuuugugauuccaagcucaugagcgcugccaucaaagacaauagagcugugcacgccgauaugggcuauuggauugaaucugcgcugaacgacacguggaagauggagaaggccuccuucaucgagauuaaaagcugccacuggccuaagucucauacacuguggagcaaugggguucuugaauccgagaugaucauucccaaaaacuucgcuggaccggugagccagcacaacuaccgcccuggcuaucauacccagaccgccgggcccuggcaccucggaaagcuggaaauggauuuugacuucugugagggcacaaccgucguggugacggaagauugcgggaaucggggacccucucugagaacaaccacagcuuccggcaaacucaucaccgaguggugcugucggagcugcacacugccuccgcuucgcuacagaggcgaggacggguguugguacggaauggaaauucggccccugaaggagaaggaagagaaccucgucaauucccugguuaccgccggccaugggcaaaucgauaacuuuucucugggagugcuuggcauggcccucuuccuggaagagaugcugagaacgcgcguggggaccaaacacgcuauccuccuggucgcggugagcuuuguuacacuuauuaccggaaauauguccuuccgggaccugggcagagugauggucauggugggcgccacaaugaccgaugacaucgggaugggaguuacguaucucgcucugcuggccgccuuuaaggugcgcccuacauucgcugccggccuucugcucagaaaacugaccucuaaggagcucaugauggcgacaauugggaucgcucugcuuagccaguccaccauucccgaaaccauccuggagcucacagaugcccuggcccugggaaugaugguccuuaaaaucgugcggaacauggaaaaguaccagcuggcuguuacgauuauggccaucucuugcgugccuaaugcggucauucuccaaaacgcuuggaaggugagcuguaccauccuggccgccguguccgucagcccccuccugcuuacaucuucccagcagaaagcugacuggauuccucuggcccucaccaucaagggccugaaucccacagcuaucuuucugaccacgcuuagccgcacaucuaaaaagagauccuggccgcugaacgaggccguuauggcgguggggauggugagcauucucgccucuucccugcucaaaaaugacaucccuaugaccggaccccuggucgcuggcggccuucugaccgugugcuauguucugacagggcggagcgccgaucucgaacuggagcgcgcugccgacgugaagugggaggaucaggccgaaauuuccggaagcucuccuauccuuagcauuaccaucuccgaggacggcucuaugagcauuaaaaacgaagaggaggaacacacacugacgauccucaucagaaccgggcugcucgucauuuccggaguguuccccguuucuaucccgauuacagcugcggccugguaccugugggaggugaagaagcaacgggcuggcguccuuugggaugugccuucucccccucccgucgggaaagccgaacuggaggacggagccuaucgcaucaagcagagaggcauuuuuggcuacucccagaucggggcuggaguguauaaagaaggcaccuuccauacaauguggcacguuaccagaggggccgugcugaugcaucgcggaaagagaaucgagcccuccugggcggaugucaaaaaggaccucauuagcuacggcgggggauggaagcuggagggcgaauggaaagagggcgaagaggugcagguucuugcucuggaaccugggaagaauccgcgggccgugcaaacgaaacccggacucuuuaagaccaacacaggcaccaucggggccgucucccuggauuucagcccuggaacaucuggcucccccauuguggacagaaaagggaaggugguuggacucuacggcaauggcgucgugacccgcagcggggcuuaugugucugccaucgcgcagacagagaaguccauugaggauaacccugaaaucgaggacgauaucuuccggaaaaagagacugacgauuauggaccuucaccccggagcuggcaaaaccaagcgcuaccugccugccaucguccgggaagccauuaaaagagggcugcgcacacucauccuggcuccgacccgggugguugccgcugagauggaagaggcccuuagaggacugcccauucgcuaucagaccccugcgauccgggccgagcauacaggcagagaaauuguggaccucaugugucacgcuacguuuaccaugcggcugcucagccccguccgcgugccuaacuacaaucugaucaucauggaugaggcccacuucacagaccccgcuuccauugccgccagaggguauaucucuacccggguugaaaugggcgaggcugcgggaauuuuuaugacagccaccccgccuggcagccgcgaucccuucccccaguccaacgcuccuaucauggacgaggaaagagagauucccgaacggagcuggaacucugggcaugagugggugacggauuuuaagggaaagacagucugguucgugccuuccaucaaagccggcaacgacaucgccgcuugccuuagaaagaaugggaaaaagguuauucaacugagccgcaaaaccuuugauucugaauacgugaagacccgggccaacgacugggauuucgucgugacaaccgacaucagcgagaugggagcgaauuuuagagcugagcgcgugauugauccgcggagauguaugaagcccgucauccugacagacggcgaggaacgcguuauucucgccgggccuaugcccgugacccacuccucugccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauacgccggaagggaucauuccuagcauguucgagcccgaacgggagaagguggacgccaucgauggagaauaccgccucagaggcgaggcucggaaaacauuugucgaccugaugcgcagaggggaucugccuguguggcucgccuaucggguugcugccgagggaauuaacuacgcugacagacgcugguguuucgauggcaucaagaauaaccaaauucuugaagagaacguggaagucgagaucuggaccaaagagggggaacggaagaagcugaaacccagauggcuggacgcccgcaucuauuccgauccucucgcgcugaaggaguucaaagaauuugccgcuggccggaagucucuuacacugaaucucauuaccgagaugggaagacugcccacguucaugacccagaaagcccgggacgcucuggauaaccucgccgugcuucacacagccgaaguuggcgggcgcgcuuacaaucacgcgcugagcgagcugccggagacccucgaaacacugcuucugcucacccugcuggccacagugaccggaggcaucuuucucuuccuuauguccgggaagggaauuggcaagaugacgcugggcaugugcugcaucauuacagcuagcauccugcucugguaugcccagauccagccucauuggauugccgcuucuaucauucuggaguuuuuccuuaucguccugcucauucccgaacccgagaaacaaagaaccccucaggacaaccagcugaccuacguggucaucgccauccugacagugguugcggccaccauggcuaaugaaaugggguuucucgagaagaccaagaaggaccuuggacugggcuccauuacgacccaggagagcgaauccaacauccuggauauugaccuccggccggccucugcuuggacacuguaugccguggcgaccacauucgugacccccaugcuucgccacagcaucgaaaauagcucugucaacguuagccugacggccauugcuaaucaagccaccgugcucauggggcugggaagaggcuggccucuguccaaaauggauaucggggugccccuccuugcuauuggauguuacagccaggucaacccuaucacacugaccgccgcucugcuccugcuuguggcccauuacgcgaucauuggccccggccugcaggccaaggcuacacgggaagcccagaagcgcaccgcugccgggaucaugaaaaauccuacgguugacggaauuacagugaucgaucucgagccgauucccuaugacccuaaguuugaaaaacaacugggccaggucaugcugcucgugcuuugcgucacccaggugcugaugaugagaacaaccugggcccugugugaggcgcucacccuggcuacagggcccaucucuacgcuuugggagggaaacccuggccgguucuggaauaccacaaucgccguuuccauggcuaacauuuuucgcgggagcuaccuggccggagccggccuccuguucucuaucaugaagaauaccacaaacaccagacggggcacggggaauauuggagaaacacugggcgagaaauggaaguccagacucaacgcucuuggaaagagcgaauuucagaucuauaaaaagucuggcauucaagagguggaucgcacccuggccaaagagggcaucaagagaggggaaaccgaccaccaugcggucagcagaggauccgccaaacugcgcugguucguggagcggaacaugguuacacccgaaggcaagguggucgaucucggcugcgggagaggaggcuggucuuacuauugugggggacugaaaaaugugcgcgaggugaagggccuuaccaaagggggaccgggccacgaggagccuauccccaugagcacauacggcuggaaccugguucggcuccaguccggggucgacguguucuuuacgcccccugagaaaugcgauacccugcugugugacauuggagaaagcucccccaauccuacaaucgaggcuggcagaacccuccgcgugcuuaaccuggucgaaaauuggcugaacaauaacacacaguucugcguuaaggugcucaauccguauaugcccucugugauugagaaaauggaaacccugcaacggaaguacgggggagcccuugucagaaacccucugagccgcaauuccacgcacgagauguacugggugucuaacgcuaccggcaauaucguuagcuccgugaacaugauuucucggaugcucaucaauagauuuacaaugaaacauaagaaggccaccuaugagcccgaugucgaccuggggagcggaacacgcaacaucggcauugaaaacgagaucccuaaucuggacauuaucggcaaaagaauugaaaagaucaaacaggagcacgaaaccuccuggcauuacgaucaggaccaccccuauaagacaugggcguaccacgggagcuaugagaccaaacagacgggaucugccuccagcauggugaacggcguugugaagcuccuuacaaagccgugggaugucgugccuauggugacccaaauggcuaugaccgacacaacgcccuucgggcagcagcgggucuuuaaagagaagguugauacccgcacacaggaaccuaaagagggaaccaagaaacugaugagaauuacagccgaauggcuguggaaggagcucggcaagaaaaagacaccccggauguguacaagagaggaguucacccggaaagugcgcucuaaugcugcccugggggcuaucuuuacggacgagaacaaguggaaauccgccagagaagcgguggaggauagccgguucugggaacuugucgaccgcgagagaaaucugcaucucgagggaaagugcgaaaccuguguguacaacaugaugggcaaacgggagaagaagcugggcgaauuugggaaagccaagggaucucgcgcuaucugguauauguggcugggcgccagauuccucgaguuugaagcucugggguuccuuaaugaggaucacugguuuucccggggaaacagccuguccggcguugagggggaaggccuccauaaacugggauacauucuucgcgacgugagcaagaaagagggcggggccauguacgccgaugacacagcgggaugggacaccagaaucacacuggaagaucucaagaaugaggaaauggucaccaaccacaugaagggcgagcauaaaaagcuggcugaggccauuuucaaacugacguaucaaaauaaggugguucgggugcagcgcccuacacccagagggaccgucauggacaucauuucucggaaagaucagcgcggaagcggccagguggggacauacggccucaacaccuucacgaauauggaagcccaacugaucagacagauggagggagaaggcaucuuuaaguccauucagcggcuuaccguuacagaggagaucgcugugcaaaacuggcuggccagagucgggcgcgaacggcucucuagaauggcuauuagcggagacgauugcguggucaagccgcuggacgaucgcuucgccuccgcgcuuaccgcccugaaugacaugggcaaagugcggaaggauauccagcagugggagccuucuagaggguggaacgacuggacacagguucccuuuugcagccaccacuuccaugaacucgugaugaaagauggacgcguccugguggugcccugucggaaccaagacgagcugauuggcagagcucgcaucucccagggggccggcuggucucucaaggaaaccgcuugccugggaaaaagcuaugcccagauguggacacuuauguacuuucaccggagagaucugcgccucgcggccaaugcuaucuguuccgccguuccuagccauugggugccgaccucucggacgacaugguccauucacgcuaagcacgaguggaugaccaccgaggacaugcuggccgucuggaacagaguguggauccaggaaaaucccuggauggaggacaagacaccuguugaaagcugggaggaagugcccuaucuuggcaaacgggaggaucaauggugcgggucucugauuggacucaccuccagagcuacaugggccaagaacauccagacggcgauuaaucagguccgcagccugaucggcaacgaggaauacaccgacuauaugccuuccaugaaacgguucagaaaggaggaagaggaagccggggugcugugguga

SEQ ID NO: 19971 - RNA, 9876 nt, Artificial Sequence
  derived and/or modified CDS sequence (opt5) from DENV-2__EU687240__SS-prME
accgugggcgucaucauuaugcugauccccaccgccauggcuuuccaccucacgacccggaauggggagccucauaugauuguuggacggcaggaaaagggcaagagccugcuuuuuaagacggaggacggggugaauaugugcacccugauggccaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcgucgcgcucgugccucauguuggaaugggccuggagaccagaacggaaacauggauguccucugagggcgcuuggaagcacgugcagcggaucgagaccuggauucugcgccaucccggguucacaaucauggccgccauucucgcuuacaccaucggaaccacacacuuucagagagcccugauuuucauccuucugacggcugucgccccuagcaugaccaugcggugcauuggcaucuccaaccgcgauuuuguggaagggguuucuggaggcagcuggguggacaucguccucgagcacggguccugugugacaaccauggcgaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgucacaugcgcuauguuuacgugcaaaaagaauauggaaggcaaaguugugcucccugagaaccuggaauacaccauugugaucacaccccacagcggggaggagcaugccgucggaaaugacaccggcaagcacggcaaagaaaucaagauuacaccucagucuuccaucaccgaggcggaacuuacgggguauggaaccgugacaauggaguguagcccccggaccggccuggauuucaacgaaaugguucuccugcagauggaggacaaagccuggcuugugcaccgccaaugguuucuggaucucccgcugccuuggcugcccggggcugacacacagggaucuaauuggauucagaaggagacccucgucacguucaagaacccucaugccaaaaagcaggacgugguugugcugggcucccaagaaggggcuaugcacacagcccuuaccggcgccacagagauccagaugagcuccggaaaucugcucuuuaccggccaucugaaaugcagacuucggauggauaagcugcagcucaaagggaugucuuacagcauguguaccggaaaguucaagauugucaaagaaaucgcugagacacaacacggcacgaucgugauuagaguccaguaugagggggacggaucccccugcaagauccccuucgaaauuauggaucuggagaaacgccaugugcugggccggcucaucaccguuaacccuauugugacagaaaaggacagcccggucaacaucgaggcggaacccccuuuuggggauucuuacauuaucaucggcguggagcccggacagcugaaacuuaauugguucaagaagggcuccagcauugggcagauguuugagaccacaaugagaggagccaaacgcauggcuauccugggcgacaccgccugggauuucgggucucucggaggcguuuuuacgagcauugggaaggcccugcaccaaguguucggcgcuaucuacggagccgcguuuuccggcgucucuuggacaaugaaaauucugaucggggugaucauuaccuggaucggaaugaacagccgguccaccagccuuucugugucccucguucuggucggcguggugacacuguaucucggggucauggugcaggcugacagcggauguguugugucuuggaagaauaaagaacugaagugcggcuccgggauuuucaucaccgauaacguccacacauggacggagcaguacaaguuucagccugaaagccccuccaaacuugccucugccauucaaaaggcucaugaggaaggcaucuguggaaucagaagcgugacccgccuggagaaucucauguggaaacagauuacaccggagcugaaccacauccuguccgaaaaugaggccaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagaucaaaucuugccacuggccuaagagccauacccugugguccaaugggguucuugaaagcgagaugauuauccccaaaaacuucgcuggaccggugucucagcacaacuaccgcccuggcuaucauacgcagacagccgggcccuggcaccucggaaagcuggaaauggauuuugacuucugugagggcaccaccgucguggugacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucgucaauucucugguuaccgccggccaugggcaaaucgauaacuuuagccugggagugcuuggcauggcccucuuccuggaagagaugcugagaacacgcguggggaccaaacacgcuauucuccuggucgcgguguccuuuguuacgcuuaucaccggaaauaugucuuuccgggaccugggcagagugauggucauggugggcgccacaaugaccgaugacauugggaugggaguuacauaucucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauccuggagcucaccgaugcccuggcccugggaaugaugguccuuaaaauugugcggaacauggaaaaguaccagcuggcuguuaccaucauggccauuagcugcgugccuaaugcggucauccuccaaaacgcuuggaagguguccuguacaauucuggccgccgugagcgucucuccccuccugcuuacguccagccagcagaaagcugacuggaucccucuggcccucaccaucaagggccugaaucccacagcuauuuuucugaccacacuuucucgcaccuccaaaaagagaagcuggccgcugaacgaggccguuauggcgguggggauggugucuauccucgccuccagccugcucaaaaaugacauuccuaugacgggaccccuggucgcuggcggccuucugacagugugcuauguucugaccgggcgguccgccgaucucgaacuggagcgcgcugccgacgugaagugggaggaucaggccgaaaucagcggaucuagcccuauucuuuccaucaccauuucugaggacggcagcauguccaucaaaaacgaagaggaggaacacacacugaccauccucauuagaacagggcugcucgucaucucuggaguguuccccguuagcauuccgaucacggcugcggccugguaccugugggaggugaagaagcaacgggcuggcguccuuugggaugugccuucucccccucccgucgggaaagccgaacuggaggacggagccuaucgcauuaagcagagaggcaucuuuggcuacagccagaucggggcuggaguguauaaagaaggcaccuuccauacaauguggcacguuaccagaggggccgugcugaugcaucgcggaaagagaauugagcccagcugggcggaugucaaaaaggaccucaucuccuacggcgggggauggaagcuggagggcgaauggaaagagggcgaagaggugcagguucuugcucuggaaccugggaagaauccgcgggccgugcaaacaaaacccggacucuuuaagaccaacacgggcaccauuggggccgucagccuggauuucucuccuggaacauccggcagccccaucguggacagaaaagggaaggugguuggacucuacggcaauggcgucgugacccgcucuggggcuuauguguccgccauugcgcagacagaaaagagcaucgaggauaacccugaaaucgaggacgauauuuuccggaaaaagagacugaccaucauggaccuucaccccggagcuggcaaaacaaagcgcuaccugccugccauuguccgggaagccaucaaaagagggcugcgcacgcucauucuggcuccgacccgggugguugccgcugagauggaagaggcccuuagaggacugcccauccgcuaucagaccccugcgauucgggccgagcauaccggcagagaaaucguggaccucaugugucacgcuaccuuuacaaugcggcugcucucccccguccgcgugccuaacuacaaucugaucauuauggaugaggcccacuucacggaccccgcuucuaucgccgccagaggguauauuagcacccggguugaaaugggcgaggcugcgggaaucuuuaugacagccaccccgccuggcucccgcgaucccuucccccagagcaacgcuccuauuauggacgaggaaagagagauccccgaacggucuuggaacuccgggcaugagugggugacagauuuuaagggaaagaccgucugguucgugccuagcaucaaagccggcaacgacauugccgcuugccuuagaaagaaugggaaaaagguuauccaacugucucgcaaaacguuugauagcgaauacgugaagacacgggccaacgacugggauuucgucgugaccaccgacauuuccgagaugggagcgaauuuuagagcugagcgcgugaucgauccgcggagauguaugaagcccgucauucugacagacggcgaggaacgcguuauccucgccgggccuaugcccgugacccacucuagcgccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauacaccggaagggauuaucccuuccauguucgagcccgaacgggagaagguggacgccauugauggagaauaccgccucagaggcgaggcucggaaaaccuuugucgaccugaugcgcagaggggaucugccuguguggcucgccuaucggguugcugccgagggaaucaacuacgcugacagacgcugguguuucgauggcauuaagaauaaccaaauccuugaagagaacguggaagucgagaucuggacgaaagagggggaacggaagaagcugaaacccagauggcuggacgcccgcauuuauucugauccucucgcgcugaaggaguucaaagaauuugccgcuggccggaagucccuuacacugaaucucaucaccgagaugggaagacugcccacauucaugacccagaaagcccgggacgcucuggauaaccucgccgugcuucacacggccgaaguuggcgggcgcgcuuacaaucacgcgcuguccgagcugccggagacccucgaaacacugcuucugcucacccugcuggccacagugaccggaggcauuuuucucuuccuuaugagcgggaagggaaucggcaagaugacacugggcaugugcugcauuaucaccgcuucuauccugcucugguaugcccagauucagccucauuggaucgccgcuuccauuauccuggaguuuuuccuuauuguccugcucauccccgaacccgagaaacaaagaacgccucaggacaaccagcugacauacguggucaucgccauucugaccgugguugcggccaccauggcuaaugaaaugggguuucucgagaagaccaagaaggaccuuggacugggcagcaucaccacacaggaguccgaaucuaacauucuggauaucgaccuccggccggccagcgcuuggacgcuguaugccguggcgaccacauucgugacccccaugcuucgccacuccauugaaaauucuagcgucaacguuucccugacagccaucgcuaaucaagccaccgugcucauggggcugggaagaggcuggccucugagcaaaauggauauuggggugccccuccuugcuaucggauguuacucucaggucaacccuaucacgcugaccgccgcucugcuccugcuuguggcccauuacgcgauuaucggccccggccugcaggccaaggcuacacgggaagcccagaagcgcaccgcugccgggauuaugaaaaauccuacaguugacggaaucaccgugauugaucucgagccgauccccuaugacccuaaguuugaaaaacaacugggccaggucaugcugcucgugcuuugcgucacacaggugcugaugaugagaacaaccugggcccugugugaggcgcucacacuggcuaccgggcccaucuccacccuuugggagggaaacccuggccgguucuggaauacaacgauugccguuagcauggcuaacaucuuucgcgggucuuaccuggccggagccggccuccuguucuccauuaugaagaauaccacaaacaccagacggggcacagggaauaucggagaaacccugggcgagaaauggaaaagcagacucaacgcucuugggaagucugaauuucagauuuauaaaaagagcggaauccaagagguggaucgcacgcuggccaaagagggcaucaagagaggggaaacagaccaccaugcggucuccagaggaucugccaaacugcgcugguucguggagcggaacaugguuacccccgaaggcaagguggucgaucucggcugcgggagaggaggcuggagcuacuauugugggggacugaaaaaugugcgcgaggugaagggccuuaccaaagggggaccgggccacgaggagccuauucccauguccacauacggcuggaaccugguucggcuccagagcggggucgacguguucuuuacacccccugagaaaugcgauacacugcugugugacaucggagaauccucucccaauccuacgauugaggcuggcagaacccuccgcgugcuuaaccuggucgaaaauuggcugaacaauaacacacaguucugcaucaagguucucaauccguauaugcccagcgugauugagaaaauggaaacccugcaacggaaguacgggggagcccuugugagaaacccucugucccgcaauucuacacacgagauguacugggucagcaacgcuaccggcaauaucguguccucuguuaacaugaucagccggaugcucauuaauagauuuacgaugaaacauaagaaggccaccuaugagcccgauguggaccugggguccggaacacgcaacaucggcauugaaaacgagaucccuaaucuggacauuaucggcaaaagaauugaaaagaucaaacaggagcacgaaaccagcuggcauuacgaucaggaccaccccuauaagacaugggcguaccacgggucuuaugagaccaaacagacaggauccgccagcucuauggucaacggcgugguuaagcuccuuaccaagccgugggauguggucccuauggugacgcaaauggcuaugacagacaccacccccuucgggcagcagcggguguuuaaagagaaggucgauacacgcacgcaggaaccuaaagagggaaccaagaaacugaugagaaucacagccgaauggcuguggaaggagcucggcaagaaaaagacaccccggauguguacaagagaggaguucacccggaaaguucgcuccaaugcugcccugggggcuauuuuuacagacgagaacaaguggaaaagcgccagagaagcgguggaggauucucgguucugggaacuuguggaccgcgagagaaaucugcaucucgagggaaagugcgaaaccugugucuacaacaugaugggcaaacgggagaagaagcugggcgaauuugggaaagccaagggaucccgcgcuaucugguauauguggcugggcgccagauuccucgaguuugaagcucugggguuccuuaaugaggaucacugguuuagccggggaaacucccugagcggcguggagggggaaggccuccauaaacugggauacauucuucgcgacguuucuaagaaagagggcggggccauguacgccgaugacacggcgggaugggacaccagaaucacacuggaagaucucaagaaugaggaaauggugaccaaccacaugaagggcgagcauaaaaagcuggcugaggccauuuucaaacugacauaucaaaauaaggucgugcggguucagcgcccuacccccagagggacggugauggacaucaucagccggaaagaucagcgcggauccggccaggucgggacauacggccucaacaccuucacaaauauggaagcccaacugauuagacagauggagggagaaggcaucuuuaagucuauucagcggcuuaccgugacggaggagaucgcuguucaaaacuggcuggccagaguggggcgcgaacggcucagcagaauggcuauuuccggagacgauugcgucgugaagccgcuggacgaucgcuucgccucugcgcuuaccgcccugaaugacaugggcaaaguccggaaggauauccagcagugggagccuagcagaggguggaacgacuggacacaggugcccuuuugcucccaccacuuccaugaacucguuaugaaagauggacgcgugcuggucgugcccugucggaaccaagacgagcugaucggcagagcucgcauuucucagggggccggcuggagccucaaggaaaccgcuugccugggaaaauccuaugcccagauguggacacuuauguacuuucaccggagagaucugcgccucgcggccaaugcuaucuguagcgccgugccuucucauuggguuccgaccucccggacaaccuggagcauucacgcuaagcacgaguggaugacgacagaggacaugcuggccguguggaacagagucuggauccaggaaaaucccuggauggaggacaagaccccuguggaaucuugggaggaaguucccuaucuuggcaaacgggaggaucaauggugcgggucccugauuggacucaccagcagagcuacaugggccaagaacauccagaccgcgauuaaucaggugcgcucccugaucggcaacgaggaauacacagacuauaugccuucuaugaaacgguucagaaaggaggaagaggaagccgggguccugugguga

SEQ ID NO: 19972 - RNA, 9876 nt, Artificial Sequence
  derived and/or modified CDS sequence (opt5) from DENV-2__EU687241__SS-prME
accgccggagugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacagcaucggaaccacccacuuucagagagcucugauuuucauccuucugacagccguggcgccuuccaugacgaugcggugcauuggcaucucuaaccgcgauuuugucgaaggggugagcggaggcuccuggguugacaucgugcucgagcacgggagcugugucaccacaauggccaagaauaagcccacccuggauuucgaacuuacaaaaaccgaggcuaagcagccugccacgcugagaaaauauugcauugaagcuaagcucacaaacaccaccacagagucucgguguccgacccaaggagagcccucccugaaugaagaacaggacaaacgcuuuaucugcaagcauagcaugguggauagaggcuggggcaacggguguggacuguucggcaaagggggaauugugacaugcgccauguuuacgugcaaaaagaauauggaaggcaaagucguucucccugagaaccuggaauacaccaucgugauuacaccccacucuggggaggagcaugcggugggaaaugacaccggcaagcacggcaaagaaaucaagaucacaccucaguccagcauuaccgaggccgaacuuacgggguauggaaccgucacaauggaguguucuccccggaccggccuggauuucaacgaaauggugcuccugcagauggaggacaaggcuuggcuuguucaccgccaaugguuucuggaucucccgcugccuuggcugcccggggccgacacacagggauccaauuggauccagaaggagacccucgugacguucaagaacccucaugcuaaaaagcaggacgucgugguucugggcagccaagaaggggccaugcacacagcccuuaccggcgcuacagagauucagauguccucuggaaaucugcucuuuaccggccaucugaaaugcagacuucggauggauaagcugcagcucaaagggaugagcuacuccauguguaccggaaaguucaagaucgugaaagaaauugcggagacacaacacggcacgaucgucaucagagugcaguaugagggggacggaagccccugcaagauucccuucgaaaucauggaucuggagaaacgccauguccugggccggcucauuaccgugaacccuaucguuacagaaaaggacucuccggugaacauugaggccgaacccccuuuuggggauuccuacaucauuaucggcgucgagcccggacagcugaaacuuaauugguucaagaagggcagcucuaucgggcagauguuugagaccacaaugagaggagcuaaacgcauggccauucugggcgacaccgccugggauuucgggagccucggaggcguguuuacguccaucgggaaggcucugcaccaaguuuucggcgccauuuacggagcggcuuuuucuggcgugagcuggacaaugaaaauccugauuggggucaucaucaccuggauuggaaugaacucccggagcaccucucuuuccgugagccucgugcugguuggcgucgugacacuguaucucggggugaugguccaggccgacaccggaugugugguuucuuggaagaauaaagaacugaagugcggcuccgggaucuucauuacagauaacgugcacacguggaccgagcaguacaaguuucagccugaaagccccuccaaacuugccucugcuauccaaaaggcccaugaggaaggcauuuguggaaucagaagcgucacacgccuggagaaucucauguggaaacagaucaccccggagcugaaccacauucuguccgaaaaugaggugaaacuuacaaucaugaccggcgacauuaaagggaucaugcaggcuggaaagcggucucucagaccucagcccacggaacugaaauauagcuggaagaccuggggcaaggccaaaaugcuguccacagagagccauaaccaaaccuuccucauugaugggccugaaacagcggagugccccaauaccaaccgcgccuggaacucucuggagguugaagacuacggauuuggcguguucuccacaaacaucuggcuuaagcugcgggagaaacaggacgucuuuugugauagcaagcucaugucugcugccaucaaagacaauagagcugugcacgccgauaugggcuauuggauugaauccgcgcugaacgacaccuggaagauggagaaggccagcuucaucgagauuaaaucuugccacuggccuaagagccauacgcugugguccaaugggguucuugaaagcgagaugaucauucccaaaaacuucgcuggaccggugucucagcacaacuaccgcccuggcuaucauacacagaccgccgggcccuggcaccucggaaagcuggaaauggauuuugacuucugugagggcaccacagucguggugaccgaagauugcgggaaucggggacccucccugagaacgacaaccgcuagcggcaaacucaucacagaguggugcugucgguccugcacccugccuccgcuucgcuacagaggcgaggacggguguugguacggaauggaaauucggccccugaaggagaaggaagagaaccucgucaauucucugguuacagccggccaugggcaaaucgauaacuuuagccugggagugcuuggcauggcccucuuccuggaagagaugcugagaacccgcguggggacgaaacacgcuauccuccuggucgcgguguccuuuguuacccuuauuacaggaaauaugucuuuccgggaccugggcagagugauggucauggugggcgccaccaugacagaugacaucgggaugggaguuaccuaucucgcucugcuggccgccuuuaaggugcgcccuacguucgcugccggccuucugcucagaaaacugacaagcaaggagcucaugauggcgaccauugggaucgcucugcuuucccagucuacaauucccgaaaccauccuggagcucaccgaugcccuggcccugggaaugaugguccuuaaaaucgugcggacaauggaaaaguaccagcuggcuguuacgauuauggccaucagcugcgugccuaacgcggucauucuccaaaaugcuuggaagguguccuguaccauccuggccgccgugagcgucucuccccuccugcuuacauccagccagcagaaagcugacuggauuccucuggcccucaccaucaagggccugaaccccacagcuaucuuucugaccacgcuuucucgcacauccaaaaagagaagcuggccgcugaaugaggccguuauggcgguggggauggugucuauucucgccuccagccugcucaaaaacgacaucccuaugaccggaccccuggucgcuggcggccuucugaccgugugcuauguucugacagggcgguccgccgaucucgaacuggagcgcgcugccgacgugaagugggaggaucaggccgaaauuagcggaucuagcccuauccuuuccauuaccaucucugaggacggcagcauguccauuaaaaaugaagaggaggaacacacacugacgauccucaucagaaccgggcugcucgucauuucuggaguguuccccguuagcaucccgauuacagcugcggccugguaccugugggaggugaagaagcaacgggcuggcguccuuugggaugugccuucucccccucccgucgggaaagccgaacuggaggacggagccuaucgcaucaagcagagaggcauuuuuggcuacagccagaucggggcuggaguguauaaagaaggcaccuuccauacaauguggcacguuaccagaggggccgugcugaugcaucgcggaaagagaaucgagcccagcugggcggaugucaaaaaggaccucauuuccuacggcgggggauggaagcuggagggcgaauggaaagagggcgaagaggugcagguucuugcucuggaaccugggaagaacccgcgggccgugcaaacgaaacccggacucuuuaagaccaauacaggcaccaucggggccgucagccuggauuucucuccuggaacauccggcagccccauuguggacagaaaagggaaggugguuggacucuacggcaacggcgucgugacccgcucuggggcuuauguguccgccaucgcgcagacagaaaagagcauugaggauaauccugaaaucgaggacgauaucuuccggaaaaagagacugacgauuauggaccuucaccccggagcuggcaaaaccaagcgcuaccugccugccaucguccgggaagccauuaaaagagggcugcgcacacucauccuggcuccgacccgggugguugccgcugagauggaagaggcccuuagaggacugcccauucgcuaucagaccccugcgauccgggccgagcauacaggcagagaaauuguggaccucaugugucacgcuacguuuaccaugcggcugcucucccccguccgcgugccuaacuacaaccugaucaucauggaugaggcccacuucacagaccccgcuucuauugccgccagaggguauaucagcacccggguugaaaugggcgaggcugcgggaauuuuuaugacagccaccccgccuggcucccgcgaucccuucccccagagcaaugcuccuaucauggacgaggaaagagagauucccgaacggucuuggaacuccgggcaugagugggugacggauuuuaagggaaagacagucugguucgugccuagcaucaaagccggcaaugacaucgccgcuugccuuagaaagaacgggaaaaagguuauucaacugucucgcaaaaccuuugauagcgaauacgugaagacccgggccaaugacugggauuucgucgugacaaccgacaucuccgagaugggagcgaacuuuagagcugagcgcgugauugauccgcggagauguaugaagcccgucauccugacagacggcgaggaacgcguuauucucgccgggccuaugcccgugacccacucuagcgccgcucagcggagaggccgcaucggaagaaauccuaaaaacgaaaaugaccaguauaucuacaugggcgagccccuggaaaacgaugaggacugcgcccauuggaaggaggcgaaaaugcuucuggauaauauuaacacgccggaagggaucauuccuuccauguucgagcccgaacgggagaagguggacgccaucgauggagaauaccgccucagaggcgaggcucggaaaacauuugucgaccugaugcgcagaggggaucugccuguguggcucgccuaucggguugcugccgagggaauuaauuacgcugacagacgcugguguuucgauggcaucaagaacaaucaaauucuugaagagaacguggaagucgagaucuggaccaaagagggggaacggaagaagcugaaacccagauggcuggacgcccgcaucuauucugauccucucgcgcugaaggaguucaaagaauuugccgcuggccggaagucccuuacacugaaccucauuaccgagaugggaagacugcccacguucaugacccagaaagcccgggacgcucuggauaaucucgccgugcuucacacagccgaaguuggcgggcgcgcuuacaaccacgcgcuguccgagcugccggagacccucgaaacacugcuucugcucacccugcuggccacagugaccggaggcaucuuucucuuccuuaugagcgggaagggaauuggcaagaugacgcugggcaugugcugcaucauuacagcuucuauccugcucugguaugcccagauccagccucauuggauugccgcuuccaucauucuggaguuuuuccuuaucguccugcucauucccgaacccgagaaacaaagaaccccucaggacaaucagcugaccuacguggucaucgccauccugacagugguugcggccaccauggcuaacgaaaugggguuucucgagaagaccaagaaggaccuuggacugggcagcauuacgacccaggaguccgaaucuaauauccuggauauugaccuccggccggccagcgcuuggacacuguaugccguggcgaccacauucgugacccccaugcuucgccacuccaucgagaacucuagcgucaauguuucccugacggccauugcuaaccaagccaccgugcucauggggcugggaagaggcuggccucugagcaaaauggauaucggggugccccuccuugcuauuggauguuacucucaggucaauccuaucacacugaccgccgcucugcuccugcuuguggcccauuacgcgaucauuggccccggccugcaggccaaggcuacacgggaagcccagaagcgcaccgcugccgggaucaugaaaaacccuacgguugacggaauuacagugaucgaucucgagccgauucccuaugacccuaaguuugaaaaacaacugggccaggucaugcugcucgugcuuugcgucacccaggugcugaugaugagaacaaccugggcccugugugaggcgcucacccuggcuacagggcccaucuccacgcuuugggagggaaauccuggccgguucuggaacaccacaaucgccguuagcauggcuaauauuuuucgcgggucuuaccuggccggagccggccuccuguucuccaucaugaagaacaccacaaauaccagacggggcacggggaacauuggagaaacacugggcgagaaauggaaaagcagacucaaugcucuugggaagucugaauuucagaucuauaaaaagagcggcauucaagagguggaucgcacccuggccaaagagggcaucaagagaggggaaaccgaccaccaugcggucuccagaggaucugccaaacugcgcugguucguggagcggaacaugguuacacccgaaggcaagguggucgaucucggcugcgggagaggaggcuggagcuacuauugugggggacugaaaaacgugcgcgaggugaagggccuuaccaaagggggaccgggccacgaggagccuauccccauguccacauacggcuggaaucugguucggcuccagagcggggucgacguguucuuuacgcccccugagaaaugcgauacccugcugugugacauuggagaauccucucccaacccuacaaucgaggcuggcagaacccuccgcgugcuuaaucuggucgaaaacuggcugaauaacaauacacaguucugcguuaaggugcucaacccguauaugcccagcgugauugagaaaauggaaacccugcaacggaaguacgggggagcccuugucagaaauccucugucccgcaacucuacgcacgagauguacugggugagcaaugcuaccggcaacaucguuuccucugugaauaugauuagccggaugcucaucaacagauuuacaaugaaacauaagaaggccaccuaugagcccgaugucgaccugggguccggaacacgcaauaucggcauugaaaacgagaucccuaaccuggacauuaucggcaaaagaauugaaaagaucaaacaggagcacgaaaccagcuggcauuacgaucaggaccaccccuauaagacaugggcguaccacgggucuuaugagaccaaacagacgggauccgccagcucuauggugaauggcguugugaagcuccuuacaaagccgugggaugucgugccuauggugacccaaauggcuaugaccgacacaacgcccuucgggcagcagcgggucuuuaaagagaagguugauacccgcacacaggaaccuaaagagggaaccaagaaacugaugagaauuacagccgaauggcuguggaaggagcucggcaagaaaaagacaccccggauguguacaagagaggaguucacccggaaagugcgcuccaacgcugcccugggggcuaucuuuacggacgagaauaaguggaaaagcgccagagaagcgguggaggauucucgguucugggaacuugucgaccgcgagagaaaccugcaucucgagggaaagugcgaaaccuguguguacaauaugaugggcaaacgggagaagaagcugggcgaauuugggaaagccaagggaucccgcgcuaucugguauauguggcugggcgccagauuccucgaguuugaagcucugggguuccuuaacgaggaucacugguuuagccggggaaauucccugagcggcguugagggggaaggccuccauaaacugggauacauucuucgcgacgugucuaagaaagagggcggggccauguacgccgaugacacagcgggaugggacaccagaaucacacuggaagaucucaagaacgaggaaauggucaccaaucacaugaagggcgagcauaaaaagcuggcugaggccauuuucaaacugacguaucaaaacaaggugguucgggugcagcgcccuacacccagagggaccgucauggacaucauuagccggaaagaucagcgcggauccggccaggugguuacauacgggcucaauaccuucacgaacauggaagcccaacugaucagacagauggagggcgaaggaaucuuuaagucuauucagcggcuuaccgugacagaggagaucgcuguccaaaauuggcuggccagagugggccgcgaacggcucagcagaauggcuauuuccggggacgauugcgucgugaagccgcuggacgaucgcuucgccucugcgcuuaccgcccugaacgacaugggaaaaguucggaaggauauccagcagugggagccuagcagaggcuggaaugacuggacacaggugcccuuuugcucccaccacuuccaugaacucgucaugaaagaugggcgcgugcuggugguucccugucggaaccaagacgagcugauuggacgggcucgcaucucucagggcgccggguggagccucaaggaaaccgcuugccugggcaaauccuaugcccagauguggacacuuauguacuuucaccggagagaucugcgccucgcggccaacgcuaucuguagcgccgugccuucucauugggucccgaccucccggacgacauggagcauucacgcuaagcacgaguggaugaccaccgaggacaugcuggccguguggaauagaguuuggauccaggaaaaccccuggauggaggacaagacaccuguggaaucuugggaggaaguccccuaucuuggaaaacgggaggaucaauggugcggcucccugauugggcucaccagcagagcuacaugggccaagaauauccagacggcgauuaaccaggugcgcucccugaucggaaaugaggaauacaccgacuauaugccuucuaugaaacgguucagaaaggaggaagaggaagccggcguccugugguga

SEQ ID NO: 19973 - RNA, 9876 nt, Artificial Sequence
  derived and/or modified CDS sequence (opt5) from DENV-2__EU687242__SS-prME
acagccggcgugaucauuaugcugauccccacagcuauggccuuccaccucacgacccggaauggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacauccgggggauuaugcaggcuggaaaaagaucccuccgcccucagcccacggaacugaaguauucuuggaaaaccuggggcaaggccaagaugcugagcacagagucccauaaccaaaccuuccucaucgaugggccugaaacagcggagugccccaauaccaaccgggccuggaauagccuggagguugaagacuacggauuuggcguguucucuacaaacaucuggcuuaaacugagagagaagcaggacgucuuuugugauuccaaacucaugagcgcugccauuaaggacaaucgcgcugugcacgccgauaugggcuauuggaucgaaucugcgcugaacgacaccuggaaaauggagaaggccuccuucauugagaucaagagcugcuacuggccuaaaucucacacgcuguggagcaaugggguucuugaauccgagaugauuauccccaagaacuucgcuggaccggugagccagcauaacuaucggccuggcuaccacacacagaccgccgggcccuggcaucucggaaaacuggaaauggauuuugacuucugugagggcaccacagucguggugaccgaagauugcgggaauagaggacccucucugcggacgacaaccgcuuccggcaagcucauuacagaguggugcugucgcagcugcacccugccuccgcuuagauaccggggcgaggacggguguugguauggaauggaaaucagaccccugaaagagaaggaagagaaccucgucaauucccugguuacagccggccacgggcaaaucgauaacuuuucucugggagugcuuggcauggcccucuuccuggaagagaugcugcgcacccggguggggacgaagcaugcuauucuccuggucgcggugagcuuuguuacccuuaucacaggaaauauguccuucagagaccugggccgcgugauggucauggugggcgccaccaugacagaugacauugggaugggaguuaccuaccucgcucugcuggccgccuuuaaagugagaccuacguucgcugccggccuucugcuccggaagcugacaucuaaagagcucaugauggcgaccaucgggauugcucugcuuagccaguccacaauccccgaaaccauccuggagcucaccgaugcccuggcccugggaaugaugguccuuaagauugugcgcaacauggaaaaauaucagcuggcuguuacaaucauggccauuucuugcgugccuaaugcggucauccuccaaaacgcuuggaaggugagcuguacgauucuggccgccguguccgucagcccccuccugcuuaccucuucccagcagaaggcugacuggaucccucuggcccucacaaucaaaggccugaaucccaccgcuauuuuucugacaacccuuagcagaacgucuaagaaacgguccuggccgcugaacgaggccguuauggcgguggggauggugagcauccucgccucuucccugcucaagaaugacauuccuaugacaggaccccuggucgcuggcggccuucugaccgugugcuacguucugaccgggcgcagcgccgaucucgaacuggagagagcugccgacgugaaaugggaggaucaggccgaaaucuccggaagcucuccuauucuuagcaucacaauuuccgaggacggcucuaugagcaucaagaacgaagaggaggaacacacccugacaauccucauucggacggggcugcucgucaucuccggaguguuccccguuucuauuccgaucaccgcugcggccugguaucugugggaggugaaaaagcaacgcgcuggcguccuuugggaugugccuucucccccucccgucgggaaggccgaacuggaggacggagccuacagaauuaaacagcggggcaucuuuggcuauucccagaucggggcuggaguguacaaggaaggcacauuccacaccauguggcauguuacacgcggggccgugcugaugcacagaggaaaacggauugagcccuccugggcggaugucaagaaagaccucaucagcuacggcgggggauggaagcuggagggcgaauggaaggagggcgaagaggugcagguucuugcucuggaaccugggaaaaauccgagagccgugcaaaccaagcccggacucuuuaaaacgaacaccggcacaauuggggccgucucccuggauuucagcccuggaaccucuggcucccccaucguggaccgcaaggggaaagugguuggacucuauggcaauggcgucgugacacggagcggggcuuacgugucugccauugcgcagaccgagaaguccaucgaggauaacccugaaaucgaggacgauauuuucagaaagaaacgccugacaaucauggaccuucaucccggagcuggcaagacgaaacgguaucugccugccauugucagagaagccaucaagcgcgggcugcggacccucauucuggcuccgacaagagugguugccgcugagauggaagaggcccuucgcggacugcccauccgguaccagaccccugcgauuagagccgagcacaccggccgggaaaucguggaccucaugugucaugcuacauuuacgaugcgccugcucagccccgucagagugccuaacuauaaucugaucauuauggaugaggcccacuucaccgaccccgcuuccaucgccgcccggggguacauuucuacacgcguugaaaugggcgaggcugcgggaaucuuuaugaccgccacaccgccuggcagcagagaucccuucccccaguccaacgcuccuauuauggacgaggaacgggagauccccgaaagaagcuggaacucugggcacgagugggugaccgauuuuaaaggaaagacggucugguucgugccuuccaucaaggccggcaacgacauugccgcuugccuucgcaaaaaugggaagaaaguuauccaacugagccggaagacauuugauucugaauaugugaaaaccagagccaacgacugggauuucgucgugaccacagacauuagcgagaugggagcgaauuuucgcgcugagcgggugaucgauccgagacgcuguaugaagcccgucauucugaccgacggcgaagaacggguuauccucgccgggccuaugcccgugacacauuccucugccgcucagagacgcggcagaaucggacggaacccuaagaaugaaaacgaccaguacauuuacaugggcgagccccuggaaaaugaugaggacugcgcccacuggaaagaggcgaagaugcuucuggauaacaucaauaccccggaagggauuaucccuagcauguucgagcccgaacgcgagaaaguggacgccauugauggagaauauagacuccggggcgaggcucgcaagacguuugucgaccugaugagaagaggggaucugccuguguggcucgccuacagaguugcugccgagggaaucaacuaugcugaccgccggugguguuucgauggcauuaaaaauaaccaaauccuugaagagaacguggaagucgagaucuggacaaaggagggggaacgcaagaagcugaagccccgcuggcuggacgcccggauuuacuccgauccucucgcgcugaaagaguucaaggaauuugccgcuggcagaaaaucucuuacccugaaucucaucacagagaugggacggcugcccaccuucaugacgcagaaggcccgcgacgcucuggauaaccucgccgugcuucauaccgccgaaguuggcgggagagcuuauaaucacgcgcugaacgagcugccggagacacucgaaacccugcuucugcucacacugcuggccaccgugacaggaggcauuuuucucuuccuuaugagcgggaaaggaaucggcaagaugacccugggcaugugcugcauuaucacggcuuccauccugcucugguacgcccagauucagccucacuggaucgccgcuagcauuauccuggaguuuuuccuuauuguccugcucauccccgaacccgagaagcaacggacaccucaggacaaucagcugaccuauguggucaucgccauucugaccgugguugcggccacaauggcuaacgaaaugggguuucucgagaaaaccaagaaagaccuuggacugggcucuaucacaacgcaggaguccgaaagcaauauucuggauaucgaccuccgcccggccuccgcuuggacccuguacgccguggcgacaaccuucgugacacccaugcuuagacauucuauugagaacagcuccgucaauguuucucugaccgccaucgcuaaccaagccacggugcucauggggcugggacggggcuggccucugagcaagauggauauuggggugccccuccuugcuaucggauguuacucccaggucaauccuaucacccugacagccgcucugcuccugcuuguggcccacuaugcgauuaucggccccggccugcaggccaaagcuacccgcgaagcccagaagagaacagcugccgggauuaugaagaacccuaccguugacggaaucacggugauugaucucgagccgauccccuacgacccuaaauuugaaaagcaacugggccaggucaugcugcucgugcuuugcgucacacaggugcugaugaugcggaccacaugggcccugugugaggcgcucacccuggcuaccgggcccaucagcacacuuugggagggaaauccuggccgcuucuggaacacgaccauugccguuucuauggcuaauaucuuuagaggguccuaucuggccggagccggccuccuguucagcauuaugaaaaacacaaccaauacacggagaggcaccgggaacaucggagaaacgcugggcgagaaguggaaaucucgccucaacgcucuugggaaguccgaauuucagauuuacaagaaaagcggaauccaagagguggaucggacacuggccaaggagggcaucaaaagaggggaaaccgaccaucacgcggucucucgcggaagcgccaagcugcggugguucguggagagaaauaugguuacccccgaaggcaaaguggucgaucucggcugcgggcgcggaggcugguccuauuacugugggggacugaagaacgugcgggaggugaaaggccuuacaaaagggggaccgggccaugaggaaccuauucccaugucuaccuauggcuggaaucugguuagacuccagagcggggucgacguguucuuuacacccccugagaagugcgauacgcugcugugugacaucggagaauccagccccaacccuaccauugaggcuggccgcacacuccgggugcuuaaucuggucgaaaacuggcugaauaacaauacccaguucugcguuaaagugcucaacccguacaugcccuccgugaucgagaagauggaaacacugcaaagaaaauacgggggagcccuuguccgcaauccucugucucggaacagcacccacgagauguauuggguguccaaugcuacgggcaacauuguuucuagcgugaauaugaucuccagaaugcucaucaaccgcuuuaccaugaagcacaaaaaggccacauacgagcccgaugucgaccuggggucuggaaccagaaacauuggcaucgaaaaugagauuccuaaccuggacaucauuggcaagcggaucgagaagauuaagcaggagcaugaaacaagcuggcacuaugaucaggaccaucccuacaaaaccugggcguaucacggguccuacgagacaaagcagaccggaagcgccucuuccauggugaauggcguugugaaacuccuuacgaagccgugggaugucgugccuauggugacacaaauggcuaugaccgacaccacacccuucgggcagcagcgcgucuuuaaggagaaaguugauacgagaacccaggaaccuaaggagggaaccaaaaagcugaugcggaucaccgccgaauggcuguggaaagagcucggcaagaagaaaacacccagaauguguacccgggaggaguucacacgcaaggugagaagcaacgcugcccugggggcuaucuuuaccgacgagaauaaauggaagucugcccgggaagcgguggaggauucccgcuucugggaacuugucgacagagagcggaaccugcaccucgagggaaaaugcgaaacguguguguauaauaugaugggcaagcgcgagaaaaagcugggcgaauuugggaaggccaaaggaagcagagcuauuugguacauguggcugggcgcccgguuccucgaguuugaagcucugggguuccuuaacgaggaucauugguuuucucgcggaaauucccugagcggcguugagggggaaggccuccacaagcugggauacauccuuagagacguguccaaaaaggagggcggggccauguaugccgaugacaccgcgggaugggacacacggauuacccuggaagaucucaaaaacgaggaaauggucacaaaucauaugaagggcgagcacaagaaacuggcugaggccaucuucaagcugaccuaccaaaacaaagugguucgcgugcagagaccuacgccccgggggacagucauggacauuaucagccgcaaggaucagagaggaucuggccagguggggaccuauggccucaauacauucaccaacauggaagcccaacugauccggcagauggagggagaaggcauuuuuaaaagcauccagagacuuacgguuaccgaggagauugcugugcaaaauuggcuggcccgcgucgggcgggaaagacucucccgcauggcuaucucuggagacgauugcguggucaagccgcuggacgaucgguucgccagcgcgcuuacagcccugaacgacaugggcaaggugagaaaagauauucagcagugggagccuucccgcggguggaacgacuggacccagguucccuuuugcucucaucacuuccacgaacucgugaugaaggauggacggguccugguggugcccuguagaaaucaagacgagcugaucggccgcgcucggaucagccagggggccggcuggucccucaaagaaacagcuugccugggaaagucuuacgcccagauguggacccuuauguauuuucauagacgcgaucugcggcucgcggccaacgcuauuuguagcgccguuccuucccacugggugccgacaagcagaaccacguggucuauccaugcuaaacacgaguggaugacaaccgaggacaugcuggccgucuggaaucggguguggauucaggaaaaccccuggauggaggacaagaccccuguugaauccugggaggaagugcccuaccuuggcaagagagaggaucaauggugcgggagccugaucggacucacaucucgcgcuaccugggccaaaaauauucagacagcgaucaaccagguccggucccugauuggcaaugaggaauauacggacuacaugccuagcaugaagagauuccgcaaagaggaagaggaagccggggugcugugguga

SEQ ID NO: 19974 - RNA, 9876 nt, Artificial Sequence
  derived and/or modified CDS sequence (opt5) from DENV-2__EU687243__SS-prME
acagccggcgugaucauuaugcugauccccacagcuauggccuuccaccucacgacccggaauggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacauccgggggauuaugcaggcuggaaaaagaucccuccgcccucagcccacggaacugaaguauucuuggaaaaccuggggcaaggccaagaugcugagcacagagucccauaaccaaaccuuccucaucgaugggccugaaacagcggagugccccaauaccaaccgggccuggaauagccuggagguugaagacuacggauuuggcguguucucuacaaacaucuggcuuaaacugagagagaagcaggacgucuuuugugauuccaaacucaugagcgcugccauuaaggacaaucgcgcugugcacgccgauaugggcuauuggaucgaaucugcgcugaacgacaccuggaaaauggagaaggccuccuucauugagaucaagagcugccacuggccuaaaucucauacgcuguggagcaaugggguucuugaauccgagaugauuauccccaagaacuucgcuggaccggugagccagcacaacuaccggccuggcuaucauacacagaccgccgggcccuggcaccucggaaaacuggaaauggauuuugacuucugugagggcaccacagucguggugaccgaagauugcgggaauagaggacccucucugcggacgacaaccgcuuccggcaagcucauuacagaguggugcugucgcagcugcacccugccuccgcuuagauaccggggcgaggacggguguugguacggaauggaaaucagaccccugaaagagaaggaagagaaccucgucaauucccugguuacagccggccaugggcaaaucgauaacuuuucucugggagugcuuggcauggcccucuuccuggaagagaugcugcgcacccggguggggacgaagcacgcuauucuccuggucgcggugagcuuuguuacccuuaucacaggaaauauguccuucagagaccugggccgcgugauggucauggugggcgccaccaugacagaugacauugggaugggaguuaccuaucucgcucugcuggccgccuuuaaagugagaccuacguucgcugccggccuucugcuccggaagcugacaucuaaagagcucaugauggcgaccaucgggauugcucugcuuagccaguccacaauccccgaaaccauccuggagcucaccgaugcccuggcccugggaaugaugguccuuaagauugugcgcaacauggaaaaauaccagcuggcuguuacaaucauggccauuucuugcgugccuaaugcggucauccuccaaaacgcuuggaaggugagcuguacgauucuggccgccguguccgucagcccccuccugcuuaccucuucccagcagaaggcugacuggaucccucuggcccucacaaucaaaggccugaaucccaccgcuauuuuucugacaacccuuagcagaacgucuaagaaacgguccuggccgcugaacgaggccguuauggcgguggggauggugagcauccucgccucuucccugcucaagaaugacauuccuaugacaggaccccuggucgcuggcggccuucugaccgugugcuauguucugaccgggcgcagcgccgaucucgaacuggagagagcugccgacgugaaaugggaggaucaggccgaaaucuccggaagcucuccuauucuuagcaucacaauuuccgaggacggcucuaugagcaucaagaacgaagaggaggaacacacccugacaauccucauucggacggggcugcucgucaucuccggaguguuccccguuucuauuccgaucaccgcugcggccugguaccugugggaggugaaaaagcaacgcgcuggcguccuuugggaugugccuucucccccucccgucgggaaggccgaacuggaggacggagccuauagaauuaaacagcggggcaucuuuggcuacucccagaucggggcuggaguguauaaggaaggcacauuccauaccauguggcacguuacacgcggggccgugcugaugcauagaggaaaacggauugagcccuccugggcggaugucaagaaagaccucaucagcuacggcgggggauggaagcuggagggcgaauggaaggagggcgaagaggugcagguucuugcucuggaaccugggaaaaauccgagagccgugcaaaccaagcccggacucuuuaaaacgaacaccggcacaauuggggccgucucccuggauuucagcccuggaaccucuggcucccccaucguggaccgcaaggggaaagugguuggacucuacggcaauggcgucgugacacggagcggggcuuaugugucugccauugcgcagaccgagaaguccaucgaggauaacccugaaaucgaggacgauauuuucagaaagaaacgccugacaaucauggaccuucaccccggagcuggcaagacgaaacgguaccugccugccauugucagagaagccaucaagcgcgggcugcggacccucauucuggcuccgacaagagugguugccgcugagauggaagaggcccuucgcggacugcccauccgguaucagaccccugcgauuagagccgagcauaccggccgggaaaucguggaccucaugugucacgcuacauuuacgaugcgccugcucagccccgucagagugccuaacuacaaucugaucauuauggaugaggcccacuucaccgaccccgcuuccaucgccgcccggggguauauuucuacacgcguugaaaugggcgaggcugcgggaaucuuuaugaccgccacaccgccuggcagcagagaucccuucccccaguccaacgcuccuauuauggacgaggaacgggagauccccgaaagaagcuggaacucugggcaugagugggugaccgauuuuaaaggaaagacggucugguucgugccuuccaucaaggccggcaacgacauugccgcuugccuucgcaaaaaugggaagaaaguuauccaacugagccggaagacauuugauucugaauacgugaaaaccagagccaacgacugggauuucgucgugaccacagacauuagcgagaugggagcgaauuuucgcgcugagcgggugaucgauccgagacgcuguaugaagcccgucauucugaccgacggcgaagaacggguuauccucgccgggccuaugcccgugacacacuccucugccgcucagagacgcggcagaaucggacggaacccuaagaaugaaaacgaccaguauauuuacaugggcgagccccuggaaaaugaugaggacugcgcccauuggaaagaggcgaagaugcuucuggauaacaucaauaccccggaagggauuaucccuagcauguucgagcccgaacgcgagaaaguggacgccauugauggagaauacagacuccggggcgaggcucgcaagacguuugucgaccugaugagaagaggggaucugccuguguggcucgccuauagaguugcugccgagggaaucaacuacgcugaccgccggugguguuucgauggcauuaaaaauaaccaaauccuugaagagaacguggaagucgagaucuggacaaaggagggggaacgcaagaagcugaagccccgcuggcuggacgcccggauuuauuccgauccucucgcgcugaaagaguucaaggaauuugccgcuggcagaaaaucucuuacccugaaucucaucacagagaugggacggcugcccaccuucaugacgcagaaggcccgcgacgcucuggauaaccucgccgugcuucacaccgccgaaguuggcgggagagcuuacaaucacgcgcugaacgagcugccggagacacucgaaacccugcuucugcucacacugcuggccaccgugacaggaggcauuuuucucuuccuuaugagcgggaaaggaaucggcaagaugacccugggcaugugcugcauuaucacggcuuccauccugcucugguaugcccagauucagccucauuggaucgccgcuagcauuauccuggaguuuuuccuuauuguccugcucauccccgaacccgagaagcaacggacaccucaggacaaucagcugaccuacguggucaucgccauucugaccgugguugcggccacaauggcuaacgaaaugggguuucucgagaaaaccaagaaagaccuuggacugggcucuaucacaacgcaggaguccgaaagcaauauucuggauaucgaccuccgcccggccuccgcuuggacccuguaugccguggcgacaaccuucgugacacccaugcuuagacacucuauugagaacagcuccgucaauguuucucugaccgccaucgcuaaccaagccacggugcucauggggcugggacggggcuggccucugagcaagauggauauuggggugccccuccuugcuaucggauguuacucccaggucaauccuaucacccugacagccgcucugcuccugcuuguggcccauuacgcgauuaucggccccggccugcaggccaaagcuacccgcgaagcccagaagagaacagcugccgggauuaugaagaacccuaccguugacggaaucacggugauugaucucgagccgauccccuaugacccuaaauuugaaaagcaacugggccaggucaugcugcucgugcuuugcgucacacaggugcugaugaugcggaccacaugggcccugugugaggcgcucacccuggcuaccgggcccaucagcacacuuugggagggaaauccuggccgcuucuggaacacgaccauugccguuucuauggcuaauaucuuuagaggguccuaccuggccggagccggccuccuguucagcauuaugaaaaacacaaccaauacacggagaggcaccgggaacaucggagaaacgcugggcgagaaguggaaaucucgccucaacgcucuugggaaguccgaauuucagauuuauaagaaaagcggaauccaagagguggaucggacacuggccaaggagggcaucaaaagaggggaaaccgaccaccaugcggucucucgcggaagcgccaagcugcggugguucguggagagaaauaugguuacccccgaaggcaaaguggucgaucucggcugcgggcgcggaggcugguccuacuauugugggggacugaagaacgugcgggaggugaaaggccuuacaaaagggggaccgggccacgaggaaccuauucccaugucuaccuacggcuggaaucugguuagacuccagagcggggucgacguguucuuuacacccccugagaagugcgauacgcugcugugugacaucggagaauccagccccaacccuaccauugaggcuggccgcacacuccgggugcuuaaucuggucgaaaacuggcugaauaacaauacccaguucugcguuaaagugcucaacccguauaugcccuccgugaucgagaagauggaaacacugcaaagaaaauacgggggagcccuuguccgcaauccucugucucggaacagcacccacgagauguacuggguguccaaugcuacgggcaacauuguuucuagcgugaauaugaucuccagaaugcucaucaaccgcuuuaccaugaagcauaaaaaggccacauaugagcccgaugucgaccuggggucuggaaccagaaacauuggcaucgaaaaugagauuccuaaccuggacaucauuggcaagcggaucgagaagauuaagcaggagcacgaaacaagcuggcauuacgaucaggaccaccccuauaaaaccugggcguaccacggguccuaugagacaaagcagaccggaagcgccucuuccauggugaauggcguugugaaacuccuuacgaagccgugggaugucgugccuauggugacacaaauggcuaugaccgacaccacacccuucgggcagcagcgcgucuuuaaggagaaaguugauacgagaacccaggaaccuaaggagggaaccaaaaagcugaugcggaucaccgccgaauggcuguggaaagagcucggcaagaagaaaacacccagaauguguacccgggaggaguucacacgcaaggugagaagcaacgcugcccugggggcuaucuuuaccgacgagaauaaauggaagucugcccgggaagcgguggaggauucccgcuucugggaacuugucgacagagagcggaaccugcaucucgagggaaaaugcgaaacguguguguacaauaugaugggcaagcgcgagaaaaagcugggcgaauuugggaaggccaaaggaagcagagcuauuugguauauguggcugggcgcccgguuccucgaguuugaagcucugggguuccuuaacgaggaucacugguuuucucgcggaaauucccugagcggcguugagggggaaggccuccauaagcugggauacauccuuagagacguguccaaaaaggagggcggggccauguacgccgaugacaccgcgggaugggacacacggauuacccuggaagaucucaaaaacgaggaaauggucacaaaucacaugaagggcgagcauaagaaacuggcugaggccaucuucaagcugaccuaucaaaacaaagugguucgcgugcagagaccuacgccccgggggacagucauggacauuaucagccgcaaggaucagagaggaucuggccagguggggaccuacggccucaauacauucaccaacauggaagcccaacugauccggcagauggagggagaaggcauuuuuaaaagcauccagagacuuacgguuaccgaggagauugcugugcaaaauuggcuggcccgcgucgggcgggaaagacucucccgcauggcuaucucuggagacgauugcguggucaagccgcuggacgaucgguucgccagcgcgcuuacagcccugaacgacaugggcaaggugagaaaagauauucagcagugggagccuucccgcggguggaacgacuggacccagguucccuuuugcucucaccacuuccaugaacucgugaugaaggauggacggguccugguggugcccuguagaaaucaagacgagcugaucggccgcgcucggaucagccagggggccggcuggucccucaaagaaacagcuugccugggaaagucuuaugcccagauguggacccuuauguacuuucacagacgcgaucugcggcucgcggccaacgcuauuuguagcgccguuccuucccauugggugccgacaagcagaaccacguggucuauccacgcuaaacacgaguggaugacaaccgaggacaugcuggccgucuggaaucggguguggauucaggaaaaccccuggauggaggacaagaccccuguugaauccugggaggaagugcccuaucuuggcaagagagaggaucaauggugcgggagccugaucggacucacaucucgcgcuaccugggccaaaaauauucagacagcgaucaaccagguccggucccugauuggcaaugaggaauacacggacuauaugccuagcaugaagagauuccgcaaagaggaagaggaagccggggugcugugguga

SEQ ID NO: 19975 - RNA, 9876 nt, Artificial Sequence
  derived and/or modified CDS sequence (opt5) from DENV-2__EU687245__SS-prME
accgccggcgugaucauuaugcugauccccaccgcuauggccuuccaccucacgacccggaauggggagccucauaugauugucggacggcaggaaaagggcaagagccugcuuuuuaagaccgaggacgggguuaauaugugcacccugauggcgaucgaucucggagaacugugugaggacacaauuaccuacaagugcccgcuucugcgccaaaacgaacccgaggauaucgacuguuggugcaauagcacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccauuaaagacaauagagcugugcacgccgauaugggcuauuggaucgaaucugcgcugaacgacaccuggaagauggagaaggccuccuucauugagaucaaaagcugccacuggccuaagucucauacgcuguggagcaaugggguucuugaauccgagaugauuauccccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauucuccuggucgcggugagcuuuguuacccuuaucacaggaaauauguccuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgaaaccauccuggagcucaccgaugcccuggcccugggaaugaugguccuuaaaauugugcggaacauggaaaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaggccguuauggcgguggggauggugagcauccucgccucuucccugcucaaaaaugacauuccuaugacaggaccccuggucgcuggcggccuucugaccgugugcuauguucugaccgggcggagcgccgaucucgaacuggagcgcgcugccgacgugaagugggaggaucaggccgaaaucuccggaagcucuccuauucuuagcaucacaauuuccgaggacggcucuaugagcaucaaaaacgaagaggaggaacacacccugacaauccucauuagaacggggcugcucgucaucuccggaguguuccccguuucuauuccgaucaccgcugcggccugguaccugugggaggugaagaagcaacgggcuggcguccuuugggaugugccuucucccccucccgucgggaaagccgaacuggaggacggagccuaucgcauuaagcagagaggcaucuuuggcuacucccagaucggggcuggaguguauaaagaaggcacauuccauaccauguggcacguuacaagaggggccgugcugaugcaucgcggaaagagaauugagcccuccugggcggaugucaaaaaggaccucaucagcuacggcgggggauggaagcuggagggcgaauggaaagagggcgaagaggugcagguucuugcucuggaaccugggaagaauccgcgggccgugcaaaccaaacccggacucuuuaagacgaacaccggcacaauuggggccgucucccuggauuucagcccuggaaccucuggcucccccaucguggacagaaaagggaaggugguuggacucuacggcaauggcgucgugacacgcagcggggcuuaugugucugccauugcgcagaccgagaaguccaucgaggauaacccugaaaucgaggacgauauuuuccggaaaaagagacugacaaucauggaccuucaccccggagcuggcaaaacgaagcgcuaccugccugccauuguccgggaagccaucaaaagagggcugcgcacccucauucuggcuccgacacgggugguugccgcugagauggaagaggcccuuagaggacugcccauccgcuaucagaccccugcgauucgggccgagcauaccggcagagaaaucguggaccucaugugucacgcuacauuuacgaugcggcugcucagccccguccgcgugccuaacuacaaucugaucauuauggaugaggcccacuucaccgaccccgcuuccaucgccgccagaggguauauuucuacacggguugaaaugggcgaggcugcgggaaucuuuaugaccgccacaccgccuggcagccgcgaucccuucccccaguccaacgcuccuauuauggacgaggaaagagagauccccgaacggagcuggaacucugggcaugagugggugaccgauuuuaagggaaagacggucugguucgugccuuccaucaaagccggcaacgacauugccgcuugccuuagaaagaaugggaaaaagguuauccaacugagccgcaaaacauuugauucugaauacgugaagacccgggccaacgacugggauuucgucgugaccacagacauuagcgagaugggagcgaauuuuagagcugagcgcgugaucgauccgcggagauguaugaagcccgucauucugaccgacggcgaggaacgcguuauccucgccgggccuaugcccgugacacacuccucugccgcucagcggagaggccgcaucggaagaaacccuaaaaaugaaaacgaccaguauauuuacaugggcgagccccuggaaaaugaugaggacugcgcccauuggaaggaggcgaaaaugcuucuggauaacaucaauaccccggaagggauuaucccuagcauguucgagcccgaacgggagaagguggacgccauugauggagaauaccgccucagaggcgaggcucggaaaacguuugucgaccugaugcgcagaggggaucugccuguguggcucgccuaucggguugcugccgagggaaucaacuacgcugacagacgcugguguuucgauggcauuaagaauaaccaaauccuugaagagaacguggaagucgagaucuggacaaaagagggggaacggaagaagcugaaacccagauggcuggacgcccgcauuuauuccgauccucucgcgcugaaggaguucaaagaauuugccgcuggccggaagucucuuacccugaaucucaucacagagaugggaagacugcccaccuucaugacgcagaaagcccgggacgcucuggauaaccucgccgugcuucacaccgccgaaguuggcgggcgcgcuuacaaucacgcgcugaacgagcugccggagacacucgaaacccugcuucugcucacacugcuggccaccgugacaggaggcauuuuucucuuccuuaugagcgggaagggaaucggcaagaugacccugggcaugugcugcauuaucacggcuuccauccugcucugguaugcccagauucagccucauuggaucgccgcuagcauuauccuggaguuuuuccuuauuguccugcucauccccgaacccgagaaacaaagaacaccucaggacaaucagcugaccuacguggucaucgccauucugaccgugguugcggccacaauggcuaacgaaaugggguuucucgagaagaccaaaaaggaccuuggacugggcucuaucacaacgcaggaguccgaaagcaauauucuggauaucgaccuccggccggccuccgcuuggacccuguaugccguggcgacaaccuucgugacacccaugcuucgccacucuauugagaacagcuccgucaauguuucucugaccgccaucgcuaaccaagccacggugcucauggggcugggaagaggcuggccucugagcaaaauggauauuggggugccccuccuugcuaucggauguuacucccaggucaauccuaucacccugacagccgcucugcuccugcuuguggcccauuacgcgauuaucggccccggccugcaggccaaggcuacccgggaagcccagaagcgcacagcugccgggauuaugaaaaacccuaccguugacggaaucacggugauugaucucgagccgauccccuaugacccuaaguuugaaaaacaacugggccaggucaugcugcucgugcuuugcgucacacaggugcugaugaugagaaccacaugggcccugugugaggcgcucacccuggcuaccgggcccaucagcacacuuugggagggaaauccuggccgguucuggaacacgaccauugccguuucuauggcuaauaucuuucgcggguccuaccuggccggagccggccuccuguucagcauuaugaagaacacaaccaaugcuagacggggcacagggaacaucggagaaacccugggcgagaaauggaagucuagacucaacgcccuugggaaguccgaauuucagauuuauaaaaagagcggaauccaagagguggaucgcacgcuggcgaaagagggcaucaagagaggggaaacagaccaccaugccgucucuagaggaagcgcuaaacugcgcugguucguggagcggaauaugguuacccccgaaggcaagguggucgaucucggcugcgggagaggaggcugguccuacuauugugggggacugaaaaacgugcgcgaggugaagggccuuaccaaagggggaccgggccacgaggaaccuauucccaugucuacauacggcuggaaucugguucggcuccagagcggggucgacguguucuuuacacccccugagaaaugcgauacacugcugugugacaucggagaauccagccccaacccuacgauugaggccggcagaacccuccgcgugcuuaaucuggucgaaaacuggcugaauaacaauacacaguucugcguuaaggugcucaacccguauaugcccuccgugaucgagaaaauggaaacccugcaacggaaguacgggggagcucuugucagaaauccucugucucgcaacagcacacacgagauguacuggguguccaaugccaccggcaacauuguuucuagcgugaauaugaucucccggaugcucaucaacagauuuacgaugaaacauaagaaggcgaccuaugagcccgaugucgaccuggggucuggaacacgcaacauuggcaucgaaaaugagauuccuaaccuggacaucauuggcaaaagaaucgaaaagauuaaacaggagcacgaaaccagcuggcauuacgaucaggaccaccccuauaagacaugggccuaccacggguccuaugagaccaaacagacaggaagcgcuucuuccauggugaauggcguugugaagcuccuuaccaagccgugggaugucgugccuauggugacgcaaauggccaugacagacaccacccccuucgggcagcagcgggucuuuaaagagaagguugauacacgcacgcaggaaccuaaagagggaaccaagaaacugaugagaaucacagcugaauggcuguggaaggagcucggcaagaaaaagacaccccggauguguacaagagaggaguucacccggaaagugcgcagcaacgccgcucugggggccaucuuuacagacgagaauaaguggaaaucugcgagagaagccguggaggauucccgguucugggaacuugucgaccgcgagagaaaccugcaucucgagggaaagugcgaaaccuguguguacaauaugaugggcaaacgggagaagaagcugggcgaauuugggaaagcuaagggaagccgcgccauuugguauauguggcugggcgcuagauuccucgaguuugaagcccugggguuccuuaacgaggaucacugguuuucucggggaaauucccugagcggcguugagggggaaggccuccauaaacugggauacauccuucgcgacguguccaagaaagagggcggggccauguacgcggaugacacggcuggaugggacaccagaauuacacuggaagaucucaagaacgaggaaauggucaccaaucacaugaagggcgagcauaaaaagcuggccgaggccaucuucaaacugacauaucaaaacaaggugguucgggugcagcgcccuaccagcagagggacggucauggacauuaucucucggaaagaucagcgcggaagcggccagguggggacauacggccucaauaccuucacaaacauggaagcucaacugaucagacagauggagggagaaggcauuuuuaaguccauccagcggcuuaccguuacggaggagauugccgugcaaaauuggcuggcuagagucgggcgcgaacggcucucuagaauggccaucagcggagacgauugcguggucaagccccuggacgaucgcuucgcguccgcccuuaccgcucugaacgacaugggcaaagugcggaaggauauucagcagugggagccgucuagaggguggaacgacuggacacagguuccuuuuugcagccaccacuuccaugaacucgugaugaaagauggacgcguccugguggugcccugucggaaucaagacgagcugaucggcagagcccgcaucucccagggggcuggcuggucucucaaggaaaccgccugccugggaaaaagcuaugcgcagauguggacacuuauguacuuucaccggagagaucugcgccucgccgcuaacgccauuuguuccgcuguucccagccauugggugccuaccucucggacaaccugguccauccacgccaagcacgaguggaugacgacagaggacaugcuggcugucuggaauagaguguggauucaggaaaacccguggauggaggacaagacccccguugaaagcugggaggaagugccuuaucuuggcaaacgggaggaucaauggugcgggucucugaucggacucaccuccagagccacaugggcgaagaauauucagaccgccgucaaccaggugcgcagccugaucggcaaugaggaauacacagacuauaugcccuccaugaaacgguucagaaaggaggaagaggaagcugggguccugugguga

SEQ ID NO: 19976 - RNA, 9873 nt, Artificial Sequence
  derived and/or modified CDS sequence (opt5) from DENV-2__HQ541798__SS-prME
accgccggcaugaucuucaugcugauucccacagugauggcuuuucaccucacgaccagaaacggggagccucauaugaucgugagccggcaggaaaagggaaagucccugcuuuucaagacaggcgacgggguuaauaugugcacccugauggccauggaucucggagagcugugugaagacacaauuaccuacaagugcccgcuucugcgccaaaacgagcccgaagauaucgacuguuggugcaauucuacaagcaccugggugacguauggcaccuguacaaccacaggggagcaccggcgggagaagcgcuccguggcgcucgucccucaugugggaaugggccuggaaaccagaacggagacauggaugucuagcgaaggcgcuuggaaacacgcccagcggauugagaccuggauccugcgccaucccggguuuacaaucauggccgcuauucucgccuacaccaucggaaccacacacuuccagagagcucugauuuuuauccuucugacggccguugcgccuuccaugaccaugcggugcauuggcaucucuaaccgcgauuucguggagggggucagcggaggcuccuggguggacauuguucucgaacacgggagcugugugacaaccauggccaagaauaagcccacacuggauuuugagcuuaucaaaaccgaagcuaagcagucugccacgcugagaaaauauugcaucgaggcuaagcucacaaacaccaccacagaaucccgguguccuacccaaggagagccgagccugaaugaggaacaggacaaacgcuucgucugcaagcauucuaugguggauagaggcuggggcaacggguguggacuguuuggcaaaggagggauugugacaugcgccauguucacgugcaaaaaggacaugaaaggcgaggucguucagcccgaaaaucucgaguacaccaucgugauuacaccucacuccggggaagaacaugcggugggaaacgauaccggcaagcacggcaaagagaucaagauuacaccccagagcucuaucaccgaagccgagcugacgggguauggaaccgucacaauggaauguuccccucggaccggccuugacuuuaaugagauggugcugcuccaaauggaaaacaaggcuuggcugguucaccgccagugguuccuugaucugccccucccguggcugccuggggccgacacacagggaagcaauuggauccagaaggagacccuggugacguuuaagaacccccaugcuaaaaagcaagacgucgugguucucggcucccaggagggggccaugcacacagcccugaccggcgcuacagaaauucagaugucuagcggaaaucuucuguucaccggccaucucaaaugcagacugcggauggauaaacuucaacugaaagggauguccuacagcauguguaccggaaaguucaagguggucaaagagaucgcggaaacacagcacggcacgauugugaucagaguccaguaugagggggacggaucuccuugcaagauucccuuugagaucauggaucucgaaaaacgccaugugcugggccggcugaucaccguuaaccccauugugacagagaaggacuccccugucaacaucgaagccgagccgcccuucggggauagcuacauuaucauuggcguggaaccuggacagcucaaacugaauugguuuaagaagggcucuagcaucgggcaaaugcuugagaccacaaugagaggagcuaaacgcauggccauucugggcgacaccgccugggauuucgggucccucggaggcguuuuuacgucuaucgggaaggcucugcaccagguguucggcgccaucuacggagcggcuuuuagcggcgucuccuggacaaugaaaauucugaucggggugauuaucaccuggauuggaaugaacagccggucuaccucccuuagcgugucucucguucuggucggcguggugacacuguaucucggggucauggugcaggccgacuccggauguguugugagcuggaagaauaaagagcugaagugcggcuccgggaucuucaucaccgauaacguccacacauggacggaacaguacaaguuucaacccgagucuccuagcaaacuugccuccgcuauucagaaggcccaugaagagggcaucuguggaauuagaucugugacccgccuggaaaaucucauguggaaacagaucacacccgagcugaaccacauucugagcgagaaugaaguuaaacuuaccaucaugacaggcgacaucaaagggauuaugcaggcuggaaagcggucccucagaccgcaaccuaccgagcugaaauauagcuggaagacguggggcaaggccaaaaugcugucuaccgaaucccauaaccagacauuccucaucgaugggcccgagaccgcggaaugcccuaauacaaaccgcgccuggaauagccuggagguggaggacuacggauuuggcgucuucaccacaaacauuuggcuuaagcugcgggaaaaacaggacguguuuugugauucuaagcucauguccgcugccaucaaagacaauagagcuguucacgccgauaugggcuauuggauugagagcgcgcugaacgacaccuggaagaucgaaaaggccucuuucaucgaggugaaaagcugccacuggcccaagccucauacgcugugguccaaugagguccuugaaagcgagaugauuauccccaaaaacuucgcugggccggugucucagcacaacuaccgcccuggauaucauacacaaaccgccggccccuggcaccucgggaagcuggaaauggauuuugacuucugugagggaaccacaguggucguuaccgaagauugcggcaaucgggggcccucccugagaacgacaaccgcuagcggaaaacucauuacagaguggugcugucgguccugcacccugccuccgcuucgcuacagaggcgaggacggcuguugguacgggauggaaauccggccccugaaggagaaggaagagaaccucgucaauucucuggugacagccggacauggccagauugauaacuuuagccuggggguccuuggaauggcccucuuccuggaagagaugcugagaacccgcgugggcacgaaacacgcuauccuccugguugcgguguccuuugucacccuuauuacagggaauaugucuuuccgggaccugggaagagugaugguuauggugggcgccaccaugacagaugacaucggcaugggggucaccuaucucgcucugcuggccgccuuuaaggugcgcccuacguucgcugccggacuucugcucagaaaacugacaagcaaggagcucaugaugaccacaaucggcauuguucugcuuucccagucuaccauccccgaaaccauucuggagcucacagaugcgcuggcucuggggaugauggugcuuaaaaugguccggaagauggaaaaguaccaacuggccgugacgaucauggccauucucugcgugccuaacgcugucauccugcagaaugccuggaaaguuagcuguaccauccucgcggugguguccgucagcccccuguuucuuacaucuucccagcagaaggcugacuggauuccucuggcccucaccaucaaaggacugaaccccacagccauuuuccugaccacgcuuagccgcacaaauaagaaaagaucuuggccgcugaacgaggcuaucauggccgugggcaugguuuccauucucgcuagcucucugcucaagaaugacaucccuaugaccgggccccugguggccggaggccuucugaccgucugcuaugugcugacaggccgguccgcggaucucgaacuggagcgcgccgcugacguuaaaugggaggaucaagccgaaaucagcggguccagcccuauucuuucuaucaccauuagcgaggacggauccaugucuaucaagaacgaagaggaggaacagacacugacgauucucaucagaaccggccugcucgugauuagcgggcuguuucccgucucccuuccgaucacagcugccgccugguaccugugggaggugaagaaacagcgggcuggaguccugugggaugugccuucucccccucccguuggcaaggcggaacucgaggacggggccuaucgcaucaaacagaaggggauucugggcuacagccaaaucggcgcugggguguauaaagaaggaaccuuccacacaauguggcaugucaccagaggcgccgugcuuaugcacaaggggaagcggauugagcccuccugggccgauguuaaaaaggaccugaucucuuacggaggcggguggaaacucgagggagaauggaaggagggcgaagaggugcagguccuggcucucgaaccuggcaaaaauccgcgcgccgugcagacgaagcccgggcuguuuaagaccaacgcgggaacaauuggcgcugugagccuugauuucuccccugggaccagcggaucucccaucaucgacaaaaagggcaaaguugucgggcuguacggaaauggcguggugacaagauccggcgccuaugucagcgccauugcucagaccgagaagucuaucgaggauaacccugaaauugaggacgauaucuuccggaaaagaaagcugacaauuauggaccuccaucccggggccggaaagacgaaacgcuaccugccugcgaucgugcgggaagcuaucaagagaggccuucgcacccugauucucgccccgacacggguuguggccgcugagauggaagaggcccugagagggcuccccauccgcuaucaaaccccugcuauucgggccgagcacaccggaagagaaaucgucgaccugaugugucaugcgacauuuacgaugcgccuucugucccccgugcggguuccuaacuacaaucugauuaucauggaugaggcccacuucaccgaccccgcuagcauugccgcuagaggcuauaucuccacacggguggaaaugggggaggccgccggcaucuuuaugaccgcuacaccgccuggaucucgcgaucccuucccccagagcaacgcgccuauuauggacgaggaaagagagauccccgaacgguccuggagcucuggccacgagugggucaccgauuuuaaagggaagacggugugguucguuccuuccauuaaagccggaaaugacaucgcugccugccuccgcaagaacggcaagaaagugauucagcugagcagaaagacauuugauucugaauacgucaaaacccggaccaaugacugggauuucguggugacaaccgacaucagcgagaugggggccaacuuuaaggcugagagagucaucgauccgcgccgguguaugaaacccguuauucuuacagacggagaagagagagugauccuggccggcccuaugcccgugacccauuccucugcggcucaacgccgggggagaauuggccgcaauccuaagaacgaaaaugaccaguauaucuacaugggagagccccucgaaaacgaugaggacugcgcccacuggaaagaggccaagaugcugcuggauaauauuaacacgccggaaggcaucaucccuagcauguucgagcccgaacgggagaaggucgacgcuauugauggggaauacagacuccgcggagaggccagaaaaacauuuguggaccuuaugcggcgcggcgaucugccuguuuggcuggcguauagaguggccgcugaggggaucaauuacgccgaccggcgcugguguuucgauggaauuaagaacaaucagauccucgaagagaacgucgaaguggagauuuggaccaaagagggcgaaagaaagaaacugaagccccgguggcuugacgcuagaaucuauuccgauccucuggcccucaaggaguucaaagaauuugcugccgggcgcaagucucugacacugagccucauuaccgagaugggccggcuucccacguucaugacccagaaagcgagagacgcccuggauaaccuggcuguucuccauacagccgaagcuggaggccgcgccuacaaucacgcccuguccgagcuuccggagacccuggaaacacuccugcugcucacccuucuggcuacagugaccgggggaaucuuucuguuccucaugagcggccgggggaucggaaagaugacgcugggcaugugcugcauuaucacagcgucuauucuucugugguaugcccaaauccagccucacuggauugcugccuccaucauccucgaguuuuuccugauuguccugcucauccccgaacccgagaaacagagaaccccucaggacaaccaacuuaccuacguggucauugccauccugacagugguugcugccaccauggcgaaugaaaugggcuuucuggagaagacaaagaaagaccucgggcugggaagcauuacgacccagcagccggaguccaacauccuugauaucgaccugcggcccgccucugcuuggacacucuaugccguggcuaccacauucgugaccccuaugcugcgccauagcauugaaaauuccucugucaacguuagccugacggccaucgcgaaucaggccaccgugcucaugggccuugggaagggauggccccuguccaaaauggauauuggcgugccucugcucgcuaucggguguuacagccaagucaaccccauuacacugaccgccgcucuuuuucugcucguggcccacuacgcuaucauuggaccuggccugcaggccaaggcgacaagagaggcccagaaacgggcugccgcuggcaucaugaagaauccgaccguugacgggaucacggugauugaucuggaccccaucccuuaugaucccaaguucgaaaaacagcucggacaagucaugcuucuggugcugugcgucacacaggugcucaugaugcgcaccacaugggcccugugugaggcccuuacccuggcgaccggcccuauuucuacacucugggaagggaaccccggaagauuuuggaauacgaccaucgcuguuuccauggccaacauuuuccggggcagcuaccuggcuggggccggacugcucuuuucuaucaugaagaauacaaccaacacacgcagaggcaccggcaauaucggggagacgcuuggagagaaauggaagucccggcugaacgcccugggcaaaagcgaguuccagauuuauaagaaaucugggauccaagagguggaccgcacacucgcuaaggaaggaauuaagagaggcgagaccgaucaucacgccgucagccggggguccgcgaaacugagaugguucguggagcgcaauaugguuaccccggaaggaaagguggucgaccuuggcugcggcagaggcggguggucuuacuauuguggagggcugaaaaacgugagagaggugaaggggcucacaaaaggcgggccuggacaugaagaacccauccccaugagcaccuacggcuggaaccugguucgccugcaguccggcgucgauguguuuuucacaccucccgaaaagugcgacacgcuccuuugugauauuggggagagcuccccuaauccgaccguggaggccggacggacacugagaguccugaaccucguugaaaauuggcugaacaauaacacccaguuuugcaucaaggugcuuaaucccuauaugccuucugugaucgagaaaauggaagcucugcagcgcaaguacggcggggcccucguccggaacccccugagcagaaauuccacacacgagauguacugggugucuaacgcuagcggaaauauuguuuccucugugaacaugaucagccgcaugcugauuaaucgguucaccaugagacacaaaaaggccacguaugaaccugacgucgaccucggcuccgggacccgcaacaucggaauugagagcgagauccccaaucuugauaucauuggcaaacggaucaagauuaagcaagaacaugagacaucuuggcacuacgaccaggaucauccguauaaaaccugggcguaccacggcuccuaugaaacaaagcagaccgggagcgccucuuccauggugaacggaguugugagacugcugacaaaaccuugggacgucgugcccauggugacccagauggcuaugacggauacaaccccuuuuggccaacagcgcgucuucaaggagaaaguugacaccagaacacaggaacccaaggaggggacgaagaaacucaugaagaucaccgccgaguggcuguggaaagaacuuggaaagaaaaagacaccucggauguguacccgcgaggaauuuacaagaaaagugcggagcaacgcugcccugggcgcuauuuucaccgaugagaauaaguggaagucugccagagaggcgguggaagacucccgguuuugggagcucgucgauaaagaacgcaaccugcaccuggaggggaagugcgaaacauguguguacaauaugaugggaaaaagagagaagaaacucggcgaguucggcaaggccaaggggagccgggcuaucugguauauguggcugggagcccgcuuucuugaguucgaggcucugggcuuucucaacgaagaccauugguucuccagagagaauagccugucugggguugaaggagagggccuucacaaacugggguacauucuccgggaugugagcaagaaagagggcggagccauguacgccgacgacaccgcgggcugggauacgcgcaucacccuggaagaccugaagaacgaggaaauggucacaaaucauauggagggggaacacaaaaagcucgcugaggccaucuucaagcugaccuaucagaacaaagugguuagagugcaacggcccacaccgcgcggaaccgucauggauauuaucuccagacgggaccagcgcggcucuggacaggugggaacguacggccuuaauacauuuaccaacauggaggcccaacugauuagacagauggaaggggagggcguuuucaagagcauccagcaucucacagugaccgaagagauugcuguccagaauuggcuggcccgggugggacgcgagagacuuucccggauggcuaucucuggcgaugacugcgucgugaaaccucuggaugacagauuugccagcgcgcucacggcccugaacgauauggggaagguucgcaaagacauccaacagugggaacccucccggggauggaaugauuggacccaggugcccuucugcucucaccacuuucaugagcugauuaugaaggacggcagaguccucguggugccuugucgcaaccaggaugaacugaucgggcgggcuagaauuagccaaggagccggcuggucccuucgcgagacagcuugccugggaaagagcuaugcccagauguggucucucauguacuuccaccggagagaccugcgccuugcggccaaugcuaucuguuccgccguuccgagccauugggugcccaccucucggacaaccugguccauucacgcuaaacacgaauggaugacagccgaggacaugcugaccgucuggaacagaguguggauccaggagaacccuuggauggaagauaagacgcccguugagagcugggaagagaucccuuaucucggcaaacgcgaagaccaguggugcggaucccugauuggccugacaucucgggcuaccugggccaagaauauccaaaccgcgauuaaccaggugagaagccucaucgggaaugaggaguacacagauuauaugcccuccaugaaacgguuuagacgcgaagaggaagaggccggaguccugugguga

SEQ ID NO: 19977 - RNA, 9876 nt, Artificial Sequence
  derived and/or modified CDS sequence (opt5) from DENV-2__JF730053__SS-prME
accgccggaaugaucauuaugcugauccccaccgugauggcuuuccaccucacgaccagaaacggggaaccucauaugauugugagccggcaggaaaagggaaaaucccugcuuuuuaagacaggcgacgggguuaauaugugcacccugauggccauggaucucggagaacugugugaagacacaaucaccuacaaaugcccgcuucugagacaaaacgaacccgaagauauugacuguuggugcaauucuacaagcaccugggugacguauggcaccuguacaaccacaggggagcaccggcgggagaagcgcuccguggcgcucgucccucaugugggaaugggccuggaaaccagaacggagacauggaugucuagcgaaggcgcuuggaaacacgcccagcggaucgagaccuggauccugcgccaucccggguucacaauuauggccgcuauccucgccuacaccauuggaaccacacacuuucagagagcucugaucuucauucuucugacggccguugcgccuuccaugaccaugcggugcaucggcauuucuaaccgcgauuuuguggagggggucagcggaggcuccuggguggacaucguucucgaacacgggagcugugugacaaccauggccaagaauaagcccacacuggauuucgagcuuaucaaaaccgaagcuaagcagucugccacgcugagaaaauauugcauugaggcuaagcucacaaacaccaccacagaaucccgguguccuacccaaggagagccgagccugaaugaggaacaggacaaacgcuuugucugcaagcauucuaugguggauagaggcuggggcaacggguguggacuguucggcaaaggcgggaucgugacaugcgccauguuuacgugcaaaaagaauaugaaagggaaggucguucagcccgagaaccucgaauacaccauugugaucacaccucacuccggggaggaacaugcggugggaaaugacaccggcaaacacggcaaggagauuaaaaucacaccccagagcucuaucaccgaggccgaacugacgggguauggaaccgucacaauggaguguuccccucggaccggccuugauuucaacgaaauggugcugcuccaaauggagaauaaggcuuggcugguucaccgccagugguuucuugaccugccccucccguggcugccuggggccgauacacagggaagcaacuggauucagaaggaaacccuggugacguucaaaaauccccaugcuaagaaacaagacgucgugguucucggcucccaggagggggccaugcacacagcccugaccggcgcuacagagauccagaugucuagcggaaaccuucuguuuaccggccaucucaagugcagacugcggauggacaaacuucaacugaaggggauguccuacagcauguguaccggaaaguucaaaguggucaaggaaauugcggagacacagcacggcacgaucgugauuagaguccaguaugaaggggauggaucuccuugcaaaauccccuucgagaucauggaccucgagaagcgccaugugcugggccggcugauuaccguuaaccccaucgugacagaaaaagauuccccugucaauauugaggccgaaccgcccuuuggggacagcuacaucauuaucggcguggagccuggacagcucaagcugaacugguucaagaaaggcucuagcauugggcaaaugcuugaaaccacaaugagaggagcuaagcgcauggccauccugggcgauaccgccugggacuuugggucccucggaggcguuuucacgucuaucgggaaagcucugcaccagguguuuggcgccauuuacggagcggcuuucagcggcgucuccuggacaaugaagauccugauuggggugaucauuaccuggaucggaaugaauagccggucuaccucccuuagcgugucucucguucuggucggcguggugacacuguaucucggggucauggugcaggccgauuccggauguguugugagcuggaaaaacaaggagcugaagugcggcuccgggaucuuuauuaccgacaauguccacacauggacggagcaguacaaauuccaacccgaaucuccuagcaaacuugccuccgcuauccagaaagcccaugaggaaggcauuuguggaaucagaucugugacccgccuggagaaccucauguggaagcagauuacacccgaacugaaucacauccugagcgagaacgagguuaaacuuaccaucaugacaggcgauauuaaggggaucaugcaggcuggaaaacggucccucagaccgcaaccuaccgaacugaaguauagcuggaagacguggggcaaagccaagaugcugucuaccgagucccauaaucagacauuucucauugacgggcccgaaaccgcggagugcccuaacacaaaucgcgccuggaacagccuggaaguggaggauuacggauucggcgucuuuaccacaaauaucuggcuuaaacugcgggagaagcaggacguguucugugacucuaaacucauguccgcugccauuaaggauaacagagcuguucacgccgacaugggcuauuggaucgaaagcgcgcugaaugauaccuggaagaucgagaaagccucuuuuauugaagucaagagcugccacuggcccaaaucccauacgcuguggagcaacgagguccuugagucugaaaugaucauuccuaagaacuucgcugggcccgugucccagcacaauuaccgcccgggauaucauacacaaaccgccggcccuuggcaccucgggaaacuggagauggacuucgauuuuugugaaggaaccacaguggucguuaccgaggacugcggcaaccgggggcccagccugagaacgacaaccgcuuccggaaagcucaucacagaauggugcugucggucuugcacccugcccccucuucgcuacagaggcgaggauggcuguugguacgggauggagauucggccgcugaaggaaaaagaggaaaaucucgugaacagccuggugacagccggacauggccagaucgacaauuucucccuggggguccuuggaauggcccucuuucuggaggaaaugcugagaacccgcgugggcacgaagcacgcuauucuccugguugcggugucuuucgucacccuuaucacagggaacaugagcuuucgggaucugggaagagugaugguuauggugggcgccaccaugacagacgauaucggcaugggggucaccuaucucgcucugcuggccgccuucaaagugcgccccacguuugcugccggacuucugcucagaaagcugacauccaaagagcucaugaugaccacaauuggcaucguucugcuuucucagagcaccauuccugagaccauccuggaacucacagacgcgcuggcucuggggaugauggugcuuaagaugguccggaagauggagaaauaccaacuggccgugacgauuauggccauccucugcgugcccaaugcugucauccugcagaacgccuggaagguuuccuguaccauucucgcgguggugagcgucucuccucuguuccuuacauccagccagcagaaagcugauuggaucccccuggcccucaccauuaagggacugaauccuacagccaucuuucugaccacgcuuucucgcacaaacaaaaagagauccuggccccugaaugaagcuauuauggccgugggcaugguuagcauccucgcuucuucccugcucaaaaacgacaucccgaugaccgggccucugguggccggaggccuucugaccgucugcuaugugcugacaggccggagcgcggaccucgagcuggaacgcgccgcugauguuaagugggaggaccaagccgagauuuccgggagcucucccauccuuagcauuaccaucuccgaagauggaucuaugagcauuaagaaugaggaagaggagcagacacugacgauccucauuagaaccggccugcucgugaucuccgggcuguucccugucucucuucccaucacagcugccgccugguaccugugggaagugaaaaagcagcgggcuggaguccugugggacgugccgagcccucccccuguuggcaaagcggagcucgaagauggggccuaucgcauuaagcagaaaggaauccugggcuacucccaaauuggcgcugggguguauaaggagggaaccuuucacacaauguggcaugucaccagaggcgccgugcuuaugcacaaggggaaacggaucgaacccucuugggccgacguuaagaaagaucugauuagcuacggaggcggguggaagcucgagggagaguggaaagaaggcgaggaagugcagguccuggcucucgagcccggcaagaacccucgcgccgugcagacgaagccggggcuguucaaaaccaaugcgggaacaaucggcgcugugucccuugacuuuagccccgggaccucuggauccccuaucauugauaagaaaggcaagguugucgggcuguacggaaacggcguggugacaagaagcggcgccuaugucucugccaucgcucagaccgaaaaauccauugaggacaaccccgagaucgaagaugacauuuuccggaagagaaagcugacaaucauggaucuccauccuggggccggaaaaacgaagcgcuaccugcccgcgaucgugcgggaggcuauuaaaagaggccuucgcacccugauccucgccccuacacggguuguggccgcugaaauggaggaagcccugagagggcucccgauucgcuaucaaacccccgcuauccgggccgagcacaccggaagagagauugucgaccugaugugucaugcgacauucacgaugcgccuucugagcccugugcggguucccaauuacaaccugaucauuauggacgaagcccacuuuaccgauccugcuuccaucgccgcuagaggcuauaucucuacacggguggagaugggggaagccgccggcauuuucaugaccgcuacacccccgggaagccgcgacccuuuuccccaguccaaugcgcccaucauggaugaggagagagaaauuccugagcggagcuggucuuccggccacgaaugggucaccgacuucaaggggaaaacggugugguuuguucccagcaucaaggccggaaacgauauugcugccugccuccgcaagaauggcaaaaaggugauccagcugucuagaaaaacauucgacagcgaguacgucaagacccggaccaacgauugggacuuuguggugacaaccgauaucuccgaaaugggggccaauuucaaagcugagagagucauugacccucgccgguguaugaagccgguuauccuuacagauggagaggaaagagugauucuggccggccccaugccugugacccauucuagcgcggcucaacgccgggggagaaucggccgcaaccccaaaaaugagaacgaccaguauauuuacaugggagaaccucucgagaaugacgaagauugcgcccacuggaaggaggccaagaugcugcuggacaacaucaauacgcccgagggcaucauuccguccauguuugaaccugagcgggaaaaagucgaugcuaucgacggggaguacagacuccgcggagaagccagaaagacauucguggaucuuaugcggcgcggcgaccugcccguuuggcuggcguauagaguggccgcugaggggauuaacuacgccgaucggcgcugguguuuugacggaaucaaaaauaaccagauucucgaggaaaacgucgagguggaaaucuggaccaaggagggcgagcgcaagaagcugaagccucgguggcuugaugcuagaauuuauucugacccccuggcccucaaagaguucaaggaguucgcugccgggcgcaaaagccugacacugucccucaucaccgaaaugggccggcuuccuacguuuaugacccagaaggcgagagaugcccuggacaaucuggcuguucuccauacagccgaggcuggaggccgcgccuacaaccacgcccugagcgaacuucccgagacccuggagacacuccugcugcucacccuucuggcuacagugaccgggggaaucuuccuguuucucaugucuggccgggggauuggaaaaaugacgcugggcaugugcugcaucauuacagcguccauccuucugugguaugcccaaauucagccgcacuggaucgcugccagcaucauucucgaguucuuucugaucguccugcucauuccugagcccgaaaagcagagaacaccccaggauaaucaacuuaccuacguggucaucgccauucugacagugguugcugccaccauggcgaacgagaugggcuuccuggaaaagacaaagaaggaccucgggcugggauccaucacgacccagcagccugagucuaauauccuugacauugaucugcggccggccagcgcuuggacacucuaugccguggcuaccacauuugugacccccaugcugcgccauuccaucgagaacucuagcgucaauguuucccugacggccauugcgaaccaggccaccgugcucaugggccuugggaaaggauggccucugagcaagauggacaucggcgugccccugcucgcuauuggguguuacucucaagucaauccuaucacacugaccgccgcucuuuuccugcucguggcccacuacgcuauuaucggacccggccugcaggccaaagcgacaagagaagcccagaagcgggcugccgcuggcaucaugaagaacccuaccguugaugggauuacggugaucgaccuggauccgauucccuaugacccuaaauuugagaagcagcucggacaagucaugcuucuggugcugugcgucacacaggugcucaugaugcgcaccacaugggcccugugugaagcccuuacccuggcgaccggccccaucuccacacucugggaggggaauccuggaagauucuggaacacgaccauugcuguuagcauggccaauaucuuucggggcucuuaccuggcuggggccggacuccuguucuccaucaugaaaaacacaaccaauacacgcagaggcaccggcaacauuggggaaacgcuuggagagaaguggaaaagccggcugaaugcccugggcaagucugaguuucagaucuauaaaaagagcgggauucaagaaguggaucgcacacucgcuaaggagggaaucaaaagaggcgaaaccgaccaucacgccgucucccgggggucugcgaagcugagaugguucguggagcgcaacaugguuacccccgagggaaaaguggucgaucuuggcugcggcagagggggauggagcuacuauuguggcgggcugaagaacgugagagaagugaaaggacucacaaagggcgggccgggacaugaggaaccuauucccauguccaccuacggcuggaaucugguucgccugcagagcggcgucgacguguucuuuacacccccugagaagugcgauacgcuccuuugugacaucggggaauccucucccaacccuaccguggaggccggacggacacugagaguccugaaucucguugagaacuggcugaauaacaauacccaguucugcaucaaagugcuuaacccguauaugcccagcgugauugaaaagauggaggcucugcagcgcaaauacggcggggcccucguccggaauccucuguccagaaacucuacacacgaaauguacugggugagcaaugcuuccggaaacaucguuucuagcgugaauaugauuucccgcaugcugaucaaccgguuuaccaugagacacaagaaagccacguaugagcccgaugucgaccucggcagcgggacccgcaauauuggaaucgaaucugagaucccuaaccuugacauuaucggcaagcggauugagaagaucaaacaagaacaugagacauccuggcacuacgaucaggaccaucccuauaagaccugggcguaccacggcagcuaugaaacaaaacagaccgggucugccuccagcauggugaacggaguugugagacugcugacaaagccgugggaugucgugccuauggugacccagauggcuaugacggacacaacccccuucggccaacagcgcgucuuuaaagagaagguugauaccagaacacaggaaccuaaggaggggacgaaaaagcucaugaaaauuaccgccgaguggcuguggaaggaacuuggcaaaaagaaaacaccccggauguguacccgcgaggaguucacaagaaaggugcggucuaaugcugcccugggcgcuaucuuuaccgacgagaacaaguggaaauccgccagagaggcgguggaagauagccgguucugggagcucgucgacaaggaacgcaaucugcaccuggaggggaaaugcgaaacauguguguacaacaugaugggaaagagagagaaaaagcucggcgaguuuggcaaggccaaagggucccgggcuauuugguauauguggcugggagcccgcuuccuugaauuugaggcucugggcuuccucaaugaagaucauugguuuagcagagagaacucucugagcgggguugaaggagagggccuucacaagcugggguacauccuccgggacguguccaaaaaggagggcggagccauguacgccgaugacaccgcgggcugggacacgcgcaucacccuggaagaucugaaaaaugaggaaauggucacaaaccauauggagggggaacacaagaagcucgcugaggccauuuucaaacugaccuaucagaauaaggugguuagagugcaacggccuacaccccgcggaaccgucauggacaucauuucuagacgggaucagcgcggcagcggacaggugggaacguacggccuuaacacauucaccaauauggaggcccaacugaucagacagauggaaggggagggcguuuuuaaauccauucagcaucucacagugaccgaagagaucgcuguccagaacuggcuggcccgggugggacgcgagagacuuucucggauggcuaucagcggcgacgauugcgucgugaagccgcuggacgauagauucgccuccgcgcucacggcccugaaugacauggggaaaguucgcaaggauauucaacagugggaaccuucucggggauggaacgacuggacccaggugcccuuuugcagccaccacuuccaugagcugaucaugaaggauggcagaguccucguggugcccugucgcaaucaggacgaacugauugggcgggcuagaaucucccaaggagccggcuggagccuucgcgagacagcuugccuggggaaaucuuaugcccagauguggucccucauguacuuucaccggagagaucugcgccuugcggccaacgcuauuuguagcgccguuccuucucauugggugccgaccucccggacaaccuggagcauccacgcuaagcacgaauggaugacagccgaggacaugcugaccgucuggaacagaguguggauccaggagaaucccuggauggaagacaaaacgccuguugaguccugggaagagauucccuaucucggcaagcgcgaagaucaguggugcggaucucugaucggccugacaagccgggcuaccugggccaaaaacauucaaaccgcgaucaaucaggugagaucccucauugggaacgaggaguacacagacuauaugccuagcaugaagcgguucagacgcgaagaggaagaggccggaguccugugguga

SEQ ID NO: 19978 - RNA, 9876 nt, Artificial Sequence
  derived and/or modified CDS sequence (opt5) from DENV-2__EU529706__SS-prME
accgccggcgugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuauggaucucgagaaacgccauguccugggccggcugaucaccgugaacccuauuguuacagaaaaggacagcccggugaacaucgaggccgaacccccuuuuggggauucuuacauuaucaucggcgucgagcccggacagcucaaacugaauugguucaagaagggcuccagcauugggcaaauguuugagaccacaaugagaggagcuaaacgcauggccauccuuggcgacaccgccugggauuucgggucucugggaggcguguuuacgagcauugggaaggcucuccaccagguuuucggcgccaucuacggagcggcuuuuuccggcgugucuuggacaaugaaaauucugaucggggucaucauuaccuggaucggaaugaacagccgguccaccagccugucugugucccuugugcucguuggcgucgugacacuguaucugggggugaugguccaggccgacaccggaugugugguuagcuggaagaauaaagaacucaagugcggcucugggauuuucaucacagauaacgugcacacguggaccgagcaguacaaguuucaaccugaaucccccagcaaacuggccuccgcuauucagaaggcccaugaggaaggcaucuguggaaucagaucugucacacgccuugagaaucugauguggaaacagauuaccccggagcucaaccacauccugagcgaaaaugaggugaagcugacaauuaugaccggcgacaucaaagggauuaugcaggcuggaaagcggucccuuagaccucaacccacggaacucaaauauucuuggaagaccuggggcaaggccaaaaugcugagcacagagucccauaaccagaccuuccugaucgaugggccugaaacagcggagugccccaauaccaaccgcgccuggaauagccucgagguugaagacuacggauuuggcguguucucuacaaacaucuggcugaaacuucgggagaaacaggacgucuuuugugauuccaagcugaugagcgcugccauuaaagacaauagagcugugcacgccgauaugggcuauuggaucgaaucugcgcucaacgacaccuggaagauggagaaggccuccuucauugagaucaaaagcugccacuggccuaagucucauacgcuguggagcaaugggguucuggaauccgagaugauuauccccaaaaacuucgcuggaccggugagccagcacaacuaccgcccuggcuaucauacacaaaccgccgggcccuggcaccuuggaaagcucgaaauggauuuugaccugugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcagaucgauaacuucucucugggagugcuuggcauggcccucuuucuggaagagaugcugagaacccgcauugggacgaaacacgcuauccuccugguggcggucagcuucgugacccuuauuacaggaaauauguccuuucgggaccugggcagaguuauggugauggucggcgccaccaugacagaugacaucgggaugggagugaccuaucucgcucugcuggccgccuucaagguucgcccuacguuugcugccggccuucugcucagaaaacugacaucuaaggagcucaugauggcgaccauugggaucgcucugcuuagccaguccacaauccccgaaaccauucuggagcucaccgaugcccuggcccugggaaugauggugcuuaaaaucguccggaacauggaaaaguaccaacuggcugugacaauuauggccaucucuugcguuccuaaugcggugauucuccagaacgcuuggaaggucagcuguacgauccuggccgccguguccgugagcccccuccugcuuaccucuucccagcagaaagcugacuggaucccucuggcccucacaauuaagggccugaaucccaccgcuaucuuccugacaacccuuagccgcacgucuaaaaagagauccuggccgcugaacgaggccgucauggcgguugggauggugagcauucucgccucuucccugcucaaaaaugacaucccuaugacaggaccccugguggcuggcggccuucugaccgucugcuaugugcugaccgggcggagcgccgaucucgaacuggagcgcgcugccgacguuaagugggaggaucaagccgaaauuuccggaagcucuccuauccuuagcauuacaaucuccgaggacggcucuaugagcaucaaaaacgaagaggaggaacacacccugacaauucucaucagaacggggcugcucgugauuuccggagucuuucccgugucuaucccgauuaccgcugcggccugguaccugugggagguuaagaagcagcgggcuggcgugcuuugggaugucccuucucccccucccguggggaaagccgaacuggaggacggagccuaucgcaucaagcagagaggcaucuucggcuacucccagauuggggcuggagucuauaaagaaggcacauuucauaccauguggcacgugacaagaggggccguucugaugcaucgcggaaagagaaucgagcccuccugggcggaugugaaaaaggaccucauuagcuacggcgggggauggaagcuggagggcgaauggaaagagggcgaagagguccaagugcuugcucuggaaccugggaagaauccgcgggccguucagaccaaacccggacucuucaagacgaacaccggcacaaucggggccgugucccuggauuuuagcccuggaaccucuggcucccccauugucgacagaaaagggaagguggugggacucuacggcaauggcguugucacacgcagcggggcuuaugugucugccaucgcgcagaccgagaaguccaucgaggauaacccugaaauugaggacgauaucuuccggaaaaagagacugacaauuauggaccuucaccccggagcuggcaaaacgaagcgcuaccugccugccaucgugcgggaagccauuaaaagagggcugcgcacccucauccuggcuccgacacgggucguggccgcugagauggaagaggcccuuagaggacugcccauucgcuaucagaccccugcgauccgggccgagcauaccggcagagaaaucguugaccucaugugucacgcuacauucacgaugcggcugcucagccccgugcgcgucccuaacuacaaucugauuaucauggaugaggcccacuuuaccgaccccgcuuccauugccgccagaggguauaucucuacacggguggaaaugggcgaggcugcgggaauuuucaugaccgccacaccgccuggcagccgcgaucccuuuccccaauccaacgcuccuaucauggacgaggaaagagagauccccgaacggagcuggaacucugggcaugaguggguuaccgauuucaagggaaagacggugugguuugucccuuccauuaaagccggcaacgacaucgccgcuugccuuagaaagaaugggaaaaaggugauucagcugagccgcaaaacauucgauucugaauacguuaagacccgggccaacgacugggauuuuguggucaccacagacaucagcgagaugggagcgaauuucagagcugagcgcgugauugauccgcggagauguaugaagcccgugauccugaccgacggcgaagaacgcgucauccucgccgggccuaugcccguuacacacuccucugccgcucagcggagaggccgcauuggaagaaacccuaaaaaugaaaacgaccaauauaucuacaugggcgagccccuggaaaaugaugaggacugcgcccauuggaaggaggcgaaaaugcuucuggauaacauuaauaccccggaagggaucauuccuagcauguuugagcccgaacgggagaagguggacgccaucgauggagaauaccgccucagaggcgaggcucggaaaacguucguggaccugaugcgcagaggggaucugccugucuggcucgccuaucggguggcugccgagggaauuaacuacgcugacagacgcugguguuuugauggcaucaagaauaaccagauccuugaagagaacguugaaguggagauuuggacaaaagagggggaacggaagaagcugaaacccagauggcuggacgcccgcaucuauuccgauccucucgcgcugaaggaguucaaagaguucgccgcuggccggaagucucuuacccugaaucucauuacagagaugggaagacugcccaccuuuaugacgcagaaagcccgggacgcucuggauaaccucgccguccuucacaccgccgaagugggcgggcgcgcuuacaaucacgcgcugagcgagcugccggagacacucgaaacccugcuucugcucacacugcuggccaccguuacaggaggcaucuuccucuuucuuauguccgggaagggaauuggcaagaugacccugggcaugugcugcaucaucacggcuagcauucugcucugguaugcccagauccaaccucauuggauugccgcuucuaucauucuggaguucuuucuuaucgugcugcucauccccgaacccgagaaacagagaacaccucaggacaaccagcugaccuacgucgugauugccauccugaccgucguggcggccacaauggcuaaugaaaugggguuccucgagaagaccaaaaaggaccuuggacugggcuccauuacaacgcaagagagcgaauccaacauccuggauauugaccuccggccggccucugcuuggacccuguaugccguugcgacaaccuuugugacacccaugcuucgccacagcaucgaaaauagcucugugaacgucagccugaccgccauugcuaaucaggccacgguucucauggggcugggaagaggcuggccucuguccaaaauggauaucggggugccccuccuugcuaucggauguuacagccaggugaacccuauuacccugacagccgcucugcuccugcuugucgcccauuacgcgaucauuggccccggccugcaggccaaggcuacccgggaagcccaaaagcgcacagcugccgggaucaugaaaaauccuaccguggacggaauuacgguuaucgaucucgagccgauccccuaugacccuaaguucgaaaaacagcugggccaggugaugcugcucguccuuugcgugacacagguccugaugaugagaaccacaugggcccugugugaggcgcucacccuggcuaccgggcccauuucuacacuuugggagggaaacccuggccgguuuuggaauacgaccaucgccguguccauggcuaacauuuuccgcgggagcuaccuggccggagccggccuccuguuuucuaucaugaagaauacaaccaacacaagacggggcaccgggaauauuggagaaacgcugggcgagaaauggaaguccagacucaacgcucuuggaaagagcgaguuccaaaucuauaaaaagucuggaauccaggagguugaucgcacacuggccaaagagggcauuaagagaggggaaaccgaccaccaugcggugagcagaggauccgccaaacugcgcugguuugucgagcggaacauggugacccccgaaggcaagguuguggaucucggcugcgggagaggaggcuggucuuacuauugugggggacugaaaaauguccgcgaggugaagggccuuacaaaagggggaccgggccacgaggaaccuauccccaugagcaccuacggcuggaaccuggugcggcuccaguccgggguugacgucuucuucacacccccugagaaaugcgauacgcugcugugugacauuggagaaagcucccccaauccuaccguggaggcuggcagaacacuccgcgugcuuaaccuggucgaaaauuggcugaacaauaacacccaauuuugcguuaaggugcucaauccguauaugcccucugugaucgagaaaauggaagcccugcagcggaaguacgggggagcucuugucagaaacccucugagccgcaauuccacacacgagauguacugggugucuaacgccaccggcaauauuguuagcuccgugaacaugaucucucggaugcucaucaauagauucacgaugaaacauaagaaggcgaccuaugagcccgaugucgaccuggggagcggaacacgcaacauuggcaucgaauccgagauuccuaaccuggacaucauuggcaaaagaaucgaaaagauuaaacaggagcacgaaaccagcuggcauuacgaucaggaccaccccuauaagacaugggccuaccacgggucuuaugagaccaaacaaacaggauccgcuagcucuauggugaauggcguugugaagcuccuuaccaagccgugggaugucgugccuauggugacgcagauggccaugacagacaccacccccuuugggcagcagcgggucuucaaagagaagguugauacacgcacgcaagaaccuaaagagggaaccaagaaacugaugagaaucacagcugaauggcuguggaaggagcucggccggaagaaaacccccagaauguguacacgggaggaauuuacccgcaaggugagauccaacgccgcucugggggccaucuucacagacgagaauaaauggaaaagcgcgcgggaagccguggaggauucucgcuuuugggaacuugucgacagagagcggaaccugcaucucgagggaaaaugcgaaaccuguguguacaauaugaugggcaagcgcgagaaaaagcugggcgaguucgggaaggcuaaaggauccagagccauuugguauauguggcugggcgcucgguuucucgaguucgaagcccugggguuucuuaacgaggaucacugguucagccgcggaaauucccugagcggcguugagggggaaggccuccauaagcugggauacauccuuagagacgugucuaaaaaggagggcggggccauguacgcggaugacacggcuggaugggacacccggauuacacuggaagaucucaaaaacgaggaaauggucaccaaucacaugaagggcgagcauaagaaacuggccgaggccaucuuuaagcugacauaucagaacaaagugguucgcgugcagagaccuacaccccgggggacggucauggacauuaucagccgcaaggaucagagaggauccggccaaguggggacauacggccucaauaccuucacaaacauggaagcucagcugauccggcagauggagggagaaggcauuuucaaaucuauccaaagacuuaccguuacggaggagauugccgugcagaauuggcuggcucgcgucgggcgggaaagacucagccgcauggccaucuccggagacgauugcguggucaagccgcuggacgaucgguuugcgucugcccuuaccgcucugaacgacaugggcaaggugagaaaagauauucagcagugggagccuagccgcggguggaaugacuggacacaaguucccuucugcucccaccacuuucaugaacucgugaugaaggauggacggguccugguggugcccuguagaaaccaggacgagcugaucggccgcgcccggaucucucagggggcuggcuggagccucaaagaaaccgccugccugggaaaguccuaugcgcagauguggacacuuauguacuuccacagacgcgaucugcggcucgccgcuaacgccauuuguagcgcuguuccuucucauugggugccgaccuccagaacaaccuggagcauccacgccaaacacgaguggaugacgacagaggacaugcuggcugucuggaaucggguguggauucaagaaaaccccuggauggaggacaagaccccuguugaaucuugggaggaagugcccuaucuuggcaagagagaggaucaguggugcgggucccugaucggacucaccagccgcgccacaugggcgaaaaauauucagaccgccaucaaccagguccggucccugauuggcaaugaggaauacacagacuauaugccuucuaugaagagauuucgcaaagaggaagaggaagcuggggugcugugguga

SEQ ID NO: 19979 - RNA, 9876 nt, Artificial Sequence
  derived and/or modified CDS sequence (opt5) from DENV-2__EU482720__SS-prME
accgccggagugaucauuaugcugauccccaccgcuauggccuuccaccucacgaccagaaauggggagccucauaugauuguuggacggcaggaaaagggcaaaagccugcuuuuuaagaccgaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaccauggccgcuauccucgccuacaccauuggaacaacgcacuuucagagagcucugaucuucauucuucugaccgccguggcgccuagcaugacaaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacggaggcuaagcagccugccacacugagaaaauauugcauugaagcuaagcucaccaacaccacaaccgagagccgguguccgacacaaggagagcccucucugaaugaggaacaggacaaacgcuuuaucugcaagcauuccaugguggauagaggcuggggcaacggguguggacuguucggcaaagggggaauugugacgugcgccauguuuaccugcaaaaagaauauggaaggcaaagucguucucccugagaaccuggaauacacaaucgugauuacaccccacagcggggaggagcaugcggugggaaaugacacaggcaagcacggcaaagaaaucaagaucaccccucagucuuccauuacggaggccgaacuuaccggguauggaacagucaccauggaguguagcccccggacaggccuggauuucaacgaaauggugcuccugcagauggaggacaaggcuuggcuuguucaccgccaaugguuucuggaucucccgcugccuuggcugcccggggccgacacccagggaucuaauuggauccagaaggagacgcucgugacauucaagaacccucaugcuaaaaagcaggacgucgugguucugggcucccaagaaggggccaugcacaccgcccuuacaggcgcuaccgagauucagaugagcuccggaaaucugcucuuuaccggccaucugaaaugcagacuucggauggauaagcugcagcucaaagggaugucuuacagcauguguacaggaaaguucaagaucgugaaagaaauugcggagacgcaacacggcaccaucgucaucagagugcaguaugagggggacggaucccccugcaagauucccuucgaaaucauggaucuggagaaacgccauguccugggccggcucauuacagugaacccuaucgccaccgaaaaggacagcccgguuaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacggcuugggauuucgggucucucggaggcgucuuuacaagcaucgggaaggcccugcaccaaguguucggcgcgauuuacggagcugccuuuuccggcguuucuuggaccaugaaaauccugauuggggugaucaucaccuggauuggaaugaacagccgguccacaagccuuucugucucccucgugcuggugggcaucguuacccuguaucucggggucauggugcaggccgacacaggauguguggucagcuggaagaauaaagaacugaagugcggcucugggauuuucaucacggauaacgugcacaccuggacagagcaguacaaguuucagccugaaucccccagcaaacuugcuuccgccauucaaaaggcucaugaggaaggcaucuguggaaucagaucuguuacccgccuggagaaucucauguggaaacagauuacaccggagcugaaccacauccugagcgaaaaugaggugaaacuuaccauuaugacgggcgacaucaaagggauuaugcaggccggaaagcggucccucagaccucagcccaccgaacugaaauauucuuggaagacauggggcaaggcgaaaaugcugagcaccgagucccauaaccaaacauuccucaucgaugggccugaaaccgccgagugccccaauacaaaccgcgcuuggaauagccuggaggucgaagacuacggauuuggcguguucucuaccaacaucuggcuuaagcugcgggagaaacaggacgucuuuugugauuccaagcucaugagcgccgcuauuaaagacaauagagccgugcacgcggauaugggcuauuggaucgaaucugcccugaacgacacguggaagauggagaaggcuuccuucauugagaucaaaagcugccacuggccuaagucucauacacuguggagcaaugggguccuugaauccgagaugauuauccccaaaaacuucgccggaccggugagccagcacaacuaccgcccuggcuaucauacccagaccgcugggcccuggcaccucggaaagcuggaaauggauuuugacuucugugagggcacaaccguuguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucgugaauagccuggugaccgccggccaugggcaaaucgauaacuuuucucugggaguccuuggcauggcucucuuccuggaagagaugcugagaacgcgcguugggaccaaacacgcgauucuccugguggccgugagcuuugucacacuuaucaccggaaauauguccuuccgggaccugggcagagugaugguuauggugggcgcuacaaugaccgaugacauugggaugggagucacguaucucgcccugcuggccgcuuuuaaggugcgcccuacauucgccgcgggccuucugcucagaaaacugaccucuaaggagcucaugauggcuacaaucgggauugcccugcuuagccaguccaccauccccgaaaccauccuggagcucacagaugcccuggcucugggaaugaugguucuuaaaauugugcggaacauggaaaaguaccagcuggccgucacgaucauggcgauuucuugcgugccuaaugcuguuauccuccaaaacgccuggaaggugagcuguaccauucuggccgcugucuccgugagcccccuccugcuuacaucuucccagcagaaagccgacuggaucccucuggcucucaccaucaagggccugaaucccacagccauuuuucugaccacgcuuagccgcacaucuaaaaagagauccuggccgcugaacgaggcggugauggccgucgggaugguuagcauccucgcuucuucccugcucaaaaaugacauuccuaugaccggaccccugguggccggcggccuucugaccgugugcuauguccugacagggcggagcgcugaucucgaacuggagaaggccgccgacgugaaaugggaggaucaggcugaaaucuccggaagcucuccuauucuuagcaucaccauuuccgaggacggcucuaugagcaucaagaacgaagaggaggaacacacacugacgauccucauucgcaccgggcugcucguuaucuccggaguguuccccgucucuauuccgaucacagcggccgcuugguaccugugggaggugaagaaacaaagagccggcguucuuugggaugugccuucucccccucccgucgggaaggccgaacuggaggacggagcuuaucggauuaaacagcgcggcaucuuuggcuacucccagaucggggccggaguguauaaggaaggcaccuuccauacaauguggcacgucaccagaggggcggugcugaugcaucggggaaaacgcauugagcccuccugggcugauguuaagaaggaccucaucagcuacggcgggggauggaaacuggagggcgaauggaaggagggcgaagaggugcagguccuugcccuggaaccugggaaaaauccgagagccgugcaaacgaagcccggacucuuuaaaaccaacacaggcaccauuggggcuguuucccuggauuucagcccuggaacaucuggcucccccaucguggaccggaaggggaaggucgugggacucuacggcaauggcgugguuaccagaagcggggccuaugucucugcgauugcucagacagagaaauccaucgaggauaacccugaaaucgaggacgauauuuuccgcaagaaacggcugacgaucauggaccuucaccccggagccggcaagaccaaaagauaccugccugccauugugcgcgaagcuaucaagcgggggcugagaacacucauucuggccccgacccgcguggucgcugccgagauggaagaggcgcuucggggacugcccaucagauaucagaccccugccauucgcgcugagcauacaggccgggaaaucguggaccucaugugucacgccacguuuaccaugagacugcucagccccguucgggugccuaacuacaaucugaucauuauggaugaggcucacuucacagaccccgccuccaucgccgcucgcggguauauuucuaccagagucgaaaugggcgaggcggccggaaucuuuaugacagcuaccccgccuggcagccgggaucccuucccccaguccaacgccccuauuauggacgaggaacgcgagauccccgaaagaagcuggaacucugggcaugagugggugacggauuuuaagggaaaaacaguuugguucgugccuuccaucaaggccggcaacgacauugcugccugccuucggaaaaaugggaagaaagucauccaacugagcagaaagaccuuugauucugaauacgugaagacccgcgcgaacgacugggauuucguugugacaaccgacauuagcgagaugggagcuaauuuucgggccgagagagucaucgauccgcgccgguguaugaaacccgugauucugacagacggcgaagagagagugauccucgccgggccuaugcccgucacccacuccucugcugcccagcgccggggcagaaucggacgcaacccuaagaaugaaaacgaccaguauauuuacaugggcgagccccuggaaaaugaugaggacugcgcgcauuggaaagaggccaagaugcuucuggauaacaucaauacgccggaagggauuaucccuagcauguucgagcccgaaagagagaaaguugacgcuauugauggagaauaccggcuccgcggcgaggccagaaagacauuuguggaccugaugcggcgcggggaucugccuguguggcucgcuuauagagucgccgcugagggaaucaacuacgccgaccggagaugguguuucgauggcauuaaaaauaaccaaauccuugaagagaacguggaaguugagaucuggaccaaggagggggaacgcaagaaacugaagccccgguggcuggacgcgagaacauauuccgauccucucgcccugaaagaguucaaggaauuugcugccggccgcaaaucucuuacccugaaucucauuacggagaugggacggcugcccaccuucaugacacagaaggcuagagacgcccuggauaaccucgccgugcuucacaccgcugaagucggcgggcgggcguacaaucacgcccugagcgagcugccggagacacucgaaacccugcuucugcucacacugcuggcuaccgugacgggaggcaucuuucucuuccuuauguccgggaagggaauuggcaaaaugacacugggcaugugcugcaucauuaccgccagcauccugcucugguaugcccagauccagccucauuggauugcugccucuaucauucuggaguuuuuccuuaucguucugcucauucccgaacccgagaagcaacgcaccccucaggacaaccagcugacauacguggucaucgcgauccugaccguggucgccgcuacaauggccaaugaaaugggguuucucgagaaaacgaagaaagaccuuggacugggcuccauuaccacacaggagagcgaauccaacauccuggauauugaccucagaccggcuucugccuggacccuguaugcgguggccacaaccuucguuacgcccaugcuucggcacagcaucgaaaauuccucugugaacgugagccugaccgcuauugccaaucaagcuacaguccucauggggcugggacgcggcuggccucuguccaagauggauaucgggguuccccuccuugccauuggauguuacagccaggugaacccuaucacccugacagcugcccugcuccugcuuguggcgcauuacgccaucauuggccccggccugcaggcuaaggccaccagagaagcucagaaacggacggccgccgggaucaugaagaauccuacagucgacggaauuaccgugaucgaucucgagccgauucccuaugacccuaaauuugaaaagcaacugggccagguuaugcugcucgugcuuugcgucacacaggugcugaugaugcgcaccaccugggcgcugugugaggcucucacacuggccacggggcccaucucuacccuuugggagggaaacccuggcagauucuggaauacaaccaucgcugucuccauggccaacauuuuucgggggagcuaccuggccggagcuggccuccuguucucuaucaugaaaaauacaaccaacacgcgcagaggcacagggaauauuggagaaacccugggcgagaaguggaagucccggcucaacgcccuugggaaaagcgaauuucagaucuauaagaaaucuggcauucaagagguggauagaacccuggcgaaggagggcaucaaacgcggggaaacagaccaccaugccguuagccggggauccgcuaagcugagaugguucguggagcgcaacauggucacccccgaaggcaaagugguugaucucggcugcgggcggggaggcuggucuuacuauugugggggacugaagaaugugagagaggucaagggccuuacaaaagggggaccgggccacgaagaaccuauccccaugagcacguacggcuggaaccuggugcgccuccaguccgggguggacguuuucuuuacacccccugagaagugcgauacacugcugugugacauuggagaaagcucccccaauccuaccaucgaggccggccggacacucagaguccuuaaccugguggaaaauuggcugaacaauaacacccaguucugcgugaaaguccucaauccguauaugcccucuguuauugagaagauggaaacgcugcaacgcaaauacgggggagcucuugugcggaacccucugagcagaaauuccacccacgagauguacugggugucuaacgccacaggcaauaucgucagcuccgugaacaugauuucucgcaugcucaucaaucgguuuaccaugaagcauaagaaagcgacauaugagcccgauguugaccuggggagcggaaccagaaacaucggcauugaaaacgagaucccuaaucuggacauuaucggcaagcgcauugagaagaucaagcaggagcacgaaacauccuggcauuacgaucaggaccaccccuauaaaaccugggccuaccacgggagcuaugagacgaagcagacaggaucugcuuccagcauggugaacggcgucgugaagcuccuuaccaaaccgugggauguugugccuauggucacccaaauggccaugacagacacgacccccuucgggcagcagagaguguuuaaggagaaaguggauacacggacccaggaaccuaaggagggaaccaaaaagcugaugcgcauuaccgcugaauggcuguggaaggagcucggcaaaaagaaaacacccagaauguguacccgggaggaguucacgagaaagguccggucuaaugccgcucugggggccaucuuuaccgacgagaacaaauggaaguccgcgcgcgaagccguugaggauagcagauucugggaacuuguggaccgggagcgcaaucugcaucucgagggaaaaugcgaaacauguguguacaacaugaugggcaagagagagaagaaacugggcgaauuugggaaggcuaaaggaucucgggccaucugguauauguggcugggcgcucgcuuccucgaguuugaagcccugggguuccuuaaugaggaucacugguuuuccagaggaaacagccuguccggcgucgagggggaaggccuccauaagcugggauacauucuucgggacgugagcaaaaaggagggcggggccauguacgcggaugacaccgcuggaugggacacacgcaucacccuggaagaucucaagaaugaggaaaugguuacgaaccacaugaaaggcgagcauaagaaacuggccgaggccauuuucaagcugacauaucaaaauaaaguggucagagugcagcggccuacaccccgcgggacaguuauggacaucauuucuagaaaggaucagcggggaagcggccagguggggaccuacggccucaacacguucaccaauauggaagcucaacugauccgccagauggagggagaaggcaucuuuaaguccauucagagacuuacagucaccgaggagaucgccgugcaaaacuggcuggcucggguugggagagaacgccucucucggauggccauuagcggagacgauugcguggucaaaccgcuggacgauagauucgcguccgcccuuacagcucugaaugacaugggcaaggugcgcaaagauauccagcagugggagccuucucggggguggaacgacuggacccagguccccuuuugcagccaccacuuccaugaacucgugaugaaggauggaagaaugcugguugugcccugucgcaaccaagacgagcugauuggccgggccagaaucucccagggggcuggcuggucucucaaagaaacagccugccugggaaagagcuaugcgcagauguggacccuuauguacuuucaccgccgggaucugagacucgccgcuaaugccaucuguuccgcugucccuagccauugggugccgacgucucgcacaaccugguccauucacgccaagcacgaguggaugaccacagaggacaugcuggcuguguggaaccggguuuggauccaggaaaaucccuggauggaggacaaaaccccuguggaaagcugggaggaaguccccuaucuuggcaagagagaggaucaauggugcgggucucugauuggacucacaucccgggccacgugggcgaaaaacauccagaccgccauuaaucaggugagaagccugaucggcaacgaggaauacacagacuauaugccuuccaugaagcgcuuccggaaagaggaagaggaagcugggguucugugguga

SEQ ID NO: 19980 - RNA, 9876 nt, Artificial Sequence
  derived and/or modified CDS sequence (opt5) from DENV-2__EU482721__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaccauggccgcuauccucgccuacaccauuggaacaacgcacuuucagagagcucugaucuucauucuucugaccgccguggcgccuagcaugacaaugcggugcaucggcauuuccaaccgcgauuuugucgaaggggugucuggaggcagcuggguugacaucgugcucgagcacggguccugugucaccacaauggccaagaauaagcccacccuggauuucgaacuuaucaaaacggaggcuaagcagccugccacacugagaaaauauugcauugaagcuaagcucaccaacaccacaaccgagagccgguguccgacacaaggagagcccucucugaaugaggaacaggacaaacgcuuuaucugcaagcauuccaugguggauagaggcuggggcaacggguguggacuguucggcaaagggggaauugugacgugcgccauguuuaccugcaaaaagaauauggaaggcaaagucguucagccugagaaccucgaauacacaaucgugauuacaccccacagcggggaggagcaugcggugggaaaugacacaggcaagcacggcaaagaaaucaagaucaccccucagucuuccauuacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucauggaucucgagaaacgccauguccugggccggcugauuacagugaacccuaucguuaccgaaaaggacagcccggugaacauugaggccgaacccccuuuuggggauucuuacaucauuaucggcgucgagcccggacagcucaaacugaauugguucaagaagggcuccagcaucgggcaaauguuugagacaaccaugagaggagcuaaacgcauggccauucuuggcgacacggccugggauuucgggucucugggaggcguguuuacaagcaucgggaaggcucuccaccagguuuucggcgccauuuacggagcggcuuuuuccggcgugucuuggaccaugaaaauccugauuggggucaucaucaccuggauuggaaugaacagccgguccacaagccugucugugucccuugugcucguuggcaucgucacccuguaucugggggugauggugcaggccgacacaggaugugucgugagcuggaagaauaaagaacucaagugcggcucugggauuuucaucacggauaacguucacaccuggacagagcaguacaaguuucaaccugaaucccccagcaaacuggccuccgcuauucagaaggcccaugaggaaggcaucuguggaaucagaucugugacccgccuugagaaucugauguggaaacagauuacaccggagcucaaccacauccugagcgaaaaugaggucaagcugaccauuaugacgggcgacaucaaagggauuaugcaggcuggaaagcggucccuuagaccucaacccaccgaacucaaauauucuuggaagacauggggcaaggccaaaaugcugagcaccgagucccauaaccagacauuccugaucgaugggccugaaaccgcggagugccccaauacaaaccgcgccuggaauagccucgagguggaagacuacggauuuggcguuuucucuaccaacaucuggcugaaacuucgggagaaacaggacguguuuugugauuccaagcugaugagcgcugccauuaaagacaauagagcuguccacgccgauaugggcuauuggaucgaaucugcgcucaacgacacguggaagauggagaaggccuccuucauugagaucaaaagcugccacuggccuaagucucauacacuguggagcaauggggugcuggaauccgagaugauuauccccaaaaacuucgcuggaccgguuagccagcacaacuaccgcccuggcuaucauacccaaaccgccgggcccuggcaccuuggaaagcucgaaauggauuuugacuucugugagggcacaaccguggucgugacggaagauugcgggaaucggggacccucucugagaacaaccacagcuuccggcaaacugauuaccgaguggugcugucggagcugcacacucccuccgcugcgcuacagaggcgaggacggguguugguacggaauggaaauccggccccuuaaggagaaggaagagaaccuggugaauagccucgucaccgccggccaugggcagaucgauaacuuuucucugggaguucugggcauggcccuuuuccucgaagagaugcugagaacgcgcauugggaccaaacacgcuauccugcucguggcggugagcuuugucacacugauuaccggaaauauguccuuccgggaccuuggcagagugaugguuauggugggcgccacaaugaccgaugacaucgggaugggagucacguaucuggcucuccuggccgccuuuaaggugcgcccuacauucgcugccggccugcuucugagaaaacucaccucuaaggagcugaugauggcgacaauugggaucgcucuccugagccaguccaccauccccgaaaccauucuugagcugacagaugcccucgcccugggaaugaugguucugaaaaucgugcggaacauggaaaaguaccaacuugcugucacgauuauggccaucucuugcgugccuaaugcgguuauucugcagaacgcuuggaaggugagcuguaccauccucgccgccgucuccgugagcccccugcuccugacaucuucccagcagaaagcugacuggaucccucuugcccugaccauuaagggccucaaucccacagcuaucuuucugaccacgcugagccgcacaucuaaaaagagauccuggccgcuuaacgaggccauuauggcgguggggauggucagcauccuggccucuucccuccugaaaaaugacauuccuaugaccggaccccucguugcuggcggccugcuuaccgugugcuaugugcugacagggcggagcgccgaucuggaacucgagcgcgcugccgacgucaagugggaggaucaagccgaaaucuccggaagcucuccuauucugagcaucaccaucuccgaggacggcucuaugagcauuaaaaacgaagaggaggaacacacacuuacgauccugauuagaaccgggcuccuggugaucuccggaguuuuccccgugucuauuccgaucacagcugcggccugguaccucugggaggucaagaagcagcgggcuggcgugcugugggauguuccuucucccccucccguggggaaagccgaacuugaggacggagccuaucgcaucaagcagagaggcauuuuuggcuacucccagaucggggcuggagucuauaaagaaggcaccuuccauacaauguggcacgugaccagaggggccguccugaugcaucgcggaaagagaauugagcccuccugggcggaugugaaaaaggaccugaucagcuacggcgggggauggaagcucgagggcgaauggaaagagggcgaagagguucaagugcuggcucuugaaccugggaagaauccgcgggccguccagacgaaacccggacuguuuaagaccaacacaggcaccauuggggccgugucccucgauuucagcccuggaacaucuggcucccccaucguugacagaaaagggaagguggucggacuguacggcaauggcguggugacccgcagcggggcuuauguuucugccaucgcgcagacagagaaguccauugaggauaacccugaaaucgaggacgauauuuuccggaaaaagagacucacgaucauggaccugcaccccggagcuggcaaaaccaagcgcuaccuuccugccauuguccgggaagccaucaaaagagggcugcgcacacugauucucgcuccgacccgggugguggccgcugagauggaagaggcccugagaggacuucccauccgcuaucagaccccugcgauccgggccgagcauacaggcagagaaauugucgaccugaugugucacgcuacguuuaccaugcggcuccugagccccgugcgcguuccuaacuacaaucucaucauuauggaugaggcccacuucacagaccccgcuuccaucgccgccagaggguauauuucuacccggguggaaaugggcgaggcugcgggaaucuuuaugacagccaccccgccuggcagccgcgaucccuucccccaauccaacgcuccuaucauggacgaggaaagagagauucccgaacggagcuggaacucugggcaugagugggucacggauuuuaagggaaagacagugugguucguuccuuccaucaaagccggcaacgacauugccgcuugccugagaaagaaugggaaaaaggugauccagcuuagccgcaaaaccuuugauucugaauacgucaagacccgggccaacgacugggauuucgugguuacaaccgacauuagcgagaugggagcgaauuuuagagcugagcgcgugaucgauccgcggagauguaugaagcccgucauccugacagacggcgaggaacgcgugauucuggccgggccuaugcccgugacccacuccucugccgcucagcggagaggccgcaucggaagaaacccuaaaaaugaaaacgaccaauauauuuacaugggcgagccccucgaaaaugaugaggacugcgcccauuggaaggaggcgaaaaugcugcuugauaacaucaauacgccggaagggauuaucccuagcauguucgagcccgaacgggagaaggucgacgccauugauggagaauaccgccugagaggcgaggcucggaaaacauuuguugaccucaugcgcagaggggaucugccuguguggcuggccuaucggguggcugccgagggaaucaacuacgcugacagacgcugguguuucgauggcaucaagaauaaccagauucucgaagagaacgucgaaguggagaucuggaccaaagagggggaacggaagaaacuuaaacccagauggcuggacgcccgcauuuauuccgauccucuggcgcucaaggaguucaaagaauuugccgcuggccggaagucucugacacuuaaucugaucaccgagaugggaagacuccccacguucaugacccagaaagcccgggacgcucuggauaaccuggccguucuccacacagccgaagcuggcgggcgcgcguacaaucacgcccuuagcgagcugccggagacccuggaaacacuccugcuucugacccuccuggcuacagugaccggaggcauuuuucuguuccucauguccgggaagggaaucggcaagaugacgcuuggcaugugcugcaucauuacagccagcauccugcugugguaugcccagauucaaccucauuggaucgcugccucuauuauccucgaguuuuuccugaucguccuucugauucccgaacccgagaaacagagaaccccucaggacaaccagcucaccuacgugguuaucgcgauucugacaguggucgccgcuaccauggccaaugaaaugggguuucuggagaagaccaagaaggaccucggacuuggcuccaucacgacccaagagagcgaauccaacauucuggauaucgaccugcggccggcuucugccuggacacucuaugcgguggccaccacauucgucacccccaugcugcgccacagcauugaaaauuccucugugaacguuagccuuacggcuaucgccaaucaggcuaccgugcugauggggcucggaaaaggcuggccucuguccaagauggauaucggggugccccugcucgccauuggauguuacagccaggucaacccuaucacacuuaccgcugcccugcugcuccugguugcgcauuacgccauuaucggccccggccuucaggcuaaggccacaagagaagcucaaaaacgggccgccgcggggauuaugaagaauccuaccguggacggaaucacggugaucgaucuggagccgauucccuaugacccuaaauuugaaaagcagcucggccaggucaugcugcugauccucugcgugacacagguucuuaugaugcgcaccacaugggcucugugugaggcccugacccucgcuaccgggcccauuucuacacugugggagggaaacccuggcagauucuggaauacgaccaucgccguguccauggccaacauuuuucgggggagcuaccuugcuggagccggccuccuguucucuaucaugaaaaauacaaccaacacacgcagaggcaccgggaauaucggagaaacgcugggcgagaaguggaagucccggcugaacgcgcucgggaaaagcgaauuucaaauuuauaagaaaucuggaauccaggaggucgauagaacacuugccaaggagggcauuaaacgcggggaaaccgaccaccaugcugugagccggggauccgccaagcugagaugguucgucgagcgcaacauggugacccccgaaggcaaaguuguggaucugggcugcgggcggggaggcuggucuuacuauugugggggacucaagaaugucagagaggugaagggccugacaaaagggggaccgggccacgaggaaccuauccccaugagcaccuacggcuggaaccuuguucgccugcaguccgggguggacgucuucuuuacacccccugagaagugcgauacgcuccugugugacauuggagaaagcucccccaauccuaccaucgaggcuggccggacacugagagugcucaaccuuguggaaaauuggcugaacaauaacacccaauucugcaucaaaguucugaauccguauaugcccucugucauugagaagauggaagcccuccagcgcaaauacgggggagcgcuggugcggaacccucuuagcagaaauuccacacacgagauguacugggugucuaacgccaccggcaauaucgucagcuccguuaacaugauuucucgcaugcugaucaaucgguuuacgaugaagcauaagaaagcuaccuaugagcccgauguggaccucgggagcggaacaagaaacauuggcaucgaauccgagauuccuaaccuggacaucaucggcaagcgcauugagaagaucaagcaggagcacgaaaccagcuggcauuacgaucaggaccaccccuauaaaacaugggccuaccacgggucuuaugagaccaagcaaacaggauccgcuagcucuauggugaauggcgucgugagacugcucaccaagccgugggauguugugccuauggucacgcagauggccaugacagacaccacccccuucgggcagcagcggguguuuaaagagaagguugauacacgcacgcaagaaccuaaagagggaaccaagaaacuuaugaagauuacagcugaauggcuguggaaggagcugggcaaaaagaaaacccccagaauguguacacgggaggaguucaccagaaaggugcgguccaacgccgcgcucggggccaucuuuacagacgagaauaaauggaaaagcgcucgcgaagccgucgaggauggaagauucugggaacugguggaccgggagcgcaaccuucaucuggagggcaaaugcgaaaccuguguguacaauaugaugggcaagagagagaagaaacucggggaauuuggaaaggcuaaaggcucucgggccauuugguauauguggcugggggcccgcuuccuggaguuugaagcgcucggauuccugaacgaggaucacugguuuuccagaggcaauagccuuuccggggucgagggcgaaggacugcaucggcucggcuacauccugcgcgacguuagcaagaaagaagggggagcuauguacgccgaugacacggccggcugggacaccagaaucacacuugaagaucugaagaacgaggaaauggugaccaaucacaugaagggggagcauaaaaagcucgcugaggccauuuucaaacugacauaucagaacaaggugguccgggugcagcgcccuacccccagaggaacgguuauggacaucauuucucggaaagaucagcgcggcagcgggcaagugggcacauacggacugaauaccuucacaaacauggaagcucagcucaucagacagauggagggcgaagggauuuuuaaguccauccaacggcugaccgucacggaggagaucgccgugcagaauuggcuugcgagaguuggacgcgaacggcugucuagaauggccauuagcggcgacgauugcguggucaagccgcucgacgaucgcuucgcuuccgcccugaccgcucuuaacgacauggggaaagugcggaaggauauccagcagugggagccuucuagaggauggaaugacuggacacaaguucccuuuugcagccaccacuuccaugaacuggugaugaaagauggccgcaugcucgucgugcccugucggaaccaggacgagcugauugggagagcccgcaucucccagggcgcgggauggucucugaaggaaaccgccugccucggcaaaagcuaugcucagauguggacacugauguacuuucaccggagagaucuucgccuggccgcuaacgccauuuguuccgcugucccuagccauugggugccgaccucucggacaaccugguccauccacgccaagcacgaguggaugacgacagaggacaugcucgcgguuuggaauagaguguggauucaagaaaaccccuggauggaggacaagaccccugucgaaagcugggaggaagugcccuaucuggggaaacgggaggaucaguggugcggaucucuuaucggccugaccuccagagccacaugggcuaagaauauccagaccgccauuaaccaggugcgcagccucaucgggaaugaggaauacacagacuauaugccuuccaugaaacgguucagaaaggaggaagaggaagccggaguucugugguga

SEQ ID NO: 19981 - RNA, 9876 nt, Artificial Sequence
  derived and/or modified CDS sequence (opt5) from DENV-2__EU482722__SS-prME
acagccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagaucaaaucuugccacuggccuaagagccauacccugugguccaaugggguucuugaaagcgagaugauuauccccaaaaacuucgcuggaccggugucucagcacaacuaccgcccuggcuaucauacgcagacagccgggcccuggcaccucggaaagcuggaaauggauuuugacuucugugagggcaccaccgucguggugacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucgucaauucucugguuaccgccggccaugggcaaaucgauaacuuuagccugggagugcuuggcauggcccucuuccuggaagagaugcugagaacacgcguggggaccaaacacgcuauucuccuggucgcgguguccuuuguuacgcuuaucaccggaaauaugucuuuccgggaccugggcagagugauggucauggugggcgccacaaugaccgaugacauugggaugggaguuacauaucucgcucugcuggccgccuuuaaggugcgcccuaccuucgcugccggccuucugcucagaaaacugacgagcaaggagcucaugauggcgacaaucgggauugcucugcuuucccagucuaccauccccgaaacaauccuggagcucaccgaugcccuggcccugggaaugaugguccuuaaaauugugcggaacauggaaaaguaccagcuggcuguuaccaucauggccauuagcugcgugccuaaugcggucauccuccaaaacgcuuggaagguguccuguacaauucuggccgccgugagcgucucuccccuccugcuuacguccagccagcagaaagcugacuggaucccucuggcccucaccaucaagggccugaaucccacagcuauuuuucugaccacacuuucucgcaccuccaaaaagagaagcuggccgcugaacgaggccguuauggcgguggggauggugucuauccucgccuccagccugcucaaaaaugacauuccuaugacgggaccccuggucgcuggcggccuucugacagugugcuauguucugaccgggcgguccgccgaucucgaacuggagcgcguggcugacgucaagugggaggaucaggccgaaaucagcggaucuagcccuauucuuuccaucaccauuucugaggacggcagcauguccaucaaaaacgaagaggaggaacacacacugaccauccucauuagaacagggcugcucgugaucucuggaguuuuccccgugagcauuccgaucacggccgcugcgugguaccugugggaggucaagaagcaacgggccggcgugcuuugggaugucccuucucccccucccguggggaaagcugaacuggaggacggagccuaucgcauuaagcagagaggcaucuuuggcuacagccagaucggggccggaguuuauaaagaaggcaccuuccauacaauguggcacgugaccagaggggcuguccugaugcaucgcggaaagagaauugagcccagcugggccgaugugaaaaaggaccucaucuccuacggcgggggauggaagcuggagggcgaauggaaagagggcgaagagguucaggugcuugcgcuggaaccugggaagaauccgcgggcuguccaaacaaaacccggacucuuuaagaccaacacgggcaccauuggggccgugagccuggauuucucuccuggaacauccggcagccccaucguggacagaaaagggaagguugucggacucuacggcaauggcguggugacccgcucuggggccuaugucuccgcuauugcccagacagaaaagagcaucgaggauaacccugaaaucgaggacgauauuuuccggaaaaagagacugaccaucauggaccuucaccccggagcgggcaaaacaaagcgcuaccugccugcuauugugcgggaagccaucaaaagagggcugcgcacgcucauucuggccccgacccggguuguggcugccgagauggaagaggcucuuagaggacugcccauccgcuaucagaccccugccauucgggcggagcauaccggcagagaaaucgucgaccucaugugucacgccaccuuuacaaugcggcugcucucccccgugcgcguuccuaacuacaaucugaucauuauggaugaggcucacuucacggaccccgccucuaucgcugccagaggguauauuagcacccggguggaaaugggcgaggccgcuggaaucuuuaugacagcgaccccgccuggcucccgcgaucccuucccccagagcaacgccccuauuauggacgaggaaagagagauccccgaacggucuuggaacuccgggcaugagugggucacagauuuuaagggaaagaccgugugguucguuccuagcaucaaagcuggcaacgacauugccgccugccuuagaaagaaugggaaaaaggugauccaacugucucgcaaaacguuugauagcgaauacgucaagacacgggcuaacgacugggauuucguggugaccaccgacauuuccgagaugggagccaauuuuagagcggagcgcgucaucgauccgcggagauguaugaagcccguuauucugacagacggcgaggaacgcgugauccucgcugggccuaugcccgugacccacucuagcgccgcccagcggagaggccgcaucggaagaaacccuaaaaaugaaaacgaccaguauauuuacaugggcgagccccuggaaaaugaugaggacugcgcucauuggaaggaggccaaaaugcuucuggauaacaucaauacaccggaagggauuaucccuuccauguucgagcccgaacgggagaaggucgacgcgauugauggagaauaccgccucagaggcgaggcccggaaaaccuuuguggaccugaugcgcagaggggaucugccuguuuggcucgcuuaucggguggccgcugagggaaucaacuacgccgacagacgcugguguuucgauggcauuaagaauaaccaaauccuugaagagaacgucgaaguggagaucuggacgaaagagggggaacggaagaagcugaaacccagauggcuggacgcucgcauuuauucugauccucucgcccugaaggaguucaaagaauuugcggccggccggaagacacuuacccugaaucucaucacagagaugggaagacugcccaccuucaugacgcagaaagcucgggacgcccuggauaaccucgcuguucuucacaccgccgaagugggcgggcgcgccuacaaucacgcucugagcgagcugccggagacacucgaaacccugcuucugcucacacugcuggcgaccgucacaggaggcauuuuucucuuccuuauguccgggaagggaaucggcaagaugacccugggcaugugcugcauuaucacggccagcauccugcucugguaugcucagauucagccucauuggaucgccgccucuauuauccuggaguuuuuccuuauugugcugcucauccccgaacccgagaaacaaagaacaccucaggacaaccagcugaccuacgucgugaucgcuauucugaccguuguggccgcgacaauggccaaugaaaugggguuucucgagaagaccaaaaaggaccuuggacugggcuccaucacaacgcaggagagcgaauccaacauucuggauaucgaccuccggccggcuucugccuggacccuguaugcuguggccacaaccuucgucacacccaugcuucgccacagcauugaaaauuccucuguuaacgugagccugaccgcgaucgccaaucaagcuacggugcucauggggcugggaagaggcuggccucuguccaaaauggauauuggggucccccuccuugccaucggauguuacagccaggugaacccuaucacccugacagcugcccugcuccugcuuguugcucauuacgccauuaucggccccggccugcaggcgaaggccacccgggaagcucagaagcgcacagccgcugggauuaugaaaaauccuaccguggacggaaucacggucauugaucucgagccgauccccuaugacccuaaguuugaaaaacaacugggccaggugaugcugcucguccuuugcgugacacagguucugaugaugagaaccacaugggcccugugugaggcccucacccuggcgaccgggcccaucucuacacuuugggagggaaacccuggccgguucuggaauacgaccauugcuguguccauggccaacaucuuucgcgggagcuaccuggcuggagccggccuccuguucucuauuaugaagaauacaaccaacacaagacggggcaccgggaauaucggagaaacgcugggcgagaaauggaaguccagacucaacgcccuugggaaguccgaauuucagauuuauaaaaagucuggaauccaagaggucgaucgcacacuggcuaaagagggcaucaagagaggggaaaccgaccaccaugccgugagcagaggauccgcgaaacugcgcugguucguugagcggaacauggugacccccgaaggcaaggucguggaucucggcugcgggagaggaggcuggucuuacuauugugggggacugaaaaaugugcgcgagguuaagggccuuacaaaagggggaccgggccacgaggagccuauucccaugagcaccuacggcuggaaccugguccggcuccaguccgggguggacguguucuuuacacccccugagaaaugcgauacgcugcugugugacaucggagaaagcucccccaauccuaccauugaggccggcagaacacuccgcguccuuaaccugguugaaaauuggcugaacaauaacacccaguucugcgugaaggugcucaauccguauaugcccucugucaucgagaaaauggaaacacugcaacggaaguacgggggagcucuugugagaaacccucugagccgcaauuccacccacgagauguacuggguuucuaacgccacgggcaauauugugagcuccgucaacaugaucucucggaugcucaucaauagauuuaccaugaaacauaagaaggcuacauaugagcccgauguggaccuggggagcggaacccgcaacauuggcaucgaaaacgagauuccuaaucuggacaucauuggcaaaagaaucgaaaagauuaaacaggagcacgaaacauccuggcauuacgaucaggaccaccccuauaagaccugggccuaccacgggagcuaugagacaaaacagaccggaucugcguccagcaugguuaacggcguggucaagcuccuuacgaagccgugggaugugaucccuauggugacacaaauggccaugaccgacaccacacccuucgggcagcagcgggucuuuaaagagaagguugauacgcgcacccaggaaccuaaagagggaacaaagaaacugaugagaaucaccgcugaauggcuguggaaggagcucggcaagaaaaagacaccccggauguguaccagagaggaguucacacggaaagugcgcucuaaugccgcucugggggccauuuuuaccgacgagaacaaguggaaauccgcuagagaagccguggaggauagccgguucugggaacuugucgaccgcgagagaaaucugcaucucgagggaaagugcgaaacguguguguacaacaugaugggcaaacgggagaagaagcugggcgaauuugggaaagcgaagggaucucgcgccaucugguauauguggcugggcgcuagauuccucgaguuugaagcccugggguuccuuaaugaggaucacugguuuucccggggaaacagccuguccggcguugagggggaaggccuccauaaacugggauacauucuucgcgacgugagcaagaaagagggcggggcuauguacgccgaugacaccgccggaugggacacaagaaucacccuggaagaucucaagaaugaggaaauggucacaaaccacaugaagggcgagcauaaaaagcuggcggaggcuauuuucaaacugaccuaucaaaauaaggugguucgggugcagcgcccuacgcccagagggacagucauggacaucaucucucggaaagaucagcgcggaagcggccagguggggaccuacggccucaacacauucaccaauauggaagcccaacugauuagacagauggagggagaaggcaucuuuaaguccauucagcggcuuacgguuaccgaggagaucgccgugcaaaacuggcuggcuagagucgggcgcgaacggcucucuagaauggccauuagcggagacgauugcguggucaagccgcuggacgaucgcuucgcuuccgcccuuacagcgcugaaugacaugggcaaagugcggaaggauauccagcagugggagccuucuagaggguggaacgacuggacccagguucccuuuugcagccaccacuuccaugaacucgugaugaaagauggacgcguccugguggugcccugucggaaccaagacgagcugaucggcagagcccgcauuucccagggggcuggcuggucucucaaggaaacagccugccugggaaaaagcuaugcucagauguggacccuuauguacuuucaccggagagaucugcgccucgccgcgaaugccaucuguuccgcuguuccuagccauugggugccgacaucucggaccacgugguccauucacgccaagcacgaguggaugacaaccgaggacaugcuggcugucuggaacagaguguggauccaggaaaaucccuggauggaggacaagaccccuguugaaagcugggaggaagugcccuaucuuggcaaacgggaggaucaauggugcgggucucugauuggacucacauccagagccaccugggcuaagaacauccagacagccauuaaucagguccgcagccugaucggcaacgaggaauacacggacuauaugccuuccaugaaacgguucagaaaggaggaagaggaagcgggggugcugugguga

SEQ ID NO: 19982 - RNA, 9876 nt, Artificial Sequence
  derived and/or modified CDS sequence (opt5) from DENV-2__EU482723__SS-prME
accgccggcgugaucauuaugcugauccccaccgcuauggccuuccaccucacgacccggaauggggagccucauaugauugucggacggcaggaaaagggcaaaagccugcuuuuuaagacggaggacgggguuaauaugugcacccugauggcgaucgaucucggagaacugugugaggacacaauuaccuacaaaugcccgcuucugagacaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagcgggccuggaaacacguucagcgcaucgagaccuggauucugagacaucccggcuucacaaucauggccgcuauucucgccuacaccaucgggaccacacacuuucagcgggcucugauuuucauccuucugacggccguggcgccuagcaugaccaugcgcugcauuggaaucuccaacagagauuuugucgaaggcgugucugggggaagcuggguugacaucgugcucgagcacggcuccugugucacaaccauggccaagaauaagcccacacuggauuucgaacuuauuaaaaccgaggcuaagcagccugccacgcugcggaaauauugcaucgaagcuaagcucacaaacaccaccacagagagccgcuguccgacccaaggggagcccucucugaaugaggaacaggacaaaagauuuauuugcaagcauuccaugguggaucggggauggggcaacggcugugggcuguucggaaagggcgggaucgugacaugcgccauguuuacgugcaaaaagaauauggaaggaaaagucguucucccugagaaccuggaauacaccauugugaucacaccccacagcggcgaggagcaugcgguggggaaugacaccggaaagcacggcaaagaaaucaagauuacaccucagucuuccaucaccgaggccgaacuuacgggcuaugggaccgucacaauggaguguagcccccgcaccggacuggauuucaacgaaauggugcuccugcagauggaggacaaggcuuggcuuguucacagacaaugguuucuggaucucccgcugccuuggcugcccggcgccgacacacaggggucuaauuggauucagaaggagacccucgugacguucaagaacccucaugcuaaaaagcaggacgucgugguucugggaucccaagaaggcgccaugcacacagcccuuaccggggcuacagagauccagaugagcuccggcaaucugcucuuuaccggacaucugaaaugccggcuuagaauggauaagcugcagcucaaaggcaugucuuacagcauguguaccgggaaguucaagauugugaaagaaaucgcggagacacaacacggaacgaucgucauucgcgugcaguaugagggcgacgggucccccugcaagauccccuucgaaauuauggaucuggagaaacggcauguccugggaagacucaucaccgugaacccuauuguuacagaaaaggacagcccggugaacaucgaggccgaacccccuuuuggcgauucuuacauuaucaucggggucgagcccggccagcugaaacuuaauugguucaagaagggauccagcauuggccagauguuugagaccacaaugcgcggggcuaaacggauggccauccugggagacaccgccugggauuucggcucucucgggggaguguuuacgagcauuggcaaggcucugcaccaaguuuucggggccaucuacggcgcggcuuuuuccggagugucuuggacaaugaaaauucugaucggcgucaucauuaccuggaucgggaugaacagcagauccaccagccuuucugugucccucgugcugguuggagucgugacacuguaucucggcgugaugguccaggccgacagcgggugugugguuucuuggaagaauaaagaacugaagugcggauccggcauuuucaucaccgauaacgugcacacauggacggagcaguacaaguuucagccugaaagccccuccaaacuugccucugcuauucaaaaggcccaugaggaagggaucuguggcauccgcagcgucacccggcuggagaaucucauguggaaacagauuacaccggagcugaaccacauccuguccgaaaaugaggugaaacuuaccauuaugacaggagacaucaaaggcauuaugcaggcugggaagagaucucuccgcccucagcccaccgaacugaaauauagcuggaagacguggggaaaggccaaaaugcuguccaccgagagccauaaccaaacauuccucaucgauggcccugaaaccgcggagugccccaauacaaaccgggccuggaacucucuggagguugaagacuacggguuuggaguguucuccaccaacaucuggcuuaagcugagagagaaacaggacgucuuuugugauagcaagcucaugucugcugccauuaaagacaaucgcgcugugcacgccgauaugggcuauuggaucgaauccgcgcugaacgacacauggaagauggagaaggccagcuucauugagaucaaaucuugccacuggccuaagagccauacccugugguccaauggcguucuugaaagcgagaugauuauccccaaaaacuucgcugggccggugucucagcacaacuaccggccuggauaucauacgcagacagccggccccuggcaccucgggaagcuggaaauggauuuugacuucugugagggaaccaccgucguggugacagaagauugcggcaauagagggcccucccugcggaccacgacagcuagcggaaaacucauuaccgaguggugcugucgcuccugcacacugccuccgcuuagauaccggggcgaggacggcuguugguacgggauggaaaucagaccccugaaggagaaggaagagaaccucgucaauucucugguuaccgccggacauggccaaaucgauaacuuuagccugggggugcuuggaauggcccucuuccuggaagagaugcugcgcacacgggugggcaccaaacacgcuauucuccuggucgcgguguccuuuguuacgcuuaucaccgggaauaugucuuucagagaccugggacgcgugauggucauggugggcgccacaaugaccgaugacauuggcauggggguuacauaucucgcucugcuggccgccuuuaaggugagaccuaccuucgcugccggacuucugcuccggaaacugacgagcaaggagcucaugauggcgacaaucggcauugcucugcuuucccagucuaccauccccgaaacaauccuggagcucaccgaugcccuggcccuggggaugaugguccuuaaaauugugcgcaacauggaaaaguaccagcuggcuguuaccaucauggccauuagcugcgugccuaaugcggucauccuccaaaacgcuuggaagguguccuguacaauucuggccgccgugagcgucucuccccuccugcuuacguccagccagcagaaagcugacuggaucccucuggcccucaccaucaagggacugaaucccacagcuauuuuucugaccacacuuucuagaaccuccaaaaagcggagcuggccgcugaacgaggccguuauggcggugggcauggugucuauccucgccuccagccugcucaaaaaugacauuccuaugacggggccccuggucgcuggaggccuucugacagugugcuauguucugaccggccgcuccgccgaucucgaacuggagagagcugccgacgugaagugggaggaucaggccgaaaucagcgggucuagcccuauucuuuccaucaccauuucugaggacggaagcauguccaucaaaaacgaagaggaggaacacacacugaccauccucauucggacaggccugcucgucaucucugggguguuccccguuagcauuccgaucacggcugcggccugguaccugugggaggugaagaagcaacgcgcuggaguccuuugggaugugccuucucccccucccgucggcaaagccgaacuggaggacggggccuauagaauuaagcagcggggaaucuuuggcuacagccagaucggcgcugggguguauaaagaaggaaccuuccauacaauguggcacguuacccgcggcgccgugcugaugcauagagggaagcggauugagcccagcugggcggaugucaaaaaggaccucaucuccuacggaggcggguggaagcuggagggagaauggaaagagggcgaagaggugcagguucuugcucuggaaccuggcaagaauccgagagccgugcaaacaaaacccgggcucuuuaagaccaacacgggaaccauuggcgccgucagccuggauuucucuccugggacauccggaagccccaucguggaccgcaaaggcaaggugguugggcucuacggaaauggcgucgugacccggucuggcgcuuauguguccgccauugcgcagacagaaaagagcaucgaggauaacccugaaaucgaggacgauauuuuccgcaaaaagcgccugaccaucauggaccuucaccccggggcuggaaaaacaaagcgguaccugccugccauugucagagaagccaucaaacgcggccugcggacgcucauucuggcuccgaccagagugguugccgcugagauggaagaggcccuucgcgggcugcccauccgguaucagaccccugcgauuagagccgagcauaccggacgggaaaucguggaccucaugugucacgcuaccuuuacaaugcgccugcucucccccgucagagugccuaacuacaaucugaucauuauggaugaggcccacuucacggaccccgcuucuaucgccgcccggggcuauauuagcacccgcguugaaaugggggaggcugcgggcaucuuuaugacagccaccccgccuggauccagagaucccuucccccagagcaacgcuccuauuauggacgaggaacgggagauccccgaaagaucuuggaacuccggccaugagugggugacagauuuuaaggggaagaccgucugguucgugccuagcaucaaagccggaaacgacauugccgcuugccuucgcaagaauggcaaaaagguuauccaacugucucggaaaacguuugauagcgaauacgugaagacaagagccaacgacugggauuucgucgugaccaccgacauuuccgagaugggggcgaauuuucgcgcugagcgggugaucgauccgagacgcuguaugaagcccgucauucugacagacggagaggaacggguuauccucgccggcccuaugcccgugacccacucuagcgccgcucagagacgcgggagaaucggccggaacccuaaaaaugaaaacgaccaguauauuuacaugggagagccccuggaaaaugaugaggacugcgcccauuggaaggaggcgaaaaugcuucuggauaacaucaauacaccggaaggcauuaucccuuccauguucgagcccgaacgcgagaagguggacgccauugauggggaauacagacuccggggagaggcucgcaaaaccuuugucgaccugaugagacggggcgaucugccuguguggcucgccuauagaguugcugccgaggggaucaacuacgcugaccgccggugguguuucgauggaauuaagaauaaccaaauccuugaagagaacguggaagucgagaucuggacgaaagagggcgaaagaaagaagcugaaaccccgcuggcuggacgcccggauuuauucugauccucucgcgcugaaggaguucaaagaauuugccgcugggagaaagagccuuacacugaaucucaucaccgagaugggccggcugcccacauucaugacccagaaagcccgcgacgcucuggauaaccucgccgugcuucacacggccgaaguuggaggcagagcuuacaaucacgcgcuguccgagcugccggagacccucgaaacacugcuucugcucacccugcuggccacagugaccgggggaauuuuucucuuccuuaugagcggcaaggggaucggaaagaugacacugggcaugugcugcauuaucaccgcuucuauccugcucugguaugcccagauucagccucauuggaucgccgcuuccauuauccuggaguuuuuccuuauuguccugcucauccccgaacccgagaaacaacggacgccucaggacaaccagcugacauacguggucaucgccauucugaccgugguugcggccaccauggcuaaugaaaugggcuuucucgagaagaccaaaaaggaccuugggcugggaagcaucaccacacaggaguccgaaucuaacauucuggauaucgaccuccgcccggccagcgcuuggacgcuguaugccguggcgaccacauucgugacccccaugcuuagacacuccauugaaaauucuagcgucaacguuucccugacagccaucgcuaaucaagccaccgugcucaugggccuggggcggggauggccucugagcaaaauggauauuggcgugccccuccuugcuaucggguguuacucucaggucaacccuaucacgcugaccgccgcucugcuccugcuuguggcccauuacgcgauuaucggacccggccugcaggccaaggcuacacgcgaagcccagaagagaaccgcugccggcauuaugaaaaauccuacaguugacgggaucaccgugauugaucucgagccgauccccuaugacccuaaguuugaaaaacaacugggacaggucaugcugcucgugcuuugcgucacacaggugcugaugaugcggacaaccugggcccugugugaggcgcucacacuggcuaccggccccaucuccacccuuugggaggggaacccuggacgcuucuggaauacaacgauugccguuagcauggcuaacaucuuuagaggcucuuaccuggccggggccggacuccuguucuccauuaugaagaauaccacaaacacccggagaggcacaggcaauaugggggaaacccugggagagaaauggaagucccgccucaacgcucuuggcaagucugaauuucagaucuauaaaaagagcgggauucaagagguggaucggacgcuggccaaagagggaaucaagagaggcgaaacagaccaccaugcggucucccgcgggucugccaaacugcggugguucguggagagaaacaugguuacccccgaaggaaagguggucgaucucggcugcggccgcgggggauggagcuacuauuguggcgggcugaaaaaugugcgggaggugaagggacuuaccaagggcgggccgggacacgaggagccuauccccauguccacauacggcuggaaccugguuagacuccagagcggcgucgacguguucuuuacacccccugagaaaugcgauacacugcugugugacauuggggaauccucucccaauccuacgaucgaggcuggacgcacccuccgggugcuuaaccuggucgaaaauuggcugaacaauaacacacaguucugcauuaagguucucaauccguauaugcccagcgugaucgagaaaauggaaacccugcaaagaaaguacggcggggcccuugugcgcaacccucuguccagaaauucuacacacgagauguacugggucagcaacgcuaccggaaauauuguguccucuguuaacaugaucagcagaaugcucaucaaucgcuuuacgaugaaacauaagaaggccaccuaugagcccgauguggaccugggcuccgggacaagaaacauuggaaucgaaaacgagauuccuaaucuggacaucauuggcaaacggaucgaaaagauuaaacaggagcacgaaaccagcuggcauuacgaucaggaccaccccuauaagacaugggcguaccacggcucuuaugagaccaaacagacaggguccgccagcucuauggucaacggagugguuaagcuccuuaccaagccgugggauguggucccuauggugacgcaaauggcuaugacagacaccacccccuucggccagcagcgcguguuuaaagagaaggucgauacaagaacgcaggaaccuaaagaggggaccaagaaacugaugcggaucacagccgaauggcuguggaaggagcucggaaagaaaaagacccccagaauguguacacgggaggaguucacccgcaaaguuagauccaaugcugcccugggcgcuaucuuuacagacgagaacaaguggaaaagcgcccgggaagcgguggaggauucucgcuucugggaacuuguggacagagagcggaaucugcaucucgaggggaagugcgaaaccugugucuacaacaugaugggaaaacgcgagaagaagcugggcgaauuuggcaaagccaagggguccagagcuauuugguauauguggcugggagcccgguuccucgaguuugaagcucugggcuuccuuaaugaggaucacugguuuagccgcgggaacucccugagcggaguggagggcgaagggcuccauaaacugggcuacauccuuagagacguuucuaagaaagagggaggcgccauguacgccgaugacacggcggggugggacacccggauuacacuggaagaucucaagaaugaggaaauggugaccaaccacaugaagggagagcauaaaaagcuggcugaggccaucuucaaacugacauaucaaaauaaggucgugcgcguucagagaccuacaccccggggcacggugauggacauuaucagccgcaaagaucagagaggguccggacaggucggcacauacgggcucaacaccuucacaaauauggaagcccaacugauccggcagauggagggcgaaggaauuuuuaagucuauccagagacuuaccgugacggaggagauugcuguucaaaacuggcuggcccgcgugggccgggaaagacucagccgcauggcuaucuccggggacgauugcgucgugaagccgcuggacgaucgguucgccucugcgcuuaccgcccugaaugacaugggaaaagucagaaaggauauucagcagugggagccuagccgcggcuggaacgacuggacacaggugcccuuuugcucccaccacuuccaugaacucguuaugaaagaugggcgggugcuggucgugcccuguagaaaccaagacgagcugaucggacgcgcucggaucucucagggcgccggguggagccucaaggaaaccgcuugccugggcaaauccuaugcccagauguggacacuuauguacuuucacagacgcgaucugcggcucgcggccaaugcuauuuguagcgccgugccuucucauuggguuccgaccuccagaacaaccuggagcauccacgcuaagcacgaguggaugacgacagaggacaugcuggccguguggaaccgggucuggauucaggaaaaucccuggauggaggacaagaccccuguggaaucuugggaggaaguucccuaucuuggaaaaagagaggaucaauggugcggcucccugaucgggcucaccagccgcgcuacaugggccaagaacauucagaccgcgaucaaucaggugcggucccugauuggaaacgaggaauacacagacuauaugccuucuaugaaaagauuccgcaaggaggaagaggaagccggcguccugugguga

SEQ ID NO: 19983 - RNA, 9876 nt, Artificial Sequence
  derived and/or modified CDS sequence (opt5) from DENV-2__EU482724__SS-prME
accgccggcgugaucauuaugcugauccccacagcuauggccuuccaccucacgacccggaacggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccagccgcgccuggaacucucuggagguugaagacuacggauuuggcguguucuccacaaauaucuggcuuaagcugcgggagaaacaggacgucuuuugugauagcaagcucaugucugcugccauuaaagacaacagagcugugcacgccgauaugggcuauuggaucgaauccgcgcugaaugacaccuggaagauggagaaggccagcuucauugagaucaaaucuugccacuggccuaagagccauacgcugugguccaacgggguucuugaaagcgagaugauuauccccaaaaauuucgcuggaccggugucucagcacaacuaccgcccuggcuaucauacacagaccgccgggcccuggcaccucggaaagcuggaaauggauuuugacuucugugagggcaccacagucguggugaccgaagauugcgggaaccggggacccucccugagaacgacaaccgcuagcggcaaacucauuacagaguggugcugucgguccugcacccugccuccgcuucgcuacagaggcgaggacggguguugguacggaauggaaauccggccccugaaggagaaggaagagaaucucgucaacucucugguuacagccggccaugggcaaaucgauaauuuuagccugggagugcuuggcauggcccucuuccuggaagagaugcugagaacccgcguggggacgaaacacgcuauucuccuggucgcgguguccuuuguuacccuuaucacaggaaacaugucuuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaagcaaggagcucaugauggcgaccaucgggauugcucugcuuucccagucuacaauccccgaaaccauccuggagcucaccgaugcccuggcccugggaaugaugguccuuaaaauugugcggaauauggaaaaguaccagcuggcuguuacaaucauggccauuagcugcgugccuaacgcggucauccuccaaaaugcuuggaagguguccuguacgauucuggccgccgugagcgucucuccccuccugcuuaccuccagccagcagaaagcugacuggaucccucuggcccucacaaucaagggccugaaccccaccgcuauuuuucugacaacccuuucucgcacguccaaaaagagaagcuggccgcugaaugaggccguuauggcgguggggauggugucuauccucgccuccagccugcucaaaaacgacauuccuaugacaggaccccuggucgcuggcggccuucugaccgugugcuauguucugaccgggcgguccgccgaucucgaacuggagcgcgcugccgacgugaagugggaggaucaggccgaaaucagcggaucuagcccuauucuuuccaucacaauuucugaggacggcagcauguccaucaaaaaugaagaggaggaacacacccugacaauccucauuagaacggggcugcucgucaucucuggaguguuccccguuagcauuccgaucaccgcugcggccugguaccugugggaggugaagaagcaacgggcuggcguccuuugggaugugccuucucccccucccgucgggaaagccgaacuggaggacggagccuaucgcauuaagcagagaggcaucuuuggcuacagccagaucggggcuggaguguauaaagaaggcacauuccauaccauguggcacguuacaagaggggccgugcugaugcaucgcggaaagagaauugagcccagcugggcggaugucaaaaaggaccucaucuccuacggcgggggauggaagcuggagggcgaauggaaagagggcgaagaggugcagguucuugcucuggaaccugggaagaacccgcgggccgugcaaaccaaacccggacucuuuaagacgaauaccggcacaauuggggccgucagccuggauuucucuccuggaaccuccggcagccccaucguggacagaaaagggaaggugguuggacucuacggcaacggcgucgugacacgcucuggggcuuauguguccgccauugcgcagaccgaaaagagcaucgaggauaauccugaaaucgaggacgauauuuuccggaaaaagagacugacaaucauggaccuucaccccggagcuggcaaaacgaagcgcuaccugccugccauuguccgggaagccaucaaaagagggcugcgcacccucauucuggcuccgacacgggugguugccgcugagauggaagaggcccuuagaggacugcccauccgcuaucagaccccugcgauucgggccgagcauaccggcagagaaaucguggaccucaugugucacgcuacauuuacgaugcggcugcucucccccguccgcgugccuaacuacaaccugaucauuauggaugaggcccacuucaccgaccccgcuucuaucgccgccagaggguauauuagcacacggguugaaaugggcgaggcugcgggaaucuuuaugaccgccacaccgccuggcucccgcgaucccuucccccagagcaaugcuccuauuauggacgaggaaagagagauccccgaacggucuuggaacuccgggcaugagugggugaccgauuuuaagggaaagacggucugguucgugccuagcaucaaagccggcaaugacauugccgcuugccuuagaaagaacgggaaaaagguuauccaacugucucgcaaaacauuugauagcgaauacgugaagacccgggccaaugacugggauuucgucgugaccacagacauuuccgagaugggagcgaacuuuagagcugagcgcgugaucgauccgcggagauguaugaagcccgucauucugaccgacggcgaggaacgcguuauccucgccgggccuaugcccgugacacacucuagcgccgcucagcggagaggccgcaucggaagaaauccuaaaaacgaaaaugaccaguauauuuacaugggcgagccccuggaaaacgaugaggacugcgcccauuggaaggaggcgaaaaugcuucuggauaauaucaacaccccggaagggauuaucccuuccauguucgagcccgaacgggagaagguggacgccauugauggagaauaccgccucagaggcgaggcucggaaaacguuugucgaccugaugcgcagaggggaucugccuguguggcucgccuaucggguugcugccgagggaaucaauuacgcugacagacgcugguguuucgauggcauuaagaacaaucaaauccuugaagagaacguggaagucgagaucuggacaaaagagggggaacggaagaagcugaaacccagauggcuggacgcccgcauuuauucugauccucucgcgcugaaggaguucaaagaauuugccgcuggccggaagucccuuacccugaaccucaucacagagaugggaagacugcccaccuucaugacgcagaaagcccgggacgcucuggauaaucucgccgugcuucacaccgccgaaguuggcgggcgcgcuuacaaccacgcgcuguccgagcugccggagacacucgaaacccugcuucugcucacacugcuggccaccgugacaggaggcauuuuucucuuccuuaugagcgggaagggaaucggcaagaugacccugggcaugugcugcauuaucacggcuucuauccugcucugguaugcccagauucagccucauuggaucgccgcuuccauuauccuggaguuuuuccuuauuguccugcucauccccgaacccgagaaacaaagaacaccucaggacaaucagcugaccuacguggucaucgccauucugaccgugguugcggccacaauggcuaacgaaaugggguuucucgagaagaccaaaaaggaccuuggacugggcagcaucacaacgcaggaguccgaaucuaauauucuggauaucgaccuccggccggccagcgcuuggacccuguaugccguggcgacaaccuucgugacacccaugcuucgccacuccauugagaacucuagcgucaauguuucccugaccgccaucgcuaaccaagccacggugcucauggggcugggaagaggcuggccucugagcaaaauggauauuggggugccccuccuugcuaucggauguuacucucaggucaauccuaucacccugacagccgcucugcuccugcuuguggcccauuacgcgauuaucggccccggccugcaggccaaggcuacccgggaagcccagaagcgcacagcugccgggauuaugaaaaacccuaccguugacggaaucacggugauugaucucgagccgauccccuaugacccuaaguuugaaaaacaacugggccaggucaugcugcucgugcuuugcgucacacaggugcugaugaugagaaccacaugggcccugugugaggcgcucacccuggcuaccgggcccaucuccacacuuugggagggaaauccuggccgguucuggaacacgaccauugccguuagcauggcuaauaucuuucgcgggucuuaccuggccggagccggccuccuguucuccauuaugaagaacacaaccaauacaagacggggcaccgggaacaucggagaaacgcugggcgagaaauggaaaagcagacucaaugcucuugggaagucugaauuucagauuuauaaaaagagcggaauccaagagguggaucgcacacuggccaaagagggcaucaagagaggggaaaccgaccaccaugcggucuccagaggaucugccaaacugcgcugguucguggagcggaacaugguuacccccgaaggcaagguggucgaucucggcugcgggagaggaggcuggagcuacuauugugggggacugaaaaacgugcgcgaggugaagggccuuacaaaagggggaccgggccacgaggagccuauucccauguccaccuacggcuggaaucugguucggcuccagagcggggucgacguguucuuuacacccccugagaaaugcgauacgcugcugugugacaucggagaauccucucccaacccuaccauugaggcuggcagaacacuccgcgugcuuaaucuggucgaaaacuggcugaauaacaauacccaguucugcguuaaggugcucaacccguauaugcccagcgugaucgagaaaauggaaacacugcaacggaaguacgggggagcccuugucagaaauccucugucccgcaacucuacccacgagauguacugggugagcaaugcuacgggcaacauuguuuccucugugaauaugaucagccggaugcucaucaacagauuuaccaugaaacauaagaaggccacauaugagcccgaugucgaccugggguccggaacccgcaauauuggcaucgaaaacgagauuccuaaccuggacaucauuggcaaaagaaucgaaaagauuaaacaggagcacgaaacaagcuggcauuacgaucaggaccaccccuauaagaccugggcguaccacgggucuuaugagacaaaacagaccggauccgccagcucuauggugaauggcguugugaagcuccuuacgaagccgugggaugucgugccuauggugacacaaauggcuaugaccgacaccacacccuucgggcagcagcgggucuuuaaagagaagguugauacgcgcacccaggaaccuaaagagggaacaaagaaacugaugagaaucaccgccgaauggcuguggaaggagcucggcaagaaaaagacaccccggauguguaccagagaggaguucacacggaaagugcgcuccaacgcugcccugggggcuaucuuuaccgacgagaauaaguggaaaagcgccagagaagcgguggaggauucucgguucugggaacuugucgaccgcgagagaaaccugcaucucgagggaaagugcgaaacguguguguacaauaugaugggcaaacgggagaagaagcugggcgaauuugggaaagccaagggaucccgcgcuauuugguauauguggcugggcgccagauuccucgaguuugaagcucugggguuccuuaacgaggaucacugguuuagccggggaaauucccugagcggcguugagggggaaggccuccauaaacugggauacauccuucgcgacgugucuaagaaagagggcggggccauguacgccgaugacaccgcgggaugggacacaagaauuacccuggaagaucucaagaacgaggaaauggucacaaaucacaugaagggcgagcauaaaaagcuggcugaggccaucuucaaacugaccuaucaaaacaaggugguucgggugcagcgcccuacgcccagagggacagucauggacauuaucagccggaaagaucagcgcggauccggccagguggggaccuacggccucaauacauucaccaacauggaagcccaacugaucagacagauggagggagaaggcauuuuuaagucuauccagcggcuuacgguuaccgaggagauugcugugcaaaauuggcuggccagagucgggcgcgaacggcucagcagaauggcuaucuccggagacgauugcguggucaagccgcuggacgaucgcuucgccucugcgcuuacagcccugaacgacaugggcaaagugcggaaggauauucagcagugggagccuagcagaggguggaaugacuggacccagguucccuuuugcucccaccacuuccaugaacucgugaugaaagauggacgcguccugguggugcccugucggaaccaagacgagcugaucggcagagcucgcaucucucagggggccggcuggagccucaaggaaacagcuugccugggaaaauccuaugcccagauguggacccuuauguacuuucaccggagagaucugcgccucgcggccaacgcuauuuguagcgccguuccuucucauugggugccgacaucccggaccacguggagcauccacgcuaagcacgaguggaugacaaccgaggacaugcuggccgucuggaauagaguguggauucaggaaaaccccuggauggaggacaagaccccuguugaaucuugggaggaagugcccuaucuuggcaaacgggaggaucaauggugcgggucccugaucggacucacaagcagagcuaccugggccaagaauauucagacagcgaucaaccagguccgcucccugauuggcaaugaggaauacacggacuauaugccuucuaugaaacgguucagaaaggaggaagaggaagccggggugcugugguga

SEQ ID NO: 19984 - RNA, 9876 nt, Artificial Sequence
  derived and/or modified CDS sequence (opt5) from DENV-2__EU482725__SS-prME
acagccggcgugaucauuaugcugauccccacagcuauggccuuccaccucacgacccggaauggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacaccggaugugugguuagcuggaagaauaaagaacugaagugcggcucugggauuuucaucacagauaacgugcacacguggaccgagcaguacaaguuucagccugaaucccccagcaaacuugccuccgcuauucaaaaggcccaugaggaaggcaucuguggaaucagaucugucacacgccuggagaaucucauguggaaacagauuaccccggagcugaaccacauccugagcgaaaaugaggugaaacuuacaauuaugaccggcgacaucaaagggauuaugcaggcuggaaagcggucccucagaccucagcccacggaacugaaauauucuuggaagaccuggggcaaggccaaaaugcugagcacagagucccauaaccaaaccuuccucaucgaugggccugaaacagcggagugccccaauaccaaccgcgccuggaauagccuggagguugaagacuacggauuuggcguguucucuacaaacaucuggcuuaagcugcgggagaaacaggacgucuuuugugauuccaagcucaugagcgcugccauuaaagacaauagagcugugcacgccgauaugggcuauuggaucgaaucugcgcugaacgacaccuggaagauggagaaggccuccuucauugagaucaaaagcugccacuggccuaagucucauacgcuguggagcaaugggguucuugaauccgagaugauuauccccaaaaacuucgcuggaccggugagccagcacaacuaccgcccuggcuaucauacacagaccgccgggcccuggcaccucggaaagcuggaaauggauuuugacuucugugagggcaccacagucguggugaccgaagauugcgggaaucggggacccucucugagaacgacaaccgcuuccggcaaacucauuacagaguggugcugucggagcugcacccugccuccgcuucgcuacagaggcgaggacggguguugguacggaauggaaauccggccccugaaggagaaggaagagaaccucgucaauucccugguuacagccggccaugggcaaaucgauaacuuuucucugggagugcuuggcauggcccucuuccuggaagagaugcugagaacccgcguggggacgaaacacgcuauucuccuggucgcggugagcuuuguuacccuuaucacaggaaauauguccuuccgggaccugggcagagugauggucauggugggcgccaccaugacagaugacauugggaugggaguuaccuaucucgcucugcuggccgccuuuaaggugcgcccuacguucgcugccggccuucugcucagaaaacugacaucuaaggagcucaugauggcgaccaucgggauugcucugcuuagccaguccacaauccccgaaaccauccuggagcucaccgaugcccuggcccugggaaugaugguccuuaaaauugugcggaacauggaaaaguaccagcuggcuguuacaaucauggccauuucuugcgugccuaaugcggucauccuccaaaacgcuuggaaggugagcuguacgauucuggccgccguguccgucagcccccuccugcuuaccucuucccagcagaaagcugacuggaucccucuggcccucacaaucaagggccugaaucccaccgcuauuuuucugacaacccuuagccgcacgucuaaaaagagauccuggccgcugaacgaggccguuauggcgguggggauggugagcauccucgccucuucccugcucaaaaaugacauuccuaugacaggaccccuggucgcuggcggccuucugaccgugugcuauguucugaccgggcggagcgccgaucucgaacuggagcgcgcugccgacgugaagugggaggaucaggccgaaaucuccggaagcucuccuauucuuagcaucacaauuuccgaggacggcucuaugagcaucaaaaacgaagaggaggaacacacccugacaauccucauuagaacggggcugcucgucaucuccggaguguuccccguuucuauuccgaucaccgcugcggccugguaccugugggaggugcggaagcaacgcgcuggcguccuuugggaugugccuucucccccucccgucgggaaggccgaacuggaggacggagccuauagaauuaaacagcggggcaucuuuggcuacucccagaucggggcuggaguguauaaggaaggcacauuccauaccauguggcacguuacacgcggggccgugcugaugcauagaggaaaacggauugagcccuccugggcggaugucaagaaagaccucaucagcuacggcgggggauggaagcuggagggcgaauggaaggagggcgaagaggugcagguucuugcucuggaaccugggaaaaauccgagagccgugcaaaccaagcccggacucuuuaaaacgaacaccggcacaauuggggccgucucccuggauuucagcccuggaaccucuggcucccccaucguggaccgcaaggggaaagugguuggacucuacggcaauggcgucgugacacggagcggggcuuaugugucugccauugcgcagaccgagaaguccaucgaggauaacccugaaaucgaggacgauauuuucagaaagaaacgccugacaaucauggaccuucaccccggagcuggcaagacgaaacgguaccugccugccauugucagagaagccaucaagcgcgggcugcggacccucauucuggcuccgacaagagugguugccgcugagauggaagaggcccuucgcggacugcccauccgguaucagaccccugcgauuagagccgagcauaccggccgggaaaucguggaccucaugugucacgcuacauuuacgaugcgccugcucagccccgucagagugccuaacuacaaucugaucauuauggaugaggcccacuucaccgaccccgcuuccaucgccgcccggggguauauuucuacacgcguugaaaugggcgaggcugcgggaaucuuuaugaccgccacaccgccuggcagcagagaucccuucccccaguccaacgcuccuauuauggacgaggaacgggagauccccgaaagaagcuggaacucugggcaugagugggugaccgauuuuaaaggaaagacggucugguucgugccuuccaucaaggccggcaacgacauugccgcuugccuucgcaaaaaugggaagaaaguuauccaacugagccggaagacauuugauucugaauacgugaaaaccagagccaacgacugggauuucgucgugaccacagacauuagcgagaugggagcgaauuuucgcgcugagcgggugaucgauccgagacgcuguaugaagcccgucauucugaccgacggcgaagaacggguuauccucgccgggccuaugcccgugacacacuccucugccgcucagagacgcggcagaaucggacggaacccuaagaaugaaaacgaccaguauauuuacaugggcgagccccuggaaaaugaugaggacugcgcccauuggaaagaggcgaagaugcuucuggauaacaucaauaccccggaagggauuaucccuagcauguucgagcccgaacgcgagaaaguggacgccauugauggagaauacagacuccggggcgaggcucgcaagacguuugucgaccugaugagaagaggggaucugccuguguggcucgccuauagaguugcugccgagggaaucaacuacgcugaccgccggugguguuucgauggcauuaaaaauaaccaaauccuugaagagaacguggaagucgagaucuggacaaaggagggggaacgcaagaagcugaagccccgcuggcuggacgcccggauuuauuccgauccucucgcgcugaaagaguucaaggaauuugccgcuggcagaaaaucucuuacccugaaucucaucacagagaugggacggcugcccaccuucaugacgcagaaggcccgcgacgcucuggauaaccucgccgugcuucacaccgccgaaguuggcgggagagcuuacaaucacgcgcugagcgagcugccggagacacucgaaacccugcuucugcucacacugcuggccaccgugacaggaggcauuuuucucuuccuuauguccgggaaaggaaucggcaagaugacccugggcaugugcugcauuaucacggcuagcauccugcucugguaugcccagauucagccucauuggaucgccgcuucuauuauccuggaguuuuuccuuauuguccugcucauccccgaacccgagaagcaacggacaccucaggacaaccagcugaccuacguggucaucgccauucugaccgugguugcggccacaauggcuaaugaaaugggguuucucgagaaaaccaagaaagaccuuggacugggcuccaucacaacgcaggagagcgaauccaacauucuggauaucgaccuccgcccggccucugcuuggacccuguaugccguggcgacaaccuucgugacacccaugcuuagacacagcauugaaaauagcucugucaacguuagccugaccgccaucgcuaaucaagccacggugcucauggggcugggacggggcuggccucuguccaagauggauauuggggugccccuccuugcuaucggauguuacagccaggucaacccuaucacccugacagccgcucugcuccugcuuguggcccauuacgcgauuaucggccccggccugcaggccaaagcuacccgcgaagcccagaagagaacagcugccgggauuaugaagaauccuaccguugacggaaucacggugauugaucucgagccgauccccuaugacccuaaauuugaaaagcaacugggccaggucaugcugcucgugcuuugcgucacacaggugcugaugaugcggaccacaugggcccugugugaggcgcucacccuggcuaccgggcccaucucuacacuuugggagggaaacccuggccgcuucuggaauacgaccauugccguuuccauggcuaacaucuuuagagggagcuaccuggccggagccggccuccuguucucuauuaugaaaaauacaaccaacacacggagaggcaccgggaauaucggagaaacgcugggcgagaaguggaaaucccagcucaacgcucuuggaaagagcgaauuucaaauuuauaagaaaucuggaauccaggagguggaucgcacacuggccaaggagggcaucaaaagaggggaaaccgaccaccaugcggucagcagaggauccgccaagcugcgcugguucguggagcggaacaugguuacccccgaaggcaaaguggucgaucucggcugcgggagaggaggcuggucuuacuauugugggggacugaagaaugugcgcgaggugaaaggccuuacaaaagggggaccgggccacgaggagccuauucccaugagcaccuacggcuggaaccugguucggcuccaguccggggucgacguguucuuuacacccccugagaagugcgauacgcugcugugugacaucggagaaagcucccccaauccuaccauugaggcuggcagaacacuccgcgugcuuaaccuggucgaaaauuggcugaacaauaacacccaauucugcguuaaagugcucaauccguauaugcccucugugaucgagaagauggaaacacugcagcggaaauacgggggagcccuugucagaaacccucugagccgcaauuccacccacgagauguacugggugucuaacgcuacgggcaauauuguuagcuccgugaacaugaucucucggaugcucaucaauagauuuaccaugaagcauaaaaaggccacauaugagcccgaugucgaccuggggagcggaacccgcaacauuggcaucgaaaacgagauuccuaaucuggacaucauuggcaagagaaucgagaagauuaagcaggagcacgaaacauccuggcauuacgaucaggaccaccccuauaaaaccugggcguaccacgggagcuaugagacaaagcaaaccggaucugccuccagcauggugaacggcguugugaaacuccuuacgaagccgugggaugucgugccuauggugacacagauggcuaugaccgacaccacacccuucgggcagcagcgggucuuuaaggagaaaguugauacgcgcacccaagaaccuaaggagggaaccaaaaagcugaugagaaucaccgccgaauggcuguggaaagagcucggcaagaagaaaacaccccggauguguaccagagaggaguucacacggaaggugcgcucuaaugcugcccugggggcuaucuuuaccgacgagaacaaauggaaguccgccagagaagcgguggaggauagccgguucugggaacuugucgaccgcgagagaaaucugcaucucgagggaaaaugcgaaacguguguguacaacaugaugggcaagcgggagaaaaagcugggcgaauuugggaaggccaaaggaucucgcgcuauuugguauauguggcugggcgccagauuccucgaguuugaagcucugggguuccuuaaugaggaucacugguuuucccggggaaacagccuguccggcguugagggggaaggccuccauaagcugggauacauccuucgcgacgugagcaaaaaggagggcggggccauguacgccgaugacaccgcgggaugggacacaagaauuacccuggaagaucucaaaaaugaggaaauggucacaaaccacaugaagggcgagcauaagaaacuggcugaggccaucuucaagcugaccuaucagaauaaagugguucgggugcagcgcccuacgcccagagggacagucauggacauuaucucucggaaggaucagcgcggaagcggccaaguggggaccuacggccucaacacauucaccaauauggaagcccagcugaucagacagauggagggagaaggcauuuuuaaauccauccaacggcuuacgguuaccgaggagauugcugugcagaacuggcuggccagagucgggcgcgaacggcucucuagaauggcuaucagcggagacgauugcguggucaagccgcuggacgaucgcuucgccuccgcgcuuacagcccugaaugacaugggcaaggugcggaaagauauucagcagugggagccuucuagaggguggaacgacuggacccaaguucccuuuugcagccaccacuuccaugaacucgugaugaaggauggacgcguccugguggugcccugucggaaccaggacgagcugaucggcagagcucgcaucucccagggggccggcuggucucucaaagaaacagcuugccugggaaagagcuaugcccagauguggacccuuauguacuuucaccggagagaucugcgccucgcggccaaugcuauuuguuccgccguuccuagccauugggugccgacaucucggaccacgugguccauccacgcuaaacacgaguggaugacaaccgaggacaugcuggccgucuggaacagaguguggauucaagaaaaucccuggauggaggacaagaccccuguugaaagcugggaggaagugcccuaucuuggcaagcgggaggaucaguggugcgggucucugaucggacucacauccagagcuaccugggccaaaaacauucagacagcgaucaaucagguccgcagccugauuggcaacgaggaauacacggacuauaugccuuccaugaagcgguucagaaaagaggaagaggaagccggggugcugugguga

SEQ ID NO: 19985 - RNA, 9876 nt, Artificial Sequence
  derived and/or modified CDS sequence (opt5) from DENV-2__EU482726__SS-prME
accgccggcgugaucguuaugcugauucccacaguuauggcuuuccaccucacgacccggaacggggagccucauaugaucgugggacggcaggaaaagggcaagucccugcuuuuuaagacagaggacggggugaauaugugcacccugauggccauugaucucggagaacugugugaggacacaaucaccuacaagugcccgcuucugcgccaaaacgaacccgaggauauugacuguuggugcaauuccacaucuaccugggucacguauggcaccuguacaaccacaggggagcaccggcgggaaaagcgcagcguggcgcucguuccucaugugggaaugggccuggagaccagaacggaaacauggauguccucugagggcgcuuggaagcacguccagcggaucgagaccuggauccugcgccaucccggguucacaauuauggccgccauccucgcuuacaccauuggaaccacacacuuucagagagcccugaucuucauucuucugacggcuguggccccuagcaugaccaugcggugcaucggcauuuccaaccgcgauuuuguugaaggggugucuggaggcagcugggucgacaucgugcucgagcacggguccugugugacaaccauggcgaagaauaagcccacacuggauuucgaacuuaucaagaccgaggccaagcagccugcuacgcugagaaaguauugcauugaagccaagcucacaaacaccaccacagagagccgguguccgacccaaggagagcccucucugaaugaagaacaggacaaacgcuuuaucugcaagcauuccauggucgauagaggcuggggcaacggguguggacuguucggcaaagggggcauuguuacaugcgcuauguuuacgugcaaaaagaauauggaaggcaaaaucgugcagccugagaaccucgaauacaccauugugaucacaccccacagcggggaggagcaugccgucggaaaugacaccggcaagcacggcaaagaaaucaagauuacaccucagucuuccaccacggaggcggaacugaccggguauggaacagugaccauggaguguagcccccggacaggccuugauuucaacgaaaugguucugcuccaaauggaggacaaagccuggcuggugcaccgccagugguuucuugaucugccgcucccuuggcugcccggggcugacacccagggaucuaauuggauccagaaggagacgcuggucacauucaagaacccucaugccaaaaagcaagacgugguugugcucggcucccaggaaggggcuaugcacaccgcccugacaggcgccaccgagauucagaugagcuccggaaaucuucuguuuaccggccaucucaaaugcagacugcggauggauaaacuucaacugaaagggaugucuuacagcauguguaucggaaaguucaagauugucaaagaaaucgcugagacacagcacggcacgaucgugauuagaguccaguaugagggggacggaucccccugcaagauccccuucgaaauuaccgaucucgagaaacgccaugugcugggccggcugaucacaguuaacccuauugugaccgaaaaggacgcgccggucaacaucgaggccgaacccccuuuuggggauagcuacauuaucgugggcguugagcccggacagcucaaacugaauugguucaagaagggaucuuccaucgggcaaauguuugagacaaccaugagaggagcuaaacgcauggccauucuuggcgacacggccugggauuucgggagccugggaggcguguuuacaucuaucgggaaggcucuccaccaggucuucggcgccauuuacggagcggcuuuuagcggcguguccuggaccaugaaaauccugauuggggugaucaucaccuggauuggaaugaacucucggagcacaucccugagcguuucucuuguccucgugggcguggucacccuguaucugggggccgugguucaggccgacuccggauguguggucagcuggaagaauaaagaacucaagugcggcucugggaucuucauuacagauaacgugcacacguggaccgagcaguacaaguuucaaccugaaucccccagcaaacuggcuuccgccauccagaaggcucaugaggaaggcauuuguggaaucagaucuguuacacgccuugagaaucugauguggaaacagaucaccccggagcucaaccacauucugagcgaaaaugaggugaagcugacaaucaugaccggcgacauuaaagggaucaugcaggccggaaagcggucccuuagaccucaacccacggaacucaaauauucuuggaagaccuggggcaaggcgaaaaugcugagcacagagucccauaaccagaccuuccugauugaugggccugaaacagccgagugccccaauaccaaccgcgcuuggaauagccucgaggucgaagacuacggauuuggcguguucacaaccaacaucuggcugaaacuucgggagaaacaggacgucuuuugugauucuaagcugauguccgccgcuaucaaagacaauagagccgugcacgcggauaugggcuauuggauugaaagcgcccucaacgacacguggaagauggagaaggcuucuuucaucgaggucaaauccugccacuggccuaagagccauacacuguggucuaauggggugcuggaaagcgagaugauuauccccaaaaacuucgccggaccggugucccagcacaacuaccgcccuggcuaucauacccaaaccgcugggcccuggcaccuuggaaagcucgaaauggauuuugacuucugugagggcacaaccgucguugugacggaagauugcgggaaucggggacccagccugagaacaaccacagccucuggcaaacugauuaccgaguggugcugucgguccugcacacucccuccgcugcgcuacagaggcgaggacggguguugguacggaauggaaauccggccccuuaaggagaaggaagagaaccuggugaauagccucgucaccgccggccaugggcagauugauaacuuuucccugggagugcugggcauggcucuuuuccucgaagagaugcugagaacgcgcguugggaccaaacacgcgacacugcucguggcccugucuuuugucacccuuaucacaggaaauaugagcuuccgggaccugggcagagugaugguuauggugggcgcuaccaugacggaugacaucgggaugggagucacauaucucgcccugcuggccgcuuuuaaggugcgcccuaccuucgccgcgggccuucugcucagaaaacugacauccaaggagcucaugauggcuaccauugggaucgcccugcuuucucagagcacccugcccgaaacaauucucgagcugacggaugcccuggcucuuggaaugaugguucugaaaaucgugcggaacauggaaaaguaccaacucgccgucaccauuauggcgaucuccugcgugccuaaugcugugauccugcagaacgccuggaaggucucuuguacaauucucgccgcuguuagcgugagcccccugcuucugaccagcucucagcagaaagccgacuggaucccucucgcucugacaauuaagggccugaaucccaccgccaucuuucuuacgacacugucccgcaccagcaaaaagagaucuuggccgcucaacgaggcgauuauggccguggggauggucuccauccuggcuagcucucuccugaaaaaugacaucccuaugaccggaccccuuguggccggcggccugcugacaguuugcuaugugcucaccgggcgguccgcugaucuggaacuugagcgcgccgccgacgucaagugggaggaucaagcugaaauuagcggauccagcccuauccugucuauuacaaucagcgaggacggcuccaugucuauuaaaaacgaagaggaggaacagacgcucaccauccugauuagaacagggcuccuggugaucagcggaguuuuccccguguccaucccgauuaccgcggccgcuugguaccuuugggaggucaagaagcagcgggccggcgugcugugggaugucccuucucccccucccguggggaaagccgaacuggaggacggagcuuaucgcaucaagcagagaggcauucucggcuacagccaaaucggggccggaguuuauaaagaaggcacauuucacaccauguggcaugugacgagaggggcgguccugaugcaccgcggaaagagaauugagcccuccugggcugaugugaaaaaggaccuuaucucuuacggcgggggauggaagcuggagggcgaauggaaagagggcgaagagguucaggugcucgcccuggaaccugggaagaauccgcgggccguccagaccaaacccggaaucuucaagacaaacaccggcacaauuggggcugugagccucgauuuuuccccuggaaccagcggcucucccaucguggacagaaaagggaagguugucggacuguacggcaauggcguggugacacgcuccggggccuaugucagcgcgauugcucagacggagaagucuaucgaggauaacccugaaauugaggacgauaucuuccggaaaaagagacuuaccaucauggaccugcaucccggagccggcaaaacaaagcgcuaccugccugccauugugcgggaagcuaucaaaagagggcuccgcacccugauucuugccccgacccggguuguggcugccgagauggaagaggcgcugagaggacuccccauccgcuaucaaaccccugccauucgggcugagcacacgggcagagaaaucgucgaccugaugugucaugccaccuucacaaugcggcuccugucccccgugcgcguuccuaacuacaaucuuauuaucauggaugaggcucacuuuaccgaccccgccagcaucgccgcuagaggguauauuuccacacggguggaaaugggcgaggcggccggaaucuucaugaccgcuacgccgccuggcucucgcgaucccuuuccccagagcaacgccccuauuauggacgaggaaagagagauccccgaacgguccuggaauagcgggcacgagugggucacagauuucaagggaaagaccgugugguuuguuccuucuauuaaagccggcaacgacaucgcugccugccugagaaagaaugggaaaaaggugauccagcugucccgcaaaaccuucgauagcgaauacgucaagacacgggcgaacgacugggauuuuguggugaccacagacauuucugagaugggagcuaauuucagagccgagcgcgucaucgauccgcggagauguaugaagcccguuauucucaccgacggcgaagaacgcgugauccuggccgggccuaugcccgugacgcauagcuccgcugcccaacggagaggccgcauuggaagaaacccuaaaaaugaaaacgaccaguauaucuacaugggcgagccccuugaaaaugaugaggacugcgcgcacuggaaggaggccaaaaugcugcucgauaacaucaauacaccggaagggauuaucccuucuauguuugagcccgaacgggagaaggucgacgcuauugauggagaauaccgccugagaggcgaggcccggaaaaccuucguggaccugaugcgcagaggggaucucccuguuuggcuugcuuaucggguggccgcugagggaaucaacuacgccgacagacgcugguguuuugauggcauuaagaauaaccagauccuggaagagaacgucgaaguggagauuuggacaaaagagggggaacggaagaagcugaaacccagauggcucgacgcgcgcaucuauagcgauccucuggcccuuaaggaguucaaagaguucgcugccggccggaagucccugacccucaaucugaucacggagaugggaagacugcccaccuuuaugacacagaaagcucgggacgcccucgauaaccuugccguucugcauaccgcugaagugggcgggcgcgcguacaaucacgcccugucugagcucccggagacacuggaaacccuucugcuccugacacugcucgcuaccgucacgggaggcauuuuccuuuuucugaugagcgggaagggaaucggcaagaugacacugggcaugugcugcauuaucaccgccuccauucuccugugguaugcccaaauccagccucacuggaucgcugccagcauuauccuugaguucuuucugauugugcuccugauccccgaacccgagaaacagagaaccccucaggacaaccaacugacauacgucgugauugcgauccucaccguuguggccgcuacaauggccaaugaaaugggguuccuugagaagacgaaaaaggaccugggacugggcucuaucaccacacaggaguccgaaagcaacauucucgauaucgaccugcggccggcuuccgccuggacccuuuaugcgguggccacaaccuuugucacgcccaugcugcgccauucuauugagaauagcuccguuaacgugucucucaccgcuaucgccaaucaggcuacagugcugauggggcugggaagaggcuggccucucagcaaaauggauauuggggucccccuucuggccaucggauguuacucccaggugaacccuauuacccugacagcugcccuccugcuucugguugcgcacuacgccaucaucggccccggccuccaagcuaaggccacccgggaagcucagaagcgcacggccgccgggauuaugaaaaauccuacaguggacggaaucaccgucauugaucuggagccgauccccuaugacccuaaguucgaaaaacagcugggccaggugaugcuccuuguccugugcgugacacaaguucugaugaugagaaccaccugggcgcucugugaggcucugacacuugccacggggcccauuagcacccugugggagggaaacccuggccgguuuuggaauacaaccaucgcugugucuauggccaacaucuuccgcggguccuaccucgccggagcuggccugcuguuuagcauuaugaagaauacaaccaacacgagacggggcacagggaauaucggagaaacccucggcgagaaauggaagucuagacuuaacgcccuggggaaguccgaguuccagauuuauaaaaagagcggaauccaggaggucgaucgcacccuggcgaaagagggcauuaagagaggggaaacagaccaucacgccgugucuagaggaagcgcuaaacuccgcugguuuguugagcggaacauggugacccccgaaggcaaggucguggaucugggcugcgggagaggaggcugguccuacuauugugggggacuuaaaaaugugcgcgagguuaagggccugacaaaaggcgggccggggcaugaagaaccuauccccaugucuacguacggcuggaaccucguccggcugcaaagcgggguggacguguucuucacacccccugagaaaugcgauacccugcucugugacaucggagaauccagccccaauccuaccauugaggccggcagaacacuucgcguccugaaccugguugaaaauuggcucaacaauaacacccaguuuugcaucaaggugcugaauccguauaugcccuccgugauugagaaaauggaaacgcuucagcggaaguacgggggagcucuggucagaaacccucucucucgcaauagcacccacgagauguacuggguguccaacgccacaggcaauaucguuucuagcgugaacaugauuucccggaugcugaucaauagauucaccaugaaacacaagaaggcgacauaugagcccgaugucgaccuggggucuggaacccgcaacaucggcauugaaagcgagaucccuaaccucgacauuaucggcaaaagaauugaaaagaucaaacaggagcaugaaacauccuggcacuacgaucaagaccaucccuauaagaccugggccuaccacgggagcuaugagacgaaacagacaggaucugcuuccagcauggugaauggcguugugaaacuucugaccaagccgugggaugucgugccuauggugacccagauggccaugacagacacgacccccuuugggcagcaacgggucuucaaagagaagguugauacacgcacccaggaaccuaaagagggaacaaagaaacugaugagaauuaccgcugaauggcucuggaaggagcugggcaagaaaaagacaccccggauguguaccagagaggaauuuacgcggaaagugcgcucuaacgccgcucuuggggccaucuucaccgacgagaauaaguggaaauccgcgagagaagccguggaggauagccgguuuugggaacuggucgaccgcgagagaaaccuccaccuggagggaaagugcgaaacauguguguacaauaugaugggcaaacgggagaagaagcugggcgaguucgggaaagcuaagggaucucgcgccaucugguauauguggcucggcgcuagauuucuggaguucgaagcccuuggguuucugaacgaggaucauugguucucccggggaaauagccucuccggcguugagggggaaggccugcaccgccuuggauacauucugagagaggugggcaaaaaggaagggggagccauguacgcggacgauaccgcuggcugggacacacggaucacccucgaggaccugaaaaacgaagagauggucacgaaucauaugaagggggagcacaagaaacuggccgaagccauuuuuaagcucacauaucagaacaaagugguucgcgugcagagaccuacaccccggggaacagucauggauaucauuagccgcaaggaccaaagaggcucuggacaggugggcaccuacggacugaauacguucaccaacauggaggcucagcuuauccggcaaauggaaggcgaggggaucuucaaaagcauucagcaucugacagccaccgaggaaaucgcuguucagaauuggcucgccagagugggacgcgagcggcuguccagaauggcgauuucuggcgaugacugcgucgugaagccgaucgaugaccgcuuugccagcgcucuuacagcccugaacgauauggggaagguccggaaagacauucagcaaugggaaccuuccagaggauggaaugauuggacccaggugcccuucugcucucaccacuuucaugagcucguuaugaaggacggccgcgugcuggucgugcccugucggaaccaggaugaacugaucgggagagcucgcaucagccagggcgccggauggucccucaaagagacagcgugccugggcaagucuuaugcccaaauguggacccuuauguacuuccaccggagagaccugcgccucgcugccaacgcuauuuguagcgccgugccuucccauuggguuccgacgagccggacaaccuggucuauccacgcuaaacacgaguggaugaccacagaagauaugcuggccguguggaauagagucuggauucaggagaaccccuggauggaagacaagaccccuguggaguccugggaagagguucccuaucuugggaagcgggaggaccaguggugcggaagccugaucggccucacaucuagagcgacgugggccaaaaauauucagaccgcuaucaaccaagugcgcucccugauugggaaugaagaguacacagauuauaugccuagcaugaagcgguuuagacgcgaagaggaagaggccggaguccugugguga

SEQ ID NO: 19986 - RNA, 9876 nt, Artificial Sequence
  derived and/or modified CDS sequence (opt5) from DENV-2__EU482727__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacaaacacugaccauccucaucagaacagggcugcucgugauuucuggaguuuuccccgugagcaucccgauuacggcugcggccugguaccugugggaggucaagaagcagcgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccacacaauguggcaugugaccagaggggccguccugaugcaccgcggaaagagaaucgagcccagcugggcggaugugaaaaaggaccucauuuccuacggcgggggauggaagcuggagggcgaauggaaagagggcgaagagguucaagugcuugcucuggaaccugggaagaauccgcgggccguccagacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaucccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcacaccggcagagaaauugucgaccucaugugucaugcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccaaagcaacgcuccuaucauggacgaggaaagagagauucccgaacggucuuggaacuccgggcacgagugggucacagauuuuaagggaaagaccgugugguucguuccuagcaucaaagccggcaacgacaucgccgcuugccuuagaaagaaugggaaaaaggugauucagcugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccauucuagcgccgcucagcggagaggccgcaucggaagaaacccuaaaaaugaaaacgaccaauauaucuacaugggcgagccccuggaaaaugaugaggacugcgccuacuggaaggaggcgaaaaugcuucuggauaacauuaauacaccggaagggaucauuccuuccauguucgagcccgaacgggagaaggucgacgccaucgauggagaauaucgccucagaggcgaggcucggaaaaccuuuguggaccugaugcgcagaggggaucugccuguuuggcucgccuaccggguggcugccgagggaauuaacuaugcugacagacgcugguguuucgauggcaucaagaauaaccagauucuugaagagaacgucgaaguggagaucuggacgaaagagggggaacggaagaagcugaaacccagauggcuggacgcccgcaucuacucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucacacggccgaagugggcgggcgcgcuuauaaucaugcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguacgcccagauccaaccucacuggauugccgcuuccaucauucuggaguuuuuccuuaucgugcugcucauucccgaacccgagaaacagagaacgccucaggacaaccagcugacauaugucgugaucgccauccugaccguuguggcggccaccauggcuaaugaaaugggguuucucgagaagaccaagaaggaccuuggacugggcagcauuaccacacaagaguccgaaucuaacauccuggauauugaccuccggccggccagcgcuuggacgcuguacgccguggcgaccacauucgucacccccaugcuucgccacuccaucgaaaauucuagcguuaacgugucccugacagccauugcuaaucaggccaccgugcucauggggcugggaagaggcuggccucugagcaaaauggauaucggggucccccuccuugcuauuggauguuacucucaggugaacccuaucacgcugaccgccgcucugcuccugcuuguugcccauuaugcgaucauuggccccggccugcaggccaaggcuacacgggaagcccaaaagcgcgcugccgccgggaucaugaaaaauccuaccguggacggaauuacagucaucgaucucgagccgauucccuacgacccuaaguuugaaaaacagcugggccaggugaugcugcucguccuuugcgugacccagguucugaugaugagaacgacaugggcgcugugugaggcucucacccuggccacagggcccaucuccacccuuugggagggaaacccuggccgguucuggaauaccacaaucgcugugagcauggccaacauuuuucgcgggucuuaucuggccggagcuggccuccuguucuccaucaugaagaauacgaccaacacaagacggggcaccgggaauauuggagaaacacugggcgagaaauggaaaagcagacucaacgcccuugggaagucugaauuucaaaucuacaaaaagagcggcauucaggaggucgaucgcacccuggcgaaagagggcaucaagagaggggaaacggaccaccaugccguguccagaggaucugcuaaacugcgcugguucguugagcggaacauggugacacccgaaggcaaggucguggaucucggcugcgggagaggaggcuggagcuauuacugugggggacugaaaaaugugcgcgagguuaagggccuuaccaaagggggaccgggccacgaggagccuauccccauguccaccuauggcuggaaccugguccggcuccagagcgggguggacguguucuuuacacccccugagaaaugcgauacccugcugugugacauuggagaauccucucccaauccuacaaucgaggccggcagaacgcuccgcguccuuaaccugguugaaaauuggcugaacaauaacacccaauucugcauuaaggugcucaauccguacaugcccagcgugaucgagaaaauggaaacacugcagcggaaguacgggggagcucuugucagaaacccucugucccgcaauucuacccaugagauguauugggugagcaacgccacaggcaauauuguuuccucugugaacaugaucagccggaugcucaucaauagauuuaccaugaaacacaagaaggcgacguacgagcccgaugucgaccugggguccggaacccgcaacauuggcaucgaaaacgagauuccuaaucuggacaucauuggcaaaagaaucgaaaagauuaaacaggagcacgaaacaagcuggcauuaugaucaggaccaccccuacaagaccugggccuaucaugggucuuacgagacaaaacaaaccggauccgcuagcucuauggugaacggcguugugcggcuccuuacaaagccgugggaugucgugccuauggugacccagauggccaugacggacacaacccccuucgggcagcagcgcgucuuuaaggagaaaguugauaccagaacacaagaaccuaaggagggaacgaaaaagcugaugcggaucaccgcugaauggcuguggaaagagcucggcaagaagaaaacacccagaauguguacccgggaggaguucacacgcaaggugagauccaaugccgcucugggggccaucuuuaccgacgagaacaaauggaaaagcgcgcgggaagccguggaggauucucgcuucugggaacuugucgacagagagcggaaucugcaccucgagggaaaaugcgaaacauguguguauaacaugaugggcaagcgcgagaaaaagcugggcgaauuugggaaggcuaaaggauccagagccauuugguacauguggcugggcgcucgguuccucgaguuugaagcccugggguuccuuaaugaggaucacugguuuagccgcagaaacucccugagcggaguugagggcgaagggcuccauaagcugggcuacauccuucgggacgugucuaaaaaggagggaggcgccauguaugcggaugacaccgcugggugggacacgcgcauuacccuggaagaucucaaaaaugaggaaauggucacaaaccacaugaagggagagcauaagaaacuggccgaggccaucuucaagcugaccuaccagaauaaagugguuagagugcagcggccuacaccccgcggcaccgucauggacauuaucagcagaaaggaucagcggggguccggacaagugggcacguaugggcucaacacauucaccaauauggaagcucagcugaucagacagauggagggcgaaggaauuuuuaaaucuauccaacgccuuacaguuaccgaggagauugccgugcagaacuggcuggcucgggucggcagagaacgccucagccggauggccaucuccggggacgauugcguggucaagccgcuggacgauagauucgcgucugcccuuacggcucugaaugacaugggaaaggugcgcaaagauauucagcagugggagccuagccggggcuggaacgacuggacccaaguucccuuuugcucccaccauuuccacgaacucgugaugaaggaugggagaguccugguggugcccugucgcaaccaggacgagcugaucggacgggccagaaucucucagggcgcuggguggagccucaaagaaacagccugccugggcaaguccuacgcgcagauguggacccuuauguauuuucaccgccgggaucugagacucgccgcuaaugccauuuguagcgcuguuccuucucauugggugccgacaucccggaccacauggagcauccacgccaaacaugaguggaugaccacggaggacaugcuggcugucuggaacagaguguggauucaagaaaaucccuggauggaggacaagacaccuguugaaucuugggaggaagugcccuaccuuggaaagcgcgaggaucaguggugcggcucccugaucgggcucaccagccgggccaccugggcgaaaaacauucagacagccaucaaucaggucagaucccugauuggaaacgaggaauauaccgacuacaugccuucuaugaagcgcuucagaaaagaggaagaggaagcuggcgugcugugguga

SEQ ID NO: 19987 - RNA, 9876 nt, Artificial Sequence
  derived and/or modified CDS sequence (opt5) from DENV-2__EU482728__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauucccugguggauagaggcuggggcaacggguguggacucuucggcaaagggggaaucgugacaugcgccauguuuacgugcaaaaagaauauggaaggcaaagucguucugccugagaaccuugaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccucgauuucaacgaaauggugcugcuucagauggaggacaaggcuuggcugguucaccgccaaugguuucucgaucugccgcugccuuggcuccccggggccgacacacagggaucuaauuggauucagaaggagacccuggugacguucaagaacccucaugcuaaaaagcaggacgucgugguucuuggcucccaagaaggggccaugcacacagcccugaccggcgcuacagagauccagaugagcuccggaaaucuccuguuuaccggccaucuuaaaugcagacugcggauggauaagcuccagcugaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccucggccggcugaucaccgugaacccuauuguuacagaaaaggacagcccggugaacaucgaggccgaacccccuuuuggggauucuuacauuaucaucggcgucgagcccggacagcuuaaacugaauugguucaagaagggcuccagcauugggcagauguuugagaccacaaugagaggagcuaaacgcauggccauccucggcgacaccgccugggauuucgggucucugggaggcguguuuacgagcauugggaaggcucugcaccaaguuuucggcgccaucuacggagcggcuuuuuccggcgugucuuggacaaugaaaauucuuaucggggucaucauuaccuggaucggaaugaacagccgguccaccagccucucugugucccuggugcugguuggcgucgugacacucuaucugggggugaugguccaggccgacagcggaugugugguuucuuggaagaauaaagaacuuaagugcggcuccgggauuuucaucaccgauaacgugcacacauggacggagcaguacaaguuucagccugaaagccccuccaaacuggccucugcuauucaaaaggcccaugaggaaggcaucuguggaaucagaagcgucacccgccucgagaaucugauguggaaacagauuacaccggagcugaaccacauccuuuccgaaaaugaggugaagcucaccauuaugacaggcgacaucaaagggauuaugcaggcuggaaagcggucucugagaccucagcccaccgaacugaaauauagcuggaagacguggggcaaggccaaaaugcucuccaccgagagccauaaccaaacauuccugaucgaugggccugaaaccgcggagugccccaauacaaaccgcgccuggaacucucuugagguugaagacuacggauuuggcguguucuccaccaacaucuggcugaagcuccgggagaaacaggacgucuuuugugauagcaagcugaugucugcugccauuaaagacaauagagcugugcacgccgauaugggcuauuggaucgaauccgcgcugaacgacacauggaagauggagaaggccagcuucauugagguuaaaucuugccacuggccuaagagccauacccuuugguccaauggggugcucgaaagcgagaugaucauucccaaaaacuucgcuggaccggucucucagcacaacuaccgcccuggcuaucauacgcagacagccgggcccuggcaccugggaaagcuggaaauggauuuugacuucugugagggcaccaccgugguggucacagaagauugcgggaaucggggacccucccucagaaccacgacagcuagcggcaaacugaucaccgaguggugcugucgguccugcacacuuccuccgcugcgcuacagaggcgaggacggguguugguacggaauggaaauucggccccucaaggagaaggaagagaaccugguuaauucucuggugaccgccggccaugggcaaaucgauaacuuuagccuuggagugcucggcauggcccuguuccuggaagagaugcucagaacacgcgucgggaccaaacacgcuauccugcuuguggcgguuuccuuugugacgcugauuaccggaaauaugucuuuccgggaccucggcagagucauggugaugguuggcgccacaaugaccgaugacaucgggaugggagugacauaucuggcucugcuugccgccuuuaagguccgcccuaccuucgcugccggccugcuccugagaaaacucacgagcaaggagcugaugauggcgacaauugggaucgcccuucugucccagucuaccauucccgaaacaauccucgagcugaccgaugcccuggcccuuggaaugauggugcugaaaaucguucggaacauggaaaaguaccagcucgcugugaccauuauggccaucagcugcgucccuaaugcggugauucugcaaaacgcuuggaagguguccuguacaauccucgccgccgucagcguuucuccccugcuucugacguccagccagcagaaagcugacuggauuccucucgcccugaccaucaagggccugaaucccacagcuaucuuucuuaccacacugucucgcaccuccaaaaagagaagcuggccgcucaacgaggccgugauggcgguggggauggucucuauucuggccuccagccuccugaaaaaugacaucccuaugacgggaccccuuguggcuggcggccugcugacaguuugcuaugugcucaccgggcgguccgccgaucuggaacuugagcgcgcugccgacgucaagugggaggaucaggccgaaauuagcggaucuagcccuauccuguccauuaccaucucugaggacggcagcauguccauuaaaaacgaagaggaggaacaaacacucaccauccugaucagaacagggcuccuggugauuucuggaguuuuccccgugagcaucccgauuacggcugcggccugguaccuuugggaggucaagaagcagcgggcuggcgugcugugggaugucccuucucccccucccguggggaaagccgaacuggaggacggagccuaucgcaucaagcagagaggcauuuuuggcuacagccagaucggggcuggaguuuauaaagaaggcaccuuccacacaauguggcaugugaccagaggggcuguccucaugcaccgcggaaagagaaucgagcccagcugggcggaugugaaaaaggaccugauuuccuacggcgggggauggaaacuugagggcgaauggaaagagggcgaagagguucaagugcuggcucucgaaccugggaagaauccgcgggccguccagacaaaacccggacuguuuaagaccaacacgggcaccaucggggccgugagccucgauuucucuccuggaacauccggcagccccauuguggacagaaaagggaagguugucggacuguacggcaauggcguggugacccgcucuggggcuuaugucuccgccaucgcgcagacagaaaagagcauugaggauaacccugaaaucgaggacgauaucuuccggaaaaagagacuuaccauuauggaccugcaucccggagcuggcaaaacaaagcgcuaccugccugccaucgugcgggaagccauuaaaagagggcuccgcacgcugauccuugcuccgacccggguuguggccgcugagauggaagaggcccugagaggacuccccauucgcuaucagaccccugcgauccgggccgagcacaccggcagagaaauugucgaccugaugugucaugcuaccuuuacaaugcggcuccugucccccgugcgcguuccuaacuacaaucuuaucaucauggaugaggcccacuucacggaccccgcuucuauugccgccagaggguauaucagcacccggguggaaaugggcgaggcugcgggaauuuuuaugacagccaccccgccuggcucccgcgaucccuucccccaaagcaacgcuccuaucauggacgaggaaagagagauucccgaacggucuuggaacuccgggcacgagugggucacagauuuuaagggaaagaccgugugguucguuccuagcaucaaagccggcaacgacaucgccgcuugccugagaaagaaugggaaaaaggugauucagcugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccucacagacggcgaggaacgcgugauucuggccgggccuaugcccgugacccauucuagcgccgcucagcggagaggccgcaucggaagaaacccuaaaaaugaaaacgaccaauauaucuacaugggcgagccccuugaaaaugaugaggacugcgcccacuggaaggaggcgaaaaugcugcucgauaacauuaauacaccggaagggaucauuccuuccauguucgagcccgaacgggagaaggucgacgccaucgauggagaauaccgccugagaggcgaggcucggaaaaccuuuguggaccugaugcgcagaggggaucucccuguuuggcuugccuaucggguggcugccgagggaauuaacuacgcugacagacgcugguguuucgauggcaucaagaauaaccagauucuggaagagaacgucgaaguggagaucuggacgaaagagggggaacggaagaagcugaaacccagauggcucgacgcccgcaucuauucugauccucuggcgcuuaaggaguucaaagaauuugccgcuggccggaagucccugacacucaaucugauuaccgagaugggaagacugcccacauucaugacccagaaagcccgggacgcucucgauaaccuugccguucugcauacggccgaagugggcgggcgcgcuuacaaucacgcgcuguccgagcucccggagacccuggaaacacuucugcuccugacccugcucgccacagucaccggaggcaucuuucuuuuccugaugagcgggaagggaauuggcaagaugacacugggcaugugcugcaucauuaccgcuucuauccuccugugguaugcccagauccaaccucacuggauugccgcuuccaucauucuugaguuuuuccugaucgugcuccugauucccgaacccgagaaacagagaacgccucaggacaaccagcugacauacgucgugaucgccauccucaccguuguggcggccaccauggcuaaugaaaugggguuucuugagaagaccaagaaggaccugggacugggcagcauuaccacacaagaguccgaaucuaacauccucgauauugaccugcggccggccagcgcuuggacgcuuuaugccguggcgaccacauucgucacccccaugcugcgccauuccaucgaaaauucuagcguuaacgugucccucacagccauugcuaaucaggccaccgugcugauggggcugggaagaggcuggccucucagcaaaauggauaucggggucccccuucuggcuauuggauguuacucucaggugaacccuaucacgcugaccgccgcucuccugcuucugguugcccacuacgcgaucauuggccccggccuccaggccaaggcuacacgggaagcccaaaagcgcgcugccgccgggaucaugaaaaauccuaccguggacggaauuacagucaucgaucuggagccgauucccuaugacccuaaguuugaaaaacagcugggccaggugaugcuccuuguccugugcgugacccagguucugaugaugagaacgacaugggcgcucugugaggcucugacccuugccacagggcccaucuccacccugugggagggaaacccuggccgguucuggaauaccacaaucgcugugagcauggccaacauuuuucgcgggucuuaccucgccggagcuggccugcuguucuccaucaugaagaauacgaccaacacaagacggggcaccgggaauauuggagaaacacucggcgagaaauggaaaagcagacuuaacgcccuggggaagucugaauuucaaaucuauaaaaagagcggcauucaggaggucgaucgcacccuggcgaaagagggcaucaagagaggggaaacggaccaucacgccguguccagaggaucugcuaaacuccgcugguucguugagcggaacauggugacacccgaaggcaaggucguggaucugggcugcgggagaggaggcuggagcuacuauugugggggacuuaaaaaugugcgcgagguuaagggccugaccaaagggggaccgggccaugaggagccuauccccauguccaccuacggcuggaaccucguccggcugcagagcgggguggacguguucuuuacacccccugagaaaugcgauacccugcucugugacauuggagaauccucucccaauccuacaaucgaggccggcagaacgcuucgcguccugaaccugguugaaaauuggcucaacaauaacacccaauucugcauuaaggugcugaauccguauaugcccagcgugaucgagaaaauggaaacacuucagcggaaguacgggggagcucuggucagaaacccucucucccgcaauucuacccacgagauguacugggugagcaacgccacaggcaauauuguuuccucugugaacaugaucagccggaugcugaucaauagauuuaccaugaaacacaagaaggcgacguaugagcccgaugucgaccugggguccggaacccgcaacauuggcaucgaaaacgagauuccuaaucucgacaucauuggcaaaagaaucgaaaagauuaaacaggagcaugaaacaagcuggcacuacgaucaggaccaucccuauaagaccugggccuaccacgggucuuaugagacaaaacaaaccggauccgcuagcucuauggugaacggcguugugcggcuucugacaaagccgugggaugucgugccuauggugacccagauggccaugacggacacaacccccuucgggcagcagcgcgucuuuaaggagaaaguugauaccagaacacaagaaccuaaggagggaacgaaaaagcugaugcggaucaccgcugaauggcucuggaaagagcugggcaagaagaaaacacccagaauguguacccgggaggaguucacacgcaaggugagauccaaugccgcucuuggggccaucuuuaccgacgagaacaaauggaaaagcgcgcgggaagccguggaggauucucgcuucugggaacuggucgacagagagcggaaucuccaccuggagggaaaaugcgaaacauguguguacaacaugaugggcaagcgcgagaaaaagcugggcgaauuugggaaggcuaaaggauccagagccauuugguauauguggcucggcgcucgguuccuggaguuugaagcccuuggguuccugaaugaggaucauugguuuagccgcggaaacucccucagcggcguugagggggaaggccugcacaaacuuggauacauccugagagacgugucuaaaaaggagggcggggccauguacgcggaugacaccgcuggaugggacacgcggauuacccucgaagaucugaaaaaugaggaaauggucacaaaccauaugaagggcgagcacaagaaacuggccgaggccaucuucaagcucaccuaucagaauaaagugguucgcgugcagagaccuacaccccgggggaccgucauggacauuaucagccgcaaggaucagagaggauccggccaaguggggacguacggccugaacacauucaccaauauggaagcucagcuuauccggcagauggagggagaaggcauuuuuaaaucuauccaaagacugacaguuaccgaggagauugccgugcagaacuggcucgcucgcgucgggcgggaaagacugagccgcauggccaucuccggagacgauugcguggucaagccgcuugacgaucgguucgcgucugcccugacggcucucaaugacaugggcaaggugagaaaagauauucagcagugggagccuagccgcggguggaacgacuggacccaaguucccuuuugcucccaucacuuccacgaacuggugaugaaggauggacggguccugguggugcccuguagaaaccaggacgagcucaucggccgcgcccggaucucucagggggcuggcuggagccugaaagaaacagccugccuuggaaaguccuaugcgcagauguggacccugauguacuuucauagacgcgaucuccggcuggccgcuaaugccauuuguagcgcuguuccuucucacugggugccgacauccagaaccacauggagcauccaugccaaacacgaguggaugaccacggaggacaugcuugcugucuggaaccggguguggauucaagaaaaucccuggauggaggacaagacaccuguugaaucuugggaggaagugcccuaucugggcaagagagaggaucaguggugcgggucccucaucggacugaccagccgcgccaccugggcgaaaaacauucagacagccaucaaucagguccggucccugauuggcaacgaggaauacaccgacuauaugccuucuaugaagagauuccgcaaagaggaagaggaagcuggggugcucugguga

SEQ ID NO: 19988 - RNA, 9876 nt, Artificial Sequence
  derived and/or modified CDS sequence (opt5) from DENV-2__EU482729__SS-prME
accgccggcgugaucauuaugcugauccccacagcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgaaaucaaagggauuaugcaggcuggaaagcggucucucagaccucagcccaccgagcugaaauauagcuggaagacguggggcaaggccaaaaugcuguccaccgaaagccauaaccaaacauuccucaucgacgggccugagaccgcggagugccccaauacaaaccgcgccuggaacucucuggaaguugaggauuacggauuuggcguguucuccaccaacaucuggcuuaagcugcgggaaaaacaggacgucuuuugugacagcaagcucaugucugcugccauuaaagauaauagagcugugcacgccgacaugggcuauuggaucgaguccgcgcugaacgauacauggaagauggagaaggccagcuucauugaaguuaaaucuugccacuggccuaagagccauacccugugguccaauggggugcuugagagcgaaaugaucauucccaaaaacuucgcuggaccggucucucagcacaacuaccgcccuggcuaucauacgcagaucgccgggcccuggcaccucggaaagcuggagauggacuuugauuucugugaaggcacaaccgugguggucaccgaggacugcgggaaucggggacccucccugagaacaaccacggcuagcggcaaacucauuacagaguggugcugucgguccugcacccugccuccgcuucgcuacagaggcgaagauggguguugguacggaauggagauccggccccugaaggaaaaggaggaaaaccucguuaauucucuggugacagccggccaugggcaaaucgacaacuuuagccugggagugcuuggcauggcccucuuccuggaggagaugcugagaacccgcgucgggacaaaacacgcuauucuccugaucgcgguguccuuuguuacccuuauuacgggaaauaugucuuuccgggaucugggcagagugauggucauggugggcgccaccaugacagacgauaucgggaugggaguuaccuaucucgcucugcuggccgccuuuaaggugcgcccuacauucgcugccggccuucugcucagaaaacugaccagcaaggaacucaugauggcgacgauugggaucgcucugcuuucccagucuacaauccccgagaccauucuggaacucacagacgcccuggcccugggaaugaugguccuuaaaaucgugcggaacauggagaaguaccagcuggcuguuaccauuauggccaucagcugcgugccuaaugcggucauucuccaaaacgcuuggaagguguccuguaccauccuggccgccgugagcgucucuccccuccugcuuacauccagccagcagaaagcugauuggaucccucuggcccucacgauuaagggccugaaucccaccgcuaucuuucugacaacccuuucucgcacauccaaaaagagaagcuggccgcugaacgaagccguuauggcgguggggauggugucuauucucgccuccagccugcucaaaaaugacaucccuaugaccggaccccuggucgcuggcggccuucugacggugugcuauguucugacagggcgguccgccgaccucgagcuggagcgcgcugccgaugugaagugggaagaccaggccgagauuagcggaucuagcccuauccuuuccauuaccaucucugaagauggcagcauguccaucaaaaacgaggaggaagaacaaacccugacaauucucaucagaaccgggcugcucgucauuucuggaguguuccccguuagcaucccgauuacagcugcggccugguaccugugggaagugaagaagcagcgggcuggcguccuuugggacgugccuucucccccucccgucgggaaagccgagcuggaagauggagccuaucgcaucaagcagagaggcaucuuuggcuacagccagauuggggcuggaguguauaaagagggcacguuccacaccauguggcauguuacaagaggggccgugcugaugcaccgcggaaagagaaucgagcccagcugggcggacgucaaaaaggaucucauuuccuacggcgggggauggaagcuggaaggcgaguggaaagaaggcgaggaagugcaaguucuugcucuggagccugggaagaauccgcgggccgugcagaccaaacccggacucuuuaagacaaacaccggcacgaucggggccgucagccuggacuucucuccuggaaccuccggcagccccauuguggauagaaaagggaaggugguuggacucuacggcaauggcgucgugacacgcucuggggcuuauguguccgccaucgcgcagaccgaaaagagcaucgaagacaacccugagauugaagaugacaucuuccggaaaaagagacugacaauuauggaucuucaucccggagcuggcaaaaccaagcgcuaccugccugccaucguccgggaggccauuaaaagagggcugcgcacacucauccuggcuccgacgcgggugguugccgcugaaauggaggaggcccuuagaggacugcccauucgcuaucagaccccugcgauccgggccgaacacacaggcagagagaucguggaccucaugugucaugcuaccuuuaccaugcggcugcucucccccguccgcgugccuaacuacaaucugauuaucauggacgaagcccacuucacagaucccgcuucuauugccgccagaggguauaucagcacgcggguugagaugggcgaggcugcgggaauuuuuaugaccgccacaccgccuggcucccgcgaccccuucccccaaagcaacgcuccuaucauggaugaagagagagaaauccccgagcggucuuggaacuccgggcacgaaugggugaccgacuuuaagggaaagacagucugguucgugccuagcauuaaagccggcaacgauaucgccgcuugccuuagaaagaaugggaaaaagguuauucagcugucucgcaaaaccuuugacagcgaguacgugaagacgcgggccaacgauugggacuucgucgugacaaccgauaucuccgagaugggagcgaauuuuagagcugaacgcgugauugacccgcggagauguaugaagcccgucauccugaccgauggcgaggaacgcguuauccucgccgggccuaugcccgugacacauucuagcgccgcucagcggagaggccgcauuggaagaaacccuaaaaaugagaacgaccaauauaucuacaugggcgaaccccuggagaaugacgaggauugcgccuacuggaaggaagcgaaaaugcuucuggacaacauuaauaccccggaggggaucauuccuuccauguucgaacccgagcgggaaaagguggaugccaucgacggagaguaucgccucagaggcgaggcucggaaaacauuugucgaucugaugcgcagaggggaccugccuguguggcucgccuaccggguugcugccgaaggaauuaacuaugcugauagacgcugguguuucgacggcaucaagaauaaccagauccuugaggaaaacguggaggucgagauuuggaccaaagaaggggagcggaagaagcugaaacccagauggcuggaugcccgcaucuacucugacccucucgcgcugaaggaguucaaagaguuugccgcuggccggaagucccuuacgcugaaucucauuacagaaaugggaagacugcccaccuucaugacacagaaagcccgggaugcucuggacaaccucgccgugcuucacaccgccgagguuggcgggcgcgcuuauaaucaugcgcuguccgagcugccggaaacgcucgagacccugcuucugcucacacugcuggccaccgugacaggaggcaucuuucucuuccuuaugagcgggaagggaauuggcaagaugacccugggcaugugcugcaucaucacagcuucuauucugcucugguacgcccagauccaaccucacuggauugccgcuuccaucauucuggaauuuuuccuuaucguccugcucauccccgagcccgaaaaacagagaaccccucaggauaaccagcugacguauguggucauugccauccugacagugguugcggccaccauggcuaaugagaugggguuucucgagaagaccaaaaaggaccuuggacugggcagcauuacaacccaagaauccgagucuaacauccuggacauugaucuccggccggccagcgcuuggacacuguacgccguggcgacgaccuucgugacacccaugcuucgccacuccaucgaaaauucuagcgucaacguuucccugaccgccauugcuaaucaggccacagugcucauggggcugggaagaggcuggccucugagcaaaauggacaucggggugccccuccuugcuaucggauguuacucucaggucaacccuauuacccugacggccgcucugcuccugcuuguggcccauuaugcgaucauuggccccggccugcaggccaaggcuacccgggaggcccaaaagcgcgcugccgccgggaucaugaaaaauccuacaguugauggaauuaccgugaucgaccucgaaccgauccccuacgauccuaaguuugagaaacagcugggccaggucaugcugcucgugcuuugcgucacacaggugcugaugaugagaaccacgugggcgcugugugaggcucucacacuggccaccgggcccauuuccacacuuugggaaggaaacccuggccgguucuggaauaccaccaucgcuguuagcauggccaacauuuuucgcgggucuuaucuggccggagcuggccuccuguucuccaucaugaagaauacaacgaacaccagacggggcacagggaauaccggagagacacugggcgaaaaauggaaaagcagacucaacgcccuugggaagucugaguuucaaauuuacaaaaagagcggaauccaggagguggaccgcacccuggcgaaagaaggcaucaagagaggggagacggaucaccaugccgucuccagaggaucugcuaaacugcgcugguucguggaacggaacaugguuacacccgagggcaagguggucgaccucggcugcgggagaggaggcuggagcuauuacugugggggacugaaaaaugugcgcgaagugaagggccuuaccaaagggggaccgggccacgaggagccuauucccauguccaccuauggcuggaaccugguucggcuccagagcggggucgauguguucuuuacacccccugaaaaaugcgacacccugcugugugauaucggagaguccucucccaauccuacaauugaagccggcagaacgcuccgcgugcuuaaccuggucgagaauuggcugaacaauaacacccaauucugcaucaagguucucaauccguacaugcccagcgugauugagaagauggagacacugcagcggaaguacgggggagcucuugugagaaacccucugucccgcaauucuacccaugagauguauugggucagcaacgccacaggcaauaucguguccucuguuaacaugaucagccggaugcucauuaauagauuuaccaugaaacacaagaaggcgacguacgaacccgacguggaucugggguccggaacccgcaacaucggcauugagaacgaaaucccuaaucuggacauuaucggcaaaagaauugagaagaucaaacaggaacacgagacaagcuggcauuaugaccaggaucaccccuacaagaccugggccuaucaugggucuuacgagacaaaacaaaccggauccgcuagcucuauggucaacggcgugguucggcuccuuacaaagccgugggacguggucccuauggugacccagauggccaugacggauacaacccccuucgggcagcagcgcguguuuaaggaaaaagucgacaccagaacacaagagccuaaggaaggaacgaaaaagcugaugcggaucaccgcugaguggcuguggaaagagcucggcaagaagaaaacacccagaauguguacccgggaagaguucacacgcaagguuagauccaaugccgcucugggggccauuuuuaccgaugaaaacaaauggaaaagcgcgcgggaggccguggaagacucucgcuucugggagcuuguggauagagagcggaaucugcaccucgaaggaaaaugcgagacaugugucuauaacaugaugggcaagcgcgagaagaagcugggcgaguuugggaaggcuaaaggauccagagccaucugguacauguggcugggcgcucgguuccucgaauuugaggcccugggguuccuuaaugaggaccacugguuuagccgcagaaacucccugagcggaguggaaggcgaggggcuccauaagcugggcuacauucuucgggauguuucuaaaaaggaaggaggcgccauguaugcggacgauaccgcugggugggacacgcgcaucacccuggaggaccucaaaaaugaagagauggugacaaaccacaugaagggagagcauaagaaacuggccgaagccauuuucaagcugaccuaccagaauaaagucgugagaguucagcggccuacaccccgcggcaccgugauggauaucaucagcagaaaggaccagcggggguccggacaagucggcacguaugggcucaacacauucaccaauauggaggcucagcugauuagacagauggaaggcgagggaaucuuuaaaucuauucaacgccuuacagugaccgaggaaaucgccguucagaacuggcuggcucgggugggcagagagcgccucagccggauggccauuuccggggaugacugcgucgugaagccgcuggaugacagauucgcgucugcccuuacggcucugaaugauaugggaaagguccgcaaagacauccagcagugggaaccuagccggggcuggaacgauuggacccaagugcccuuuugcucccaccauuuccacgagcucguuaugaaggacgggagagugcuggucgugcccugucgcaaccaggaugaacugaucggacgggccagaauuucucagggcgcuggguggagccucaaagagacagccugccugggcaaguccuacgcgcagauguggacccuuauguauuuucaccgccgggaccugagacucgccgcuaaugccaucuguagcgcugugccuucucauuggguuccgacaucccggaccacauggagcauucacgccaaacaugaguggaugaccacggaagauaugcuggcuguguggaacagagucuggauccaagagaaucccuggauggaagacaagacaccuguggagucuugggaagagguucccuaccuuggaaagcgcgaggaccaguggugcggcucccugauugggcucaccagccgggccaccugggcgaaaaacauccagacagccauuaaucaggugagaucccugaucggaaacgaagaguauaccgauuacaugccuucuaugaagcgcuucagaaaagaagaggaagaggcuggcguccugugguga

SEQ ID NO: 19989 - RNA, 9876 nt, Artificial Sequence
  derived and/or modified CDS sequence (opt5) from DENV-2__EU482731__SS-prME
accgccggcgugaucgucaugcugauucccacaguuauggcuuuccaccucacgacccggaacggggagccucauaugaucgugggacggcaggaaaagggcaagucccugcuuuuuaagacagaggacggggugaauaugugcacccugauggccauugaucucggagaacugugugaggacacaaucaccuacaagugcccgcuucugcgccaaaacgaacccgaggauauugacuguuggugcaauuccacaucuaccugggucacguauggcaccuguacaaccacaggggagcacagacgggaaaagcgcagcguggcgcucguuccucaugugggaaugggccuggagaccagaacggaaacauggauguccucugagggcgcuuggaagcacguccagcggaucgagaccuggauccugcgccaucccggguucacaauuauggccgccauccucgcuuacaccauuggaaccacacacuuucagagagcccugaucuucauucuucugacggcuguggccccuagcaugaccaugcggugcaucggcauuuccaaccgcgauuuuguugaaggggugucuggaggcagcugggucgacaucgugcucgagcacggguccugugugacaaccauggcgaagaauaagcccacacuggauuucgaacuuaucaagaccgaggccaagcagccugcuacgcugagaaaauauugcauugaagccaagcucacaaacaccaccacagagagccgguguccgacccaaggagagcccucucugaaugaagaacaggacaaacgcuuuaucugcaagcauuccauggucgauagaggcuggggcaacggguguggacuguucggcaaagggggcauuguuacaugcgcuauguuuacgugcaaaaagaauauggaaggcaaaaucgugcagccugagaaccucgaauacaccauugugaucacaccccacagcggggaggagcaugccgucggaaaugacaccggcaagcacggcaaagaaaucaagauuacaccucagucuuccaccacggaggcggaacugaccggguauggaacagugaccauggaguguagcccccggacaggccuugauuucaacgaaaugguucugcuccaaauggaggacaaagccuggcuggugcaccgccagugguuucuugaucugccgcucccuuggcugcccggggcugacacccagggaucuaauuggauccagaaggagacgcuggucacauucaagaacccucaugccaaaaagcaagacgugguugugcucggcucccaggaaggggcuaugcacaccgcccugacaggcgccaccgagauucagaugagcuccggaaaucuucuguuuaccggccaucucaaaugcagacugcggauggauaaacuucaacugaaagggaugucuuacagcauguguacaggaaaguucaagaucgucaaagaaauugcugagacgcagcacggcaccaucgugaucagaguccaguaugagggggacggaucccccugcaagauucccuucgaaaucacagaucucgagaaacgccaugugcugggccggcugauuaccguuaacccuaucgugacagaaaaggacgcgccggucaacauugaggccgaacccccuuuuggggauagcuacaucauugugggcguugagcccggacagcucaaacugaauugguucaagaagggaucuuccaucgggcaaauguuugagaccacgaugagaggagcuaaacgcauggccauccuuggcgacacagccugggauuucgggagccugggaggcguguuuaccucuauugggaaggcucuccaccaggucuucggcgccaucuacggagcggcuuuuagcggcguguccuggaccaugaaaauucugaucggggugauuaucacauggaucggaaugaacucucggagcaccucccugagcguuucucuuguccucgugggcguggucacacuguaucugggggccauggugcaggccgacuccggauguguugugagcuggaagaauaaagaacucaagugcggcucugggauuuucaucacggauaacguccacaccuggacagagcaguacaaguuucaaccugaaucccccagcaaacuggcuuccgccauucagaaggcucaugaggaaggcaucuguggaauuagaucugugacccgccuugagaaucugauguggaaacagaucacaccggagcucaaccacauccugagcgaaaaugagguuaagcugaccauuaugacgggcgacaucaaagggauuaugcaggccggaaagcggucccuuagaccucaacccaccgaacucaaauauucuuggaagacauggggcaaggcgaaaaugcugagcaccgagucccauaaccagacauuccugaucgaugggccugaaaccgccgagugccccaauacaaaccgcgcuuggaauagccucgagguggaagacuacggauuuggcgucuucaccacgaacauuuggcugaaacuucgggagaaacaggacguguuuugugauucuaagcugauguccgccgcuaucaaagacaauagagccguucacgcggauaugggcuauuggaucgaaagcgcccucaacgacacauggaagauggagaaggcuucuuucauugaggugaaauccugccacuggccuaagagccauacccuguggucuaaugggguccuggaaagcgagaugaucauucccaaaaacuucgccggaccggugucccagcacaacuaccgcccuggcuaucauacccaaacagcugggcccuggcaccuuggaaagcucgaaauggauuuugacuucugugagggcaccacgguggucguuacagaagauugcgggaaucggggacccagccugagaaccacaaccgccucuggcaaacugaucacagaguggugcugucgguccugcacccucccuccgcugcgcuacagaggcgaggacggguguugguacggaauggaaauucggccccuuaaggagaaggaagagaaccuggugaauagccucgugacggccggccaugggcagaucgauaacuuuucccugggaguccugggcauggcucuuuuccucgaagagaugcugagaacccgcguggggacaaaacacgcgacccugcucguugcccugucuuuugugacacuuauuaccggaaauaugagcuuccgggaccugggcagagucauggugaugguuggcgcuacgaugacagaugacaucgggaugggagugaccuaucucgcccugcuggccgcuuuuaagguccgcccuacauucgccgcgggccuucugcucagaaaacugaccuccaaggagcucaugauggcuaccaucgggauugcccugcuuucucagagcacacugcccgaaacgauccucgagcugaccgaugcccuggcucuuggaaugauggugcugaaaauuguucggaacauggaaaaguaccaacucgccgugacaaucauggcgauuuccugcgucccuaaugcugugauccugcagaacgccuggaaggugucuuguaccauccucgccgcugucagcguuagcccccugcuucugacaagcucucagcagaaagccgacuggauuccucucgcucugaccaucaagggccugaaucccacggccauuuuucuuacaacccugucccgcaccagcaaaaagagaucuuggccgcucaacgaggcgaucauggccguggggaugguguccauucuggcuagcucucuccugaaaaaugacaucccuaugacaggaccccuugucgccggcggccugcugaccgugugcuauguucucacagggcgguccgcugaucuggaacuugagcgcgccgccgacgugaagugggaggaucaagcugaaaucagcggauccagcccuauucugucuaucacgauuagcgaggacggcuccaugucuaucaaaaacgaagaggaggaacagacccucacaauucugaucagaaccgggcuccuggucauuagcggaguguuccccguuuccaucccgaucacagcggccgcuugguaccuuugggaggugaagaagcagcgggccggcguccugugggaugugccuucucccccucccgucgggaaagccgaacuggaggacggagcuuaucgcauuaagcagagaggcauccucggcuacagccaaauuggggccggaguguauaaagaaggcaccuuucacacgauguggcauguuaccagaggggcggugcugaugcaccgcggaaagagaaucgagcccuccugggcugaugucaaaaaggaccuuauuucuuacggcgggggauggaagcuggagggcgaauggaaagagggcgaagaggugcagguucucgcccuggaaccugggaagaauccgcgggccgugcagacaaaacccggaaucuucaagaccaacacaggcaccaucggggcugucagccucgauuuuuccccuggaacaagcggcucucccauuguggacagaaaagggaaggugguuggacuguacggcaauggcgucgugacgcgcuccggggccuaugugagcgcgaucgcucagaccgagaagucuauugaggauaacccugaaaucgaggacgauauuuuccggaaaaagagacuuacaaucauggaccugcaucccggagccggcaaaaccaagcgcuaccugccugccaucguccgggaagcuauuaaaagagggcuccgcacccugauccuugccccgacacgggugguugcugccgagauggaagaggcgcugagaggacuccccauucgcuaucaaacgccugccauccgggcugagcacaccggcagagaaauuguggaccugaugugucaugccacauucaccaugcggcuccugucccccguccgcgugccuaacuacaaucuuaucauuauggaugaggcucacuuuacagaccccgccagcaucgccgcuagaggguauaucuccacccggguugaaaugggcgaggcggccggaauuuucaugacggcuacaccgccuggcucucgcgaucccuuuccccagagcaacgccccuaucauugacgaggaaagagagauccccgaacgguccuggaauagcgggcacgagugggugaccgauuucaagggaaagaccgucugguuugugccuucuauuaaagccggcaacgacaucgcugccugccugagaaagaaugggaaaaagguuauccagcugucccgcaaaacauucgauagcgaauacgugaagacccgggcgaacgacugggauuuugucgugacaaccgacauuucugagaugggagcuaauuucaaggccgagagagugaucgauccgcgccgguguaugaaacccgucauucucacggacggcgaagagagaguuauccuggccgggccuaugcccgugacacauagcuccgcugcccaacgccggggcagaauuggacgcaacccuaagaaugaaaacgaccaguauaucuacaugggcgagccccuugaaaaugaugaggacugcgcgcacuggaaagaggccaagaugcugcucgauaacaucaauaccccggaagggauuaucccuucuauguuugagcccgaaagagagaaaguggacgcuauugauggagaauaccggcugcgcggcgaggccagaaagacauucgucgaccugaugcggcgcggggaucucccuguguggcuugcuuauaaaguugccgcugagggaaucaacuacgccgacagaaagugguguuuugauggcauuaagaauaaccagauccuggaagagaacguggaagucgagauuuggaccaaagagggggaacggaagaaacugaagcccagauggcucgacgcgcgcaucuauagcgauccucuggcccuuaaagaguucaaggaguucgcugccggccggaagucccugacgcucaaucugaucaccgagaugggaagacugcccacauuuaugacccagaaagcucgcaacgcccucgacaaucuugccgugcugcauacagcugaaguuggcgggcgggcgcacaaccacgcccugucugagcucccggagacccuggaaacacuucugcuccugacccugcucgcuacggugacaggaggcauuuuccuuuuucugaugagcgggaagggaaucggcaaaaugacccugggcaugugcugcauuaucaccgccuccauucuccugugguacgcccaaauccagccucauuggaucgcugccagcauuauccuugaguucuuucugauuguccuccugauccccgaacccgagaagcagagaacaccucaggauaaucaacugaccuauguggucauugcgauccucacagugguugccgcuacgauggccaacgaaaugggguuccuugagaaaaccaagaaggaccugggauuuggcucuaucacaacccaggaguccgaaagcaauauucuggacaucgaucuccggccggcuuccgccuggacacuguacgcgguggccaccacguucgugacccccaugcuucgccacucuauugagaacagcuccgucaauguuucucugacagcuaucgccaaccaggcuaccgugcucauggggcugggaaaaggcuggccucugagcaagauggacauuggggugccccuccuugccaucggauguuauucccaggucaauccuauuacacugaccgcugcccugcuccugcuuguggcgcauuacgccaucaucggccccggccugcaagcuaaagccacgagagaagcucagaagcgggccgccgcggggauuaugaaaaacccuacaguugauggaaucaccgugauugaccucgagccgauccccuacgauccuaaguuugaaaagcagcugggccaggucaugcugcucauucuuugcgugacacaaguccugaugaugcgcaccaccugggcucugugugaggcccucacacuggcuacggggcccaucagcacccuuugggagggaaauccuggcagauucuggaacacaaccaucgccgugucuauggccaauauuuuucggggguccuaucuggcuggagccggccuccuguucagcaucaugaaaaacacaaccaauacgcgcagaggcacagggaacguuggagaaacccugggcgagaaguggaaaucucggcucaacgcgcuugggaaguccgaauuucagauuuacaaaaagagcggaauccaggagguggaccgcacccuggccaaagagggcauuaagagaggggaaacagaucaccaugcugucucucggggaagcgccaagcugagaugguucguggagcgcaauaugguuacccccgaaggcaaaguggucgaccucggcugcgggcggggaggcugguccuauuacugugggggacugaagaacgugagagaggugaaaggccuuacaaaagggggaccgggccacgaagaaccuauccccaugucuacguauggcuggaaucugguucgccuccaaagcggggucgauguguucuuuacacccccugagaaaugcgacacccugcugugugauaucggagaauccagccccaacccuaccauugaggcuggccggacacucagagugcuuaaucuggucgaaaacuggcugaauaacaauacccaguucugcaucaagguucucaacccguacaugcccuccgugauugagaagauggaaacgcugcagcgcaaauaugggggagcccuugugcggaauccucugucuagaaacagcacccacgagauguacugggucuccaaugcgacaggcaacaucgugucuagcguuaauaugauuucccgcaugcucaucaaccgguuuaccaugaagcauaaaaaggccacauacgagcccgacguggaucuggggucuggaaccagaaacaucggcauugaaagcgagaucccuaaucuggacauuaucggcaaacgcauugaaaagaucaagcaggagcacgaaacauccuggcauuaugaccaagaucaccccuacaaaaccugggcuuaucacgggagcuacgagacgaagcagacaggaucugccuccagcauggucaacggcgugguucggcuccuuaccaaaccgugggacguggucccuauggugacccagauggcuaugacagauacgacccccuucgggcagcaaagaguguuuaaggagaaagucgacacacgcacccaggaaccuaaggagggaacaaagaaacugaugaagauuaccgccgaauggcuguggaaagagcucggcaagaaaaagacacccagaauguguacccgggaggaguucacgcgcaaaguuagaucuaaugcugcccugggggcgaucuuuaccgaugagaacaaguggaaguccgcccgggaagcuguggaggacggaagauucugggaacuuguggaucgggagcgcaaucugcaucucgagggcaaaugcgaaacaugugucuauaacaugaugggcaagagagagaaaaagcugggggaauuuggaaaagccaagggcagccgggcuaucugguacauguggcugggggcccgcuuccucgaguuugaagcccugggauuccuuaaugaggaccacugguuuucuagaggcaacucccugagcgggguggagggcgaaggacuccaucggcugggcuauauucuucgcgagguugggaagaaagaaggaggcgcgauguacgcugaugacaccgccgggugggauacaagaaucacccuggaggaccucaagaaugaagagauggugacgaaccacaugaaaggagagcauaagaaacuggccgaagcuauuuucaagcugacauaccagaauaaggucgugcggguucagcgcccuacccccagaggcacagugauggacaucauuucccggaaagaucaacgcgggagcggccaggucggaaccuauggccucaacacguucaccaauauggaggcccagcugaucagacaaauggaaggggagggaaucuuuaagucuauucagcaccuuacagcuaccgaggaaaucgccgugcagaacuggcuggcgcggguuggccgcgagagacucagccggauggccauuuccggggacgauugcguggucaaaccgaucgacgauagauucgcuucugcccugacagcucuuaaugacaugggaaaggugcgcaaagauauucagcaaugggaaccuagccggggcuggaacgacuggacccagguccccuuuugcucccaccauuuccacgagcuggugaugaaggaugggagaguucucgugguccccugucgcaaccaggacgaacugaucggccgggccagaaucucucagggagcgggcuggagccugaaggagacagccugccucgggaaauccuacgcucaaauguggacccugauguauuuucaucgccgggaucuuagacuggccgcuaaugccauuuguucugcugugccuagccacugggugccgacgucccgcacaaccuggagcauccacgccaagcaugaguggaugaccacagaagacaugcucgcgguuuggaaccggguguggauucaggagaaucccuggauggaagauaaaaccccugucgagucuugggaagaggugcccuaccugggaaagagagaggaccaguggugcggcucccuuaucgggcugacaagccgcgccacgugggcuaaaaacauucagaccgccaucaaucaaguucggucucucauuggaaacgaagaguauacagacuacaugccuuccaugaagagauuccggagagaagaggaagaggccggcgugcugugguga

SEQ ID NO: 19990 - RNA, 9876 nt, Artificial Sequence
  derived and/or modified CDS sequence (opt5) from DENV-2__EU482732__SS-prME
acagugggagucaucauuaugcugauccccacagccauggcuuuccaccucacgacacggaauggggagccucauaugauuguuggacggcaggaaaagggcaagagccugcuuuuuaagacagaggacggggugaauaugugcacccugauggccaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcgucgcgcucgugccucauguuggaaugggccuggagaccagaacggaaacauggauguccucugagggcgcuuggaagcacgugcagcggaucgagaccuggauucugcgccaucccggguucacaaucauggccgccauucucgcuuacaccaucggaaccacacacuuucagagagcccugauuuucauccuucugacggcugucgccccuagcaugaccaugcggugcauuggcaucuccaaccgcgauuuuguggaagggguuucuggaggcagcuggguggacaucguccucgagcacggguccugugugacaaccauggcgaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgucacaugcgcuauguuuacgugcaaaaagaauauggaaggcaaaguugugcucccugagaaccuggaauacaccauugugaucacaccccacagcggggaggagcaugccgucggaaaugacaccggcaagcacggcaaagaaaucaagauuacaccucagucuuccaucaccgaggcggaacuuacgggguauggaaccgugacaauggaguguagcccccggaccggccuggauuucaacgaaaugguucuccugcagauggaggacaaagccuggcuugugcaccgccaaugguuucuggaucucccgcugccuuggcugcccggggcugacacacagggaucuaauuggauucagaaggagacccucgucacguucaagaacccucaugccaaaaagcaggacgugguugugcugggcucccaagaaggggcuaugcacacagcccuuaccggcgccacagagauccagaugagcuccggaaaucugcucuuuaccggccaucugaaaugcagacuucggauggauaagcugcagcucaaagggaugucuuacagcauguguaccggaaaguucaagauugucaaagaaaucgcugagacacaacacggcacgaucgugauuagaguccaguaugagggggacggaucccccugcaagauccccuucgaaauuauggaucuggagaaacgccaugugcugggccggcucaucaccguuaacccuauugugacagaaaaggacagcccggucaacaucgaggcggaacccccuuuuggggauucuuacauuaucaucggcguggagcccggacagcugaaacuuaauugguucaagaagggcuccagcauugggcagauguuugagaccacaaugagaggagccaaacgcauggcuauccugggcgacaccgccugggauuucgggucucucggaggcgccuuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacacacacugaccauccucaucagaacagggcugcucgugauuucuggaguuuuccccgugagcaucccgauuacggcugcggccugguaccugugggaggucaagaagcaacgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccauacaauguggcacgugaccagaggggccguccugaugcaucgcggaaagagaaucgagcccagcugggcggaugugaaaaaggaccucauuuccuacggcgggggauggaagcuggagggcgaauggaaagagggcgaagagguucaggugcuugcucuggaaccugggaagaauccgcgggccguccaaacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaccccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcauaccggcagagaaauugucgaccucaugugucacgcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccagagcaacgcuccuaucauggacgaggaaagagagauucccgaacggucuuggaacuccgggcaugagugggucacagauuuuaagggaaagaccgugugguucguuccuagcaucaaagccggcaacgacaucgccgcuugccuuagaaagaaugggaaaaaggugauucaacugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccacucuagcgccgcucagcggagaggccgcaucggaagaaacccuaaaaaugaaaacgaccaguauaucuacaugggcgagccccuggaaaaugaugaggacugcgcccauuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccaaauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucacacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccagccucauuggauugccgcuuccaucauucuggaguuuuuccuuaucgugcugcucauucccgaacccgagaaacaaagaacgccucaggacaaccagcugacauacgucgugaucgccauccugaccguuguggcggccaccauggcuaaugaaaugggguuucucgagaagaccaagaaggaccuuggacugggcagcauuaccacacaggaguccgaaucuaacauccuggauauugaccuccggccggccagcgcuuggacgcuguaugccguggcgaccacauucgucacccccaugcuucgccacuccaucgaaaauucuagcguuaacgugucccugacagccauugcuaaucaagccaccgugcucauggggcugggaagaggcuggccucugagcaaaauggauaucggggucccccuccuugcuauuggauguuacucucaggugaacccuaucacgcugaccgccgcucugcuccugcuuguugcccauuacgcgaucauuggccccggccugcaggccaaggcuacacgggaagcccagaagcgcgcugccgccgggaucaugaaaaauccuaccguggacggaauuacagucaucgaucucgagccgauucccuaugacccuaaguuugaaaaacaacugggccaggugaugcugcucguccuuugcgugacccagguucugaugaugagaacgacaugggcgcugugugaggcucucacccuggccacagggcccaucuccacccuuugggagggaaacccuggccgguucuggaauaccacaaucgcugugagcauggccaacauuuuucgcgggucuuaccuggccggagcuggccuccuguucuccaucaugaagaauacgaccaacacaagacggggcaccgggaauauuggagaaacacugggcgagaaauggaaaagcagacucaacgcccuugggaagucugaauuucagaucuauaaaaagagcggcauucaagaggucgaucgcacccuggcgaaagagggcaucaagagaggggaaacggaccaccaugccguguccagaggaucugcuaaacugcgcugguucguugagcggaacauggugacacccgaaggcaaggucguggaucucggcugcgggagaggaggcuggagcuacuauugugggggacugaaaaaugugcgcgagguuaagggccuuaccaaagggggaccgggccacgaggagccuauccccauguccaccuacggcuggaaccugguccggcuccagagcgggguggacguguucuuuacacccccugagaaaugcgauacccugcugugugacauuggagaauccucucccaauccuacaaucgaggccggcagaacgcuccgcguccuuaaccugguugaaaauuggcugaacaauaacacccaguucugcauuaaggugcucaauccguauaugcccagcgugaucgagaaaauggaaacacugcaacggaaguacgggggagcucuugucagaaacccucugucccgcaauucuacccacgagauguacugggugagcaacgccacaggcaauauuguuuccucugugaacaugaucagccggaugcucaucaauagauuuaccaugaaacauaagaaggcgacguaugagcccgaugucgaccugggguccggaacccgcaacauuggcaucgaaaacgagauuccuaaucuggacaucauuggcaaaagaaucgaaaagauuaaacaggagcacgaaacaagcuggcauuacgaucaggaccaccccuauaagaccugggccuaccacgggucuuaugagacaaaacagaccggauccgcuagcucuauggugaacggcguugugaagcuccuuacaaagccgugggaugucgugccuauggugacccaaauggccaugacggacacaacccccuucgggcagcagcgggucuuuaaagagaagguugauacccgcacacaggaaccuaaagagggaacgaagaaacugaugagaaucaccgcugaauggcuguggaaggagcucggcaagaaaaagacaccccggauguguaccagagaggaguucacacggaaagugcgcuccaaugccgcucugggggccaucuuuaccgacgagaacaaguggaaaagcgcgagagaagccguggaggauucucgguucugggaacuugucgaccgcgagagaaaucugcaucucgagggaaagugcgaaacauguguguacaacaugaugggcaaacgggagaagaagcugggcgaauuugggaaagcuaagggaucccgcgccauuugguauauguggcugggcgcuagauuccucgaguuugaagcccugggguuccuuaaugaggaucacugguuuagccggggaaacucccugagcggcguugagggggaaggccuccauaaacugggauacauccuucgcgacgugucuaagaaagagggcggggccauguacgcggaugacaccgcuggaugggacacgagaauuacccuggaagaucucaagaaugaggaaauggucacaaaccacaugaagggcgagcauaaaaagcuggccgaggccaucuucaaacugaccuaucaaaauaaggugguucgggugcagcgcccuacacccagagggaccgucauggacauuaucagccggaaagaucagcgcggauccggccagguggggacguacggccucaacacauucaccaauauggaagcucaacugaucagacagauggagggagaaggcauuuuuaagucuauccagcggcuuacaguuaccgaggagauugccgugcaaaacuggcuggcuagagucgggcgcgaacggcucagcagaauggccaucuccggagacgauugcguggucaagccgcuggacgaucgcuucgcgucugcccuuacggcucugaaugacaugggcaaagugcggaaggauauucagcagugggagccuagcagaggguggaacgacuggacccagguucccuuuugcucccaccacuuccaugaacucgugaugaaagauggacgcguccugguggugcccugucggaaccaagacgagcugaucggcagagcccgcaucucucagggggcuggcuggagccucaaggaaacagccugccugggaaaauccuaugcgcagauguggacccuuauguacuuucaccggagagaucugcgccucgccgcuaaugccauuuguagcgcuguuccuucucauugggugccgacaucccggaccacauggagcauccacgccaagcacgaguggaugaccacggaggacaugcuggcugucuggaacagaguguggauucaggaaaaucccuggauggaggacaagacaccuguugaaucuugggaggaagugcccuaucuuggcaaacgggaggaucaauggugcgggucccugaucggacucaccagcagagccaccugggcgaagaacauucagacagccaucaaucagguccgcucccugauuggcaacgaggaauacaccgacuauaugccuucuaugaaacgguucagaaaggaggaagaggaagcuggggugcugugguga

SEQ ID NO: 19991 - RNA, 9876 nt, Artificial Sequence
  derived and/or modified CDS sequence (opt5) from DENV-2__EU482733__SS-prME
acagccggagugaucauuaugcugauccccacagcuauggccuuccaccucacgacacggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaacauggaaaaguaccagcuggcugugaccauuauggccaucagcugcgucccuaaugcggugauucuccaaaacgcuuggaagguguccuguacaauccuggccgccgucagcguuucuccccuccugcuuacguccagccagcagaaagcugacuggauuccucuggcccucaccaucaagggccugaaucccacagcuaucuuucugaccacacuuucucgcaccuccaaaaagagaagcuggccgcugaacgaggccgugauggcgguggggauggucucuauucucgccuccagccugcucaaaaaugacaucccuaugacgggaccccugguggcuggcggccuucugacaguuugcuaugugcugaccgggcgguccgccgaucucgaacuggagcgcgcugccgacgucaagugggaggaucaggccgaaauuagcggaucuagcccuauccuuuccauuaccaucucugaggacggcagcauguccauuaaaaacgaagaggaggaacaaacacugaccauccucaucagaacagggcugcucgugauuucuggaguuuuccccgugagcaucccgauuacggcugcggccugguaccugugggaggucaagaagcagcgggcuggcgugcuuugggaugucccuucucccccucccguggggaaagccgaacuggaggacggagccuaucgcaucaagcagagaggcauuuuuggcuacagccagaucggggcuggaguuuauaaagaaggcaccuuccacacaauguggcaugugaccagaggggccguccugaugcaccgcggaaagagaaucgagcccagcugggcggaugugaaaaaggaccucauuuccuacggcgggggauggaagcuggagggcgaauggaaagagggcgaagagguucaagugcuugcucuggaaccugggaagaauccgcgggccguccagacaaaacccggacucuuuaagaccaacacgggcaccaucggggccgugagccuggauuucucuccuggaacauccggcagccccauuguggacagaaaagggaagguugucggacucuacggcaauggcguggugacccgcucuggggcuuaugucuccgccaucgcgcagacagaaaagagcauugaggauaacccugaaaucgaggacgauaucuuccggaaaaagagacugaccauuauggaccuucaucccggagcuggcaaaacaaagcgcuaccugccugccaucgugcgggaagccauuaaaagagggcugcgcacgcucauccuggcuccgacccggguuguggccgcugagauggaagaggcccuuagaggacugcccauucgcuaucagaccccugcgauccgggccgagcacaccggcagagaaauugucgaccucaugugucaugcuaccuuuacaaugcggcugcucucccccgugcgcguuccuaacuacaaucugaucaucauggaugaggcccacuucacggaccccgcuucuauugccgccagaggguauaucagcacccggguggaaaugggcgaggcugcgggaauuuuuaugacagccaccccgccuggcucccgcgaucccuucccccaaagcaacgcuccuaucauggacgaggaaagagagauucccgaacggucuuggaacuccgggcacgagugggucacagauuuuaagggaaagaccgugugguucguuccuagcaucaaagccggcaacgacaucgccgcuugccuuagaaagaaugggaaaaaggugauucagcugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccugacagacggcgaggaacgcgugauucucgccgggccuaugcccgugacccauucuagcgccgcucagcggagaggccgcaucggaagaaacccuaaaaaugaaaacgaccaauauaucuacaugggcgagccccuggaaaaugaugaggacugcgcccacuggaaggaggcgaaaaugcuucuggauaacauuaauacaccggaagggaucauuccuuccauguucgagcccgaacgggagaaggucgacgccaucgauggagaauaccgccucagaggcgaggcucggaaaaccuuuguggaccugaugcgcagaggggaucugccuguuuggcucgccuaucggguggcugccgagggaauuaacuacgcugacagacgcugguguuucgauggcaucaagaauaaccagauucuugaagagaacgucgaaguggagaucuggacgaaagagggggaacggaagaagcugaaacccagauggcuggacgcccgcaucuauucugauccucucgcgcugaaggaguucaaagaauuugccgcuggccggaagucccuuacacugaaucucauuaccgagaugggaagacugcccacauucaugacccagaaagcccgggacgcucuggauaaccucgccguucuucauacggccgaagugggcgggcgcgcuuacaaucacgcgcuguccgagcugccggagacccucgaaacacugcuucugcucacccugcuggccacagucaccggaggcaucuuucucuuccuuaugagcgggaagggaauuggcaagaugacacugggcaugugcugcaucauuaccgcuucuauccugcucugguaugcccagauccaaccucacuggauugccgcuuccaucauucuggaguuuuuccuuaucgugcugcucauucccgaacccgagaaacagagaacgccucaggacaaccagcugacauacgucgugaucgccauccugaccguuguggcggccaccauggcuaaugaaaugggguuucucgagaagaccaagaaggaccuuggacugggcagcauuaccacacaagaguccgaaucuaacauccuggauauugaccuccggccggccagcgcuuggacgcuguaugccguggcgaccacauucgucacccccaugcuucgccauuccaucgaaaauucuagcguuaacgugucccugacagccauugcuaaucaggccaccgugcucauggggcugggaagaggcuggccucugagcaaaauggauaucggggucccccuccuugcuauuggauguuacucucaggugaacccuaucacgcugaccgccgcucugcuccugcuuguugcccacuacgcgaucauuggccccggccugcaggccaaggcuacacgggaagcccaaaagcgcgcugccgccgggaucaugaaaaauccuaccguggacggaauuacagucaucgaucucgagccgauucccuaugacccuaaguuugaaaaacagcugggccaggugaugcugcucguccuuugcgugacccagguucugaugaugagaacgacaugggcgcugugugaggcucucacccuggccacagggcccaucuccacccuuugggagggaaacccuggccgguucuggaauaccacaaucgcugugagcauggccaacauuuuucgcgggucuuaccuggccggagcuggccuccuguucuccaucaugaagaauacgaccaacacaagacggggcaccgggaauauuggagaaacacugggcgagaaauggaaaagcagacucaacgcccuugggaagucugaauuucaaaucuauaaaaagagcggcauucaggaggucgaucgcacccuggcgaaagagggcaucaagagaggggaaacggaccaucacgccguguccagaggaucugcuaaacugcgcugguucguugagcggaacauggugacacccgaaggcaaggucguggaucucggcugcgggagaggaggcuggagcuacuauugugggggacugaaaaaugugcgcgagguuaagggccuuaccaaagggggaccgggccaugaggagccuauccccauguccaccuacggcuggaaccugguccggcuccagagcgggguggacguguucuuuacacccccugagaaaugcgauacccugcugugugacauuggagaauccucucccaauccuacaaucgaggccggcagaacgcuccgcguccuuaaccugguugaaaauuggcugaacaauaacacccaauucugcauuaaggugcucaauccguauaugcccagcgugaucgagaaaauggaaacacugcagcggaaguacgggggagcucuugucagaaacccucugucccgcaauucuacccacgagauguacugggugagcaacgccacaggcaauauuguuuccucugugaacaugaucagccggaugcucaucaauagauuuaccaugaaacacaagaaggcgacguaugagcccgaugucgaccugggguccggaacccgcaacauuggcaucgaaaacgagauuccuaaucuggacaucauuggcaaaagaaucgaaaagauuaaacaggagcaugaaacaagcuggcacuacgaucaggaccaucccuauaagaccugggccuaccacgggucuuaugagacaaaacaaaccggauccgcuagcucuauggugaacggcguugugcggcuccuuacaaagccgugggaugucgugccuauggugacccagauggccaugacggacacaacccccuucgggcagcagcgcgucuuuaaggagaaaguugauaccagaacacaagaaccuaaggagggaacgaaaaagcugaugcggaucaccgcugaauggcuguggaaagagcucggcaagaagaaaacacccagaauguguacccgggaggaguucacacgcaaggugagauccaaugccgcucugggggccaucuuuaccgacgagaacaaauggaaaagcgcgcgggaagccguggaggauucucgcuucugggaacuugucgacagagagcggaaucugcaccucgagggaaaaugcgaaacauguguguacaacaugaugggcaagcgcgagaaaaagcugggcgaauuugggaaggcuaaaggauccagagccauuugguauauguggcugggcgcucgguuccucgaguuugaagcccugggguuccuuaaugaggaucauugguuuagccgcggaaacucccugagcggcguugagggggaaggccuccacaagcugggauacauccuuagagacgugucuaaaaaggagggcggggccauguacgcggaugacaccgcuggaugggacacgcggauuacccuggaagaucucaaaaaugaggaaauggucacaaaccauaugaagggcgagcacaagaaacuggccgaggccaucuucaagcugaccuaucagaauaaagugguucgcgugcagagaccuacaccccgggggaccgucauggacauuaucagccgcaaggaucagagaggauccggccaaguggggacguacggccucaacacauucaccaauauggaagcucagcugauccggcagauggagggagaaggcauuuuuaaaucuauccaaagacuuacaguuaccgaggagauugccgugcagaacuggcuggcucgcgucgggcgggaaagacucagccgcauggccaucuccggagacgauugcguggucaagccgcuggacgaucgguucgcgucugcccuuacggcucugaaugacaugggcaaggugagaaaagauauucagcagugggagccuagccgcggguggaacgacuggacccaaguucccuuuugcucccaucacuuccacgaacucgugaugaaggauggacggguccugguggugcccuguagaaaccaggacgagcugaucggccgcgcccggaucucucagggggcuggcuggagccucaaagaaacagccugccugggaaaguccuaugcgcagauguggacccuuauguacuuucauagacgcgaucugcggcucgccgcuaaugccauuuguagcgcuguuccuucucacugggugccgacauccagaaccacauggagcauccaugccaaacacgaguggaugaccacggaggacaugcuggcugucuggaaccggguguggauucaagaaaaucccuggauggaggacaagacaccuguugaaucuugggaggaagugcccuaucuuggcaagagagaggaucaguggugcgggucccugaucggacucaccagccgcgccaccugggcgaaaaacauucagacagccaucaaucagguccggucccugauuggcaacgaggaauacaccgacuauaugccuucuaugaagagauuccgcaaagaggaagaggaagcuggggugcugugguga

SEQ ID NO: 19992 - RNA, 9876 nt, Artificial Sequence
  derived and/or modified CDS sequence (opt5) from DENV-2__EU482734__SS-prME
accgccggagugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauuaugaucacaccccacagcggggaggagcaugcggugggaaaugacaccggcaagcacggcaaagaaaucaagauuacaccucagucuuccaucaccgaggccgaacugacgggguauggaaccgugacaauggaguguagcccccggaccggccuugauuucaacgaaaugguccugcuccaaauggaggacaaggcuuggcuggugcaccgccagugguuucuugaucugccgcucccuuggcugcccggggccgacacacagggaucuaauuggauucagaaggagacccugguuacguucaagaacccucaugcuaaaaagcaagacguggucgugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauuguuaaagaaaucgcggagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcguggggaaggcucuccaccagguuuucggcgccauuuacggagcggcuuuuuccggcgugucuuggacaaugaaaauccugauuggggucaucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacaggcgacauuaaagggaucaugcaggccggaaagcggucucuuagaccucaacccaccgaacucaaauauagcuggaagacguggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacaaacaucuggcugaaacuucgggagaaacaggacguguuuugugauuccaagcugaugagcgccgcuaucaaagacaauagagccguccacgcggauaugggcuauuggauugaaucugcccucaacgacaccuggaagauggagaaggcuuccuucaucgaggugaaaagcugccacuggccuaagucucauacgcuguggagcaaugggguucuggaauccgagaugauuauccccaaaaacuucgccggaccggugagccagcacaacuaccgcccuggcuaucauacacaaaccgcugggcccuggcaccuuggaaagcucgaaauggauuuugacuucugugagggcaccacagucguggugaccgaagauugcgggaaucggggacccucucugagaacgacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacagccggccaugggcagauugauaacuuuucucugggagugcugggcauggcucuuuuccucgaagagaugcugagaacccgcguggggacgaaacacgcgauccugcucgucgccgugagcuuuguuacccugaucacaggaaauauguccuuccgggaccuuggcagagugauggucauggugggcgcuaccaugacagaugacauugggaugggaguuaccuaucuggcccuccuggccgcuuuuaaggugcgcccuacguucgccgcgggccugcuucugagaaaacucacaucuaaggagcugaugauggcuaccaucgggauugcccuccugagccaguccacaauccccgaaaccauucuugagcugaccgaugcccucgcucugggaaugauggcccugaaaaucgucaagaacauggaaaaguaccaacuugcggugacaaucauggcuauuucuugcguuccuaaugccgugauccugcagaacgccuggaaagucagcuguacgauucucgcugccguguccgugagcccccugcuccugaccucuucccagcagaaggcugacuggaucccucuugcccugacaauuaaaggccucaaucccaccgcgaucuuucugacaacccugagccggacgucuaagaaacgcuccuggccgcuuaacgaggccaucauggcugucgggaugguuagcauucuggccucuucccuccugaagaaugacaucccuaugacaggaccccucguggcuggcggccugcuuaccgugugcuauguccugaccgggagaagcgccgaucuggaacucgagcgggccgcugacgugaaaugggaggaucaagcggaaauuuccggaagcucuccuauccugagcauuacaaucuccgaggacggcucuaugagcauucgcaacgaagaggaggaacagacccuuacaauccugaucagaacggggcuccugguuauuuccggaguguuccccgucucuaucccggugaccgccgcugccugguaccucugggagguuaagaagcagcgggccggcgugcugugggaugucccuucucccccucccguggggaaagcugaacuugaggacggagccuaucgcauuaagcagagaggcauccugggcuacucccaaauuggggcgggagucuauaaagaaggcacauuucacaccauguggcaugugacaagaggggcuguucugaugcaccgcggaaagagaaucgagcccuccugggccgaugugaaaaaggaccucgucagcuacggcgggggauggaagcuggagggcgaauggaaagagggcgaagaggugcagguucuugcccuggaaccugggaagaauccgcgggcugugcagaccaaacccggaaucuucaagacgaacaccggcacaauuggggccgucucccucgauuuuagcccuggaaccucuggcucccccaucguggacagaaaagggaaggugguuggacuguacggcaauggcgucgugacacgcagcggggcguaugugucugcuauugcccagaccgagaaguccaucgaggauaacccugaaauugaggacgauaucuuccggaaaaagagacucacaaucauggaccugcaucccggagccggcaaaacgaagcgcuaccuuccugcuauuguccgggaagccaucaaaagagggcugcgcacccugauucucgcuccgacacgggugguugccgcggagauggaagaggcccugagaggacuucccauccgcuaucaaaccccugcuauucgggccgagcacaccggcagagaaaucguggaccugaugugucaugcuacauucacgaugcggcuccugagccccguccgcgugccuaacuacaaucucauuaucauggaugaggcccacuuuaccgaccccgccuccaucgcugcgagaggguauauuucuacacggguugaaaugggcgaggccgcuggaaucuucaugaccgccacaccgccuggcagccgcgaucccuuuccccaguccaacgccccuauuauggacgaggaaagagagauccccgaacggagcuggaacucugggcacgagugggugaccgauuucaagggaaagacggucugguuugugccuuccauuaaagcuggcaacgacaucgccgcgugccugagaaagaaugggaaaaagguuauccagcuuagccgcaaaacauucgauucugaauacgugaagacccgggcuaacgacugggauuuugucgugaccacagacauuagcgagaugggagccaauuucaaggccgagagagugaucgauccgcgccgguguaugaaacccgucauucugaccgacggcgaagagagaguuauccuggcugggccuaugcccgugacacauuccucugccgcgcaacgccggggcagaauuggacgcaacccuaagaaugaaaacgaccaguauaucuacaugggcgagccccucgaaaaugaugaggacugcgcccacuggaaagaggcuaagaugcugcuugauaacaucaauaccccggaagggauuaucccuagcauguuugagcccgaaagagagaaaguggacgccauugauggagaauaccggcugcgcggcgaggcuagaaagacguucgucgaccucaugcggcgcggggaucugccuguguggcuggccuauaaaguugcugccgagggaaucaacuacgcggacagacggugguguuuugauggcauuaagaauaaccagauccucgaagagaacguggaagucgagauuuggacaaaggagggggaacgcaagaaacuuaaaccccgcuggcuggacgcccggaucuauuccgauccucuggcucucaaggaguucaaagaguucgccgcuggcagaaagucucugacccuuaaucugaucacagagaugggacgccuccccaccuuuaugacgcagaaggcccggaacgcccuggacaaucuggcugugcuccauaccgcggaagccggcgggaaggcuuacaaccacgcccuuagcgagcugccggagacacuggaaacccuccugcuucugacacuccuggccaccguuacaggaggcauuuuccuguuucucauguccgggaagggaaucggcaaaaugacccuuggcaugugcugcauuaucacggcuagcauucugcugugguaugcccaaauccagccucacuggaucgcggccucuauuauccucgaguucuuucugauugugcuucugauccccgaacccgagaagcagagaacaccucaggauaaucaacucaccuacgucgugauugcuauccugaccgucguggccgcuacaauggccaacgaaaugggguuccuggagaaaaccaagaaggaccucggacuuggcuccaucacaacgcaggagagcgaauccaauauucuggacaucgaucugcggccggcgucugccuggacccucuaugcuguugccacaaccuuugugacacccaugcugcgccauagcauugagaacuccucugugaaugucagccuuaccgcuaucgccaaccaggcuacgguucugauggggcucggaaaaggcuggccucuguccaagauggacauuggggugccccugcucgccaucggauguuacagccaggugaauccuauuacccuuacagcggcccugcugcuccuggucgcucacuacgccaucaucggccccggccuucaagcuaaagccaccagagaagcccagaagcgggcggcugccgggauuaugaaaaacccuacaguggauggaaucaccguuauugaccuggagccgauccccuaugauccuaaguucgaaaagcagcucggccaggugaugcugcugauucucugcgucacgcaagugcuuaugaugcgcacaaccugggcucugugugaggcccugacacucgccaccgggcccaucucuacccugugggagggaaauccuggcagauuuuggaacacaacgaucgcugucuccauggccaauauuuuccgggggagcuaccuugcgggagccggccugcucuuuucuaucaugaaaaacaccacaaauacccgcagaggcacagggaacauuggagaaacccugggcgagaaguggaaaucccggcugaacgcucucggaaagagcgaguuccagaucuauaaaaagucuggcauucaggagguggaccgcacgcuugccaaagagggcaucaagagaggggaaacagaucaucacgcuguuagccggggauccgccaagcugagaugguuuguggagcgcaauauggucacccccgaaggcaaagugguugaccugggcugcgggcggggaggcuggucuuacuauugugggggacucaagaacgugagagaggucaaaggccugaccaaagggggaccgggccaugaagaaccuaucacaaugagcaccuacggcuggaaucuugugcgccugcaauccgggguggauguuuucuucacaccucccgagaaaugcgacacgcuccugugugauauuggagaaagcucccccaaccccaccaucgaggcgggccggacacugagaguccucaaucuuguggaaaacuggcugaauaacaauacccaguuuugcauuaaggugcugaacccuuauaugccgucugucaucgagaagauggaaacacuccagcgcaaauacgggggagcccugguucggaauccccuuagcagaaacuccacccacgagauguacugggugucuaaugcuacgggcaacauugugagcuccgucaauaugaucucucgcaugcugaucaaccgguucaccaugaagcacaaaaaggccacauaugagccugacguggaucucgggagcggaaccagaaacauuggcaucgaauccgagauucccaaucuggacaucauuggcaaacgcaucgaaaagauuaagcaggagcaugaaacaagcuggcacuacgaccaagaucauccuuauaaaaccugggcuuaccacgggucuuaugagacaaagcagaccggauccgccagcucuaugguuaacggcgugguccggcugcucacgaaacccugggacgugguuccgauggugacacagauggcuaugaccgauaccacaccuuuugggcagcaaagagucuucaaggagaaaguggacacgcgcacccaggaacccaaggagggaacaaagaaacuuaugaagaucaccgccgaauggcuguggaaagagcugggcaagaaaaagacaccuagaauguguacccgggaggaauuuacacgcaaagugagauccaaugcggcccucggggcuaucuucaccgaugagaacaaguggaaaagcgcccgggaagcugucgaggacggaagauuuugggaacugguugaucgggagcgcaaucuucaccuggagggcaaaugcgaaacguguguguacaacaugaugggcaagagagagaaaaagcucggggaguucggaaaagccaagggcucucgggccauuugguauauguggcugggggcgcgcuuucuggaguucgaagcucucggauuucugaaugaggaccauugguucuccagaggcaacagccuuuccgggguggagggcgaaggacugcaccggcucggcuacauccugcgcgaugucagcaagaaagaagggggagccauguacgccgacgauaccgcuggcugggacacaagaauuacccuugaagaccugaagaaugaggaaauggugacaaaccauaugaaaggggagcacaagaaacucgccgaggcuaucuuuaagcugaccuaucagaauaagguugugcggguccagcgccccacgccuagaggaacagugauggauauuaucucucggcgcgaccaaagaggcagcgggcagguuggcaccuacggacugaacacauucaccaauauggaagcccagcucauccggcaaauggagggcgaagggauuuucaaauccauccagcaucugacggugaccgaggagauugcgguccagaacuggcuugcccgcgugggaagagaacggcugucuagaauggcuaucagcggcgaugacugcguugugaagcccauugaugaccgcuuugccuccgcucucacagcccugaaugauauggggaaaguccggaaggacauccagcaaugggagccgucuagaggauggaacgauuggacccaggugccuuucugcagccaccacuuucaugaacuugucaugaaagacggccgcgugcugguugugcccugucggaaccaggaugagcucaucgggagagcgcgcauuucccagggcgccggauggucucugaaggaaacagcuugccugggcaagagcuaugcccaaauguggacccucauguacuuccaccggagagaccugcgccuugcugccaaugcuaucuguuccgccguccccagccauugggugccuacaucucggaccacgugguccauucacgcgaaacacgaguggaugacaaccgaggauaugcuggccguguggaacagaguuuggauccaggaaaauccguggauggaggacaagacccccguggaaagcugggaggaagucccuuaucucgggaaacgcgaggaccaguggugcggaucucugauuggccuuacaucccgggcuaccugggccaagaacauccagacagccauuaaucaagugagaagccugaucgggaacgaggaauacacggauuauaugcccuccaugaaacgguuuagacgcgaggaagaggaagcuggaguucucugguga

SEQ ID NO: 19993 - RNA, 9876 nt, Artificial Sequence
  derived and/or modified CDS sequence (opt5) from DENV-2__EU482735__SS-prME
accgccggagugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauuaugaucacaccccacagcggggaggagcaugcggugggaaaugacaccggcaagcacggcaaagaaaucaagauuacaccucagucuuccaucaccgaggccgaacugacgggguauggaaccgugacaauggaguguagcccccggaccggccuugauuucaacgaaaugguccugcuccaaauggaggacaaggcuuggcuggugcaccgccagugguuucuugaucugccgcucccuuggcugcccggggccgacacacagggaucuaauuggauucagaaggagacccugguuacguucaagaacccucaugcuaaaaagcaagacguggucgugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauuguuaaagaaaucgcggagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcguggggaaggcucuccaccagguuuucggcgccauuuacggagcggcuuuuuccggcgugucuuggacaaugaaaauccugauuggggucaucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacaggcgacauuaaagggaucaugcaggccggaaagcggucucuuagaccucaacccaccgaacucaaauauagcuggaagacguggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacaaacaucuggcugaaacuucgggagaaacaggacguguuuugugauuccaagcugaugagcgccgcuaucaaagacaauagagccguccacgcggauaugggcuauuggauugaaucugcccucaacgacaccuggaagauggagaaggcuuccuucaucgaggugaaaagcugccacuggccuaagucucauacgcuguggagcaaugggguucuggaauccgagaugauuauccccaaaaacuucgccggaccggugagccagcacaacuaccgcccuggcuaucauacacaaaccgcugggcccuggcaccuuggaaagcucgaaauggauuuugacuucugugagggcaccacagucguggugaccgaagauugcgggaaucggggacccucucugagaacgacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacagccggccaugggcagauugauaacuuuucucugggagugcugggcauggcucuuuuccucgaagagaugcugagaacccgcguggggacgaaacacgcgauccugcucgucgccgugagcuuuguuacccugaucacaggaaauauguccuuccgggaccuuggcagagugauggucauggugggcgcuaccaugacagaugacauugggaugggaguuaccuaucuggcccuccuggccgcuuuuaaggugcgcccuacguucgccgcgggccugcuucugagaaaacucacaucuaaggagcugaugauggcuaccaucgggauugcccuccugagccaguccacaauccccgaaaccauucuugagcugaccgaugcccucgcucugggaaugauggcccugaaaaucgucaagaacauggaaaaguaccaacuugcggugacaaucauggcuauuucuugcguuccuaaugccgugauccugcagaacgccuggaaagucagcuguacgauucucgcugccguguccgugagcccccugcuccugaccucuucccagcagaaggcugacuggaucccucuugcccugacaauuaaaggccucaaucccaccgcgaucuuucugacaacccugagccggacgucuaagaaacgcuccuggccgcuuaacgaggccaucauggcugucgggaugguuagcauucuggccucuucccuccugaagaaugacaucccuaugacaggaccccucguggcuggcggccugcuuaccgugugcuauguccugaccgggagaagcgccgaucuggaacucgagcgggccgcugacgugaaaugggaggaucaagcggaaauuuccggaagcucuccuauccugagcauuacaaucuccgaggacggcucuaugagcauucgcaacgaagaggaggaacagacccuuacaauccugaucagaacggggcuccugguuauuuccggaguguuccccgucucuaucccggugaccgccgcugccugguaccucugggagguuaagaagcagcgggccggcgugcugugggaugucccuucucccccucccguggggaaagcugaacuugaggacggagccuaucgcauuaagcagagaggcauccugggcuacucccaaauuggggcgggagucuauaaagaaggcacauuucacaccauguggcaugugacaagaggggcuguucugaugcaccgcggaaagagaaucgagcccuccugggccgaugugaaaaaggaccucgucagcuacggcgggggauggaagcuggagggcgaauggaaagagggcgaagaggugcagguucuugcccuggaaccugggaagaauccgcgggcugugcagaccaaacccggaaucuucaagacgaacaccggcacaauuggggccgucucccucgauuuuagcccuggaaccucuggcucccccaucguggacagaaaagggaaggugguuggacuguacggcaauggcgucgugacacgcagcggggcguaugugucugcuauugcccagaccgagaaguccaucgaggauaacccugaaauugaggacgauaucuuccggaaaaagagacucacaaucauggaccugcaucccggagccggcaaaacgaagcgcuaccuuccugcuauuguccgggaagccaucaaaagagggcugcgcacccugauucucgcuccgacacgggugguugccgcggagauggaagaggcccugagaggacuucccauccgcuaucaaaccccugcuauucgggccgagcacaccggcagagaaaucguggaccugaugugucaugcuacauucacgaugcggcuccugagccccguccgcgugccuaacuacaaucucauuaucauggaugaggcccacuuuaccgaccccgccuccaucgcugcgagaggguauauuucuacacggguugaaaugggcgaggccgcuggaaucuucaugaccgccacaccgccuggcagccgcgaucccuuuccccaguccaacgccccuauuauggacgaggaaagagagauccccgaacggagcuggaacucugggcacgagugggugaccgauuucaagggaaagacggucugguuugugccuuccauuaaagcuggcaacgacaucgccgcgugccugagaaagaaugggaaaaagguuauccagcuuagccgcaaaacauucgauucugaauacgugaagacccgggcuaacgacugggauuuugucgugaccacagacauuagcgagaugggagccaauuucaaggccgagagagugaucgauccgcgccgguguaugaaacccgucauucugaccgacggcgaagagagaguuauccuggcugggccuaugcccgugacacauuccucugccgcgcaacgccggggcagaauuggacgcaacccuaagaaugaaaacgaccaguauaucuacaugggcgagccccucgaaaaugaugaggacugcgcccacuggaaagaggcuaagaugcugcuugauaacaucaauaccccggaagggauuaucccuagcauguuugagcccgaaagagagaaaguggacgccauugauggagaauaccggcugcgcggcgaggcuagaaagacguucgucgaccucaugcggcgcggggaucugccuguguggcuggccuauaaaguugcugccgagggaaucaacuacgcggacagacggugguguuuugauggcauuaagaauaaccagauccucgaagagaacguggaagucgagauuuggacaaaggagggggaacgcaagaaacuuaaaccccgcuggcuggacgcccggaucuauuccgauccucuggcucucaaggaguucaaagaguucgccgcuggcagaaagucucugacccuuaaucugaucacagagaugggacgccuccccaccuuuaugacgcagaaggcccggaacgcccuggacaaucuggcugugcuccauaccgcggaagccggcgggaaggcuuacaaccacgcccuuagcgagcugccggagacacuggaaacccuccugcuucugacacuccuggccaccguuacaggaggcauuuuccuguuucucauguccgggaagggaaucggcaaaaugacccuuggcaugugcugcauuaucacggcuagcauucugcugugguaugcccaaauccagccucacuggaucgcggccucuauuauccucgaguucuuucugauugugcuucugauccccgaacccgagaagcagagaacaccucaggauaaucaacucaccuacgucgugauugcuauccugaccgucguggccgcuacaauggccaacgaaaugggguuccuggagaaaaccaagaaggaccucggacuuggcuccaucacaacgcaggagagcgaauccaauauucuggacaucgaucugcggccggcgucugccuggacccucuaugcuguugccacaaccuuugugacacccaugcugcgccauagcauugagaacuccucugugaaugucagccuuaccgcuaucgccaaccaggcuacgguucugauggggcucggaaaaggcuggccucuguccaagauggacauuggggugccccugcucgccaucggauguuacagccaggugaauccuauuacccuuacagcggcccugcugcuccuggucgcucacuacgccaucaucggccccggccuucaagcuaaagccaccagagaagcccagaagcgggcggcugccgggauuaugaaaaacccuacaguggauggaaucaccguuauugaccuggagccgauccccuaugauccuaaguucgaaaagcagcucggccaggugaugcugcugauucucugcgucacgcaagugcuuacaaugcgcaccacaugggcucugugugaggcccugacccucgccaccgggcccaucucuacacugugggagggaaauccuggcagauuuuggaacacgaccaucgcugucuccauggccaauauuuuccgggggagcuaccuugcgggagccggccugcucuuuucuaucaugaaaaacacaaccaauacacgcagaggcaccgggaacauuggagaaacgcugggcgagaaguggaaaucccggcugaacgcucucggaaagagcgaguuccagaucuauaaaaagucuggcauucaggagguggaccgcacacuugccaaagagggcaucaagagaggggaaaccgaucaucacgcuguuagccggggauccgccaagcugagaugguuuguggagcgcaauauggucacccccgaaggcaaagugguugaccugggcugcgggcggggaggcuggucuuacuauugugggggacucaagaacgugagagaggucaaaggccugacaaaagggggaccgggccaugaagaaccuauccccaugagcaccuacggcuggaaucuugugcgccugcaauccgggguggauguuuucuucacacccccugagaaaugcgacacgcuccugugugauauuggagaaagcucccccaacccuaccaucgaggcgggccggacacugagaguccucaaucuuguggaaaacuggcugaauaacaauacccaguuuugcauuaaggugcugaacccguauaugcccucugucaucgagaagauggaaacacuccagcgcaaauacgggggagcccugguucggaauccucuuagcagaaacuccacccacgagauguacugggugucuaaugcuacgggcaacauugugagcuccgucaauaugaucucucgcaugcugaucaaccgguucaccaugaagcacaaaaaggccacauaugagcccgacguggaucucgggagcggaaccagaaacauuggcaucgaauccgagauuccuaaucuggacaucauuggcaaacgcaucgaaaagauuaagcaggagcaugaaacaagcuggcacuacgaccaagaucaucccuauaaaaccugggcuuaccacgggucuuaugagacaaagcagaccggauccgccagcucuaugguuaacggcgugguccggcugcucacgaaaccgugggacgugguuccuauggugacacagauggcuaugaccgauaccacacccuuugggcagcaaagagucuucaaggagaaaguggacacgcgcacccaggaaccuaaggagggaacaaagaaacuuaugaagaucaccgccgaauggcuguggaaagagcugggcaagaaaaagacacccagaauguguacccgggaggaauuuacacgcaaagugagauccaaugcggcccucggggcuaucuucaccgaugagaacaaguggaaaagcgcccgggaagcugucgaggacggaagauuuugggaacugguugaucgggagcgcaaucuucaccuggagggcaaaugcgaaacguguguguacaacaugaugggcaagagagagaaaaagcucggggaguucggaaaagccaagggcucucgggccauuugguauauguggcugggggcgcgcuuucuggaguucgaagcucucggauuucugaaugaggaccauugguucuccagaggcaacagccuuuccgggguggagggcgaaggacugcaccggcucggcuacauccugcgcgaugucagcaagaaagaagggggagccauguacgccgacgauaccgcuggcugggacacaagaauuacccuugaagaccugaagaaugaggaaauggugacaaaccauaugaaaggggagcacaagaaacucgccgaggcuaucuuuaagcugaccuaucagaauaagguugugcggguccagcgcccuacgcccagaggaacagugauggauauuaucucucggcgcgaccaaagaggcagcgggcagguuggcaccuacggacugaacacauucaccaauauggaagcccagcucauccggcaaauggagggcgaagggauuuucaaauccauccagcaucugacggugaccgaggagauugcgguccagaacuggcuugcccgcgugggaagagaacggcugucuagaauggcuaucagcggcgaugacugcguugugaagccgauugaugaccgcuuugccuccgcucucacagcccugaaugauauggggaaaguccggaaggacauccagcaaugggagccuucuagaggauggaacgauuggacccaggugcccuucugcagccaccacuuucaugaacuugucaugaaagacggccgcgugcugguugugcccugucggaaccaggaugagcucaucgggagagcgcgcauuucccagggcgccggauggucucugaaggaaacagcuugccugggcaagagcuaugcccaaauguggacccucauguacuuccaccggagagaccugcgccuugcugccaaugcuaucuguuccgccgucccuagccauugggugccgacaucucggaccacgugguccauucacgcgaaacacgaguggaugacaaccgaggauaugcuggccguguggaacagaguuuggauccaggaaaaucccuggauggaggacaagaccccuguggaaagcugggaggaaguccccuaucucgggaaacgcgaggaccaguggugcggaucucugauuggccuuacaucccgggcuaccugggccaagaacauccagacagccauuaaucaagugagaagccugaucgggaacgaggaauacacggauuauaugccuuccaugaaacgguuuagacgcgaggaagaggaagcuggaguucucugguga

SEQ ID NO: 19994 - RNA, 9876 nt, Artificial Sequence
  derived and/or modified CDS sequence (opt5) from DENV-2__EU482736__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagagcaggacaaacgcuuugugugcaagcauuccaugguggauagaggcuggggcaacggguguggacuguucggcaaggggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaagcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaagcuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggagugcuuggcauggcgcucuuccuggaagagaugcugagaacacgcgucgggaccaaacacgccaugcuccuggugguuguguccuuugucacgcuuaucaccggaaacaugucuuuccgggaccugggcagagugaugguuauggugggcgcuacaaugaccgaugacaucgggaugggaauuacauaucucgcccugcuggccgcuuuuaagguccgcccuaccuucgccgcgggccuucugcucagaaaacugacgagcaaggagcucaugauggcuacaaucgggauugcccugcuuucccagucuaccauccccgaaacaauucuggagcucaccgaugcccuggcucugagcaugauggugcuuaaaaucguucggaauauggaaaaguaccagcuggccgugaccaucauggcgauuuccugcgucccuaacgcugugauccuccaaaaugccuggaaggugagcuguacaauucuggccgcugucucuguuuccccccuccugcuuacgagcucucagcagaaagccgacuggaucccucuggcucucaccauuaagggacugaaccccacagccaucuuucugaccacacuuucccgcaccagcaaaaagagaucuuggccgcugaaugaggcgaucauggccgugggcaugguguccauucucgcuagcucccugcucaaaaacgacaucccuaugacggggccccuggucgccggaggccuucugacagugugcuauguucugaccggccggagcgcugaucucgaacuggagcgcgccgccgacgugaagugggaggaucaggcugaaauuucugggagcuccccuauccuuucuauuaccaucagcgaggacggauccaugucuauuaaaaaugaagaggaggaacaaacacugaccauccucaucagaacaggccugcucgucauuagcgggguguuccccguuuccaucccgauuacggcggccgcuugguaccugugggaggugaagaagcagcgggccggaguccuuugggaugugccuucucccccucccgucggcaaagccgaacuggaggacggggcuuaucgcaucaagcagagaggaauucugggcuacagccagaucggcgccgggguguauaaagaaggaaccuuucacacaauguggcauguuacccggggcgcggugcucaugcaccgcgggaagagaaucgagcccuccugggcugaugucaaaaaggaccugauuagcuacggaggcggguggaagcuugagggagaauggaaagagggcgaagaggugcaaguucuggcccucgaaccuggcaagaacccgcgggccgugcagacaaaacccgggcuguucaagaccaauacgggaaccaucggcgcugucucucucgauuuuuccccugggacaagcggaucucccauuguggacagaaaaggcaaggugguugggcuguacggaaacggcgucgugacccgcuccggcgccuaugugagcgcgaucgcucagacagagaaguccauugaggauaauccugaaaucgaggacgauaucuuccggaaaaagagacuuaccauuauggaccugcaucccggggccggaaaaacaaagcgcuaccugccugccaucguccgggaagcuauuaaaagaggccuccgcacgcugauccuugccccgacccgggugguugcugccgagauggaagaggcgcugagagggcuccccauucgcuaucagacaccugccauccgggcugagcacaccggaagagaaauuguggaccugaugugucaugccaccuucacaaugcggcuccugucucccguccgcgugccuaacuacaaccuuaucaucauggaugaggcucacuuuacggaccccgccagcauugccgcuagaggcuauaucuccacccggguugaaaugggggaggcggccggcauuuucaugacagcuaccccgccuggaagccgcgaucccuuuccccaaucuaaugccccuaucauggacgaggaaagagagauucccgaacgguccuggaacagcggccacgagugggugacagauuucaaggggaagaccgucugguuugugccuucuaucaaagccggaaaugacaucgcugccugccugagaaagaacggcaaaaagguuauucagcugagccgcaaaacguucgauuccgaauacgugaagacacgggcgaaugacugggauuuugucgugaccaccgacaucucugagaugggggcuaacuucaaggccgagagagugauugauccgcgccgguguaugaaacccgucauccucacagacggagaagagagaguuauucuggccggcccuaugcccgugacccauagcuccgcugcccagcgccgggggagaaucggccgcaauccuaagaacgaaaaugaccaauauaucuacaugggagagccccuugaaaacgaugaggacugcgcgcacuggaaagaggccaagaugcugcucgauaauauuaacacaccggaaggcaucauuccuucuauguuugagcccgaaagagagaaaguggacgcuaucgauggggaauaccggcugcgcggagaggccagaaagaccuucgucgaccugaugcggcgcggcgaucucccuguguggcuugcuuauagaguugccgcugaggggauuaauuacgccgaccggagaugguguuuugauggaaucaaaaacaaucagauucuggaagagaacguggaagucgagaucuggacgaaggagggcgaacgcaagaaacugaagccccgguggcucgacgcgagaaucuauagcgauccucuggcccuuaaagaguucaaggaauucgcugccgggcgcaaaucccugacacucaaccugauuaccgagaugggccggcugcccacauuuaugacccagaaggcuagagacgcccucgauaaucuugccgugcugcauacggcugaagcgggaggccgggccuacaaccacgcucugagcgagcucccggagacccuggaaacacuucugcuccugacccugcucgccacaguuaccgggggaaucuuccuuuuucugaugucuggcaaggggauuggaaaaaugacacugggcaugugcugcaucauuaccgccuccauccuccugugguaugcucagauccaaccucacuggauugccgcgagcaucauucuugaguucuuucugaucgugcuccugauucccgaacccgagaagcagcgcacgccucaggacaaucagcugacauacgucgugaucgccauccucaccgucguggcugccaccauggcuaacgaaaugggcuuccuugagaaaacaaagaaagaccuggggcugggauccauugccacccaagagucugaaagcaauauccucgauauugaccugagaccggcguccgccuggacacuuuaugcuguugccacgaccuuugugacacccaugcugcggcauucuaucgagaacagcuccgugaaugucagccucaccgcuauugccaaccaggcuacaguucugaugggccuggggaagggauggccucucucuaagauggauaucggcgugccccuucuggccauuggguguuacucccaggugaauccuaucacccugacggcggcccuccugcuucuggucgcucacuacgccaucauuggacccggccuccaggcuaaagccacccgcgaagcccaaaagagagcggcugccggcaucaugaaaaacccuacaguggacgggauuaccguuaucgaucuggagccgauucccuaugacccuaaguucgaaaaacagcugggacaggugaugcuccuuauccugugcgucacacaggugcugaugaugcggaccacgugggcucucugugaggcccugacacuugccaccggccccaucagcacacugugggaggggaauccuggacgcuuuuggaacaccaccauugcugucucuauggccaauaucuucagaggcuccuaccucgcgggggccggacugcuguuuagcauuaugaagaacacaacgaauacccggcgcggcacaggcaacaucggggaaacccucggagagaaguggaaaucuagacuuaaugcucugggcaagagcgaauuccaaauuuauaaaaaguccgggauccaggagguggaucggacacuggccaaagagggaaucaagagaggcgaaaccgaccaucacgcuguuucucgcgggagcgccaaacuccggugguuuguggagagaaacauggucacgcccgaaggaaaggugguugaucugggcugcggccgcgggggaugguccuacuauuguggcgggcuuaagaacgugcgggaggucaaaggacugacaaagggcgggccgggacaugaagagccuauucccaugagcaccuacggcuggaaucucgugagacugcaguccggcguggacguuuucuucacccccccugagaaaugcgauacacugcucugugacaucggggaaucuagccccaacccuaccauugaggcgggacgcacacuucggguccugaaucugguggaaaacuggcucaauaacaauacgcaauuuugcaucaaggugcugaacccguauaugcccuccgucauugagaaaauggaaacccuucagagaaaguacggcggggcccugguucgcaauccucucucucggaacagcacacacgagauguacuggguguccaaugcuaccggaaacaucgugucuagcgucaauaugaucuccagaaugcugauuaaccgcuucacaaugaagcacaaaaaggccaccuaugagcccgauguggaccugggcagcgggacgcggaauaucggaauugaaucugagaucccuaaccucgacauuaucggcaaaagaauugaaaagaucaaacaggagcaugaaaccuccuggcacuacgaucaggaccaucccuauaagacaugggcuuaccacggcagcuaugagaccaagcaaacagggucugccuccagcaugguuaacggagugguccgccuucugaccaaaccgugggaugugguuccuauggugacacagauggcuaugaccgacacgacacccuuuggccagcagagagucuucaaggagaaaguggauacccggacccaagaaccuaaggaggggacaaaaaagcugaugaagaucacggccgaauggcucuggaaagagcugggaaagaaaaagaccccccgcauguguacaagagaggaauuuacccggaaagugagaucuaaugcggcccuuggcgcuauuuucacagacgagaacaaguggaaauccgcccgggaagcugucgaggauagccgcuuuugggaacugaucgacagagagcggaaucuccaccuggaggggaagugcgaaaccuguguuuacaacaugaugggaaagcgcgagaaaaagcugggcgaauucggcaaagccaagggguccagagccauuugguauauguggcucggagcgcgguuucuggaguucgaagcucuuggcuuucugaaugaggaucauugguucagccgcgggaacucucucagcggaguggagggcgaagggcugcacagacuuggcuacauccugcgggacguguccaaaaaggagggaggcgccauguacgccgaugacacagcugggugggacacccgcauuacgcucgaagaucugaagaaugaggaaauggucaccaaccauaugaaaggagagcacaagaaacuggccgaggcuaucuuuaagcucacauaucagaauaaagugguuagagugcagcggccuaccccccgcggcacagucauggacaucauuucuagacgggaucagcgcgggagcggacaagugggcaccuacgggcugaacacguucacaaauauggaagcccagcuuaucagacagauggagggcgaaggaauuuucaaguccauccaacaucugaccguuacagaggagauugcggugcagaacuggcucgcccgggucggcagagaacgccugucucggauggcuaucagcggggacgauugcgugguuaagccgcuugacgauagauuugccuccgcucugaccgcccucaaugacaugggaaaagugcgcaaggauauccagcagugggagccuucucggggcuggaacgacuggacgcaaguccccuucugcagccaccacuuucaugaacuggugaugaaagaugggagaguccuggugguucccugucgcaaucaggacgagcucauuggacgggcgagaaucucccagggcgccggguggagccugaaggaaaccgcuugccuuggcaaaucuuaugcccagauguggacacugauguacuuccaccgccgggaucucagacuggcugccaacgcuauuuguuccgccgugccuagccauugggucccgaccucucgcacaaccugguccauccacgcgaagcacgaguggaugacaaccgaggacaugcuugccguguggaaccggguguggauucaagaaaaucccuggauggaggacaagacgccuguugaaagcugggaggaagugcccuaucugggaaaaagagaggaucaguggugcggcucccucaucgggcugacaucucgggcuaccugggccaagaacauucagaccgccaucaaucaggucagaagccugaucggaaacgaggaauacacagacuauaugccuuccaugaaacgcuuucggagagaggaagaggaagcuggcgugcucugguga

SEQ ID NO: 19995 - RNA, 9876 nt, Artificial Sequence
  derived and/or modified CDS sequence (opt5) from DENV-2__EU482737__SS-prME
accgccggcgugaucgucaugcugauucccacagcuauggccuuccaccucacgaccagaaacggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagagcaggacaaacgcuuugugugcaagcauuccauggucgauagaggcuggggcaacggguguggacuguucggcaaggggggaaucguuacaugcgccauguuuacgugcaaaaagaauauggaaggcaaaguggugcucccugagaaccuggaauacaccauugucaucacaccccacagcggggaggagcaugcggugggaaaugacaccggcaagcacggcaaagaaauuaagaucacaccucagucuuccaucaccgaggccgaacuuacgggguauggaaccguuacaauggaguguagcccccggaccggccuggauuucaacgaaauggugcuccugcagauggaggacaaagcuuggcuuguccaccgccaaugguuucuggaucucccgcugccuuggcugcccggggccgacacacagggaucuaauuggauucagaaggagacccucgugacguucaagaacccucaugcuaaaaagcaggacguugugguccugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgauugucaucagagugcaguaugagggggacggaucccccugcaagauccccuucgaaauuauggaucuggagaaacgccauguucugggccggcucaucaccgugaacccuauugucgccgaaaaggacagcccggugaacaucgaggcugaacccccuuuuggggauucuuacauuaucauuggcguugagcccggacagcugaaacuuaauugguucaagaagggcuccagcaucgggcagauguuugagacaaccaugagaggagccaaacgcauggccauccugggcgacacagcuugggauuucgggucucucggaggcguguuuaccagcauugggaaggcccugcaccaagucuucggcgcgaucuacggagcugccuuuuccggcgugucuuggacgaugaaaauucugaucggggugauuaucacauggaucggaaugaacagccgguccaccagccuuucuguuucccucguccuggugggcguggucacccuguaucucggggccauggugcaggcugacagcggauguguugugucuuggaaguccaaagaacugaagugcggcagcgggauuuucaucacagauaauguccacaccuggacagagcaguacaaguuucagccugaaucccccucuaaacuugccagcgcuauucaaaaggcccaugaggaaggcaucuguggaauuagauccgugacgcgccuggagaaccucauguggaaacagaucaccccggagcugaaucacauccugucugaaaacgagguuaagcuuacaauuaugaccggcgacaucaaagggauuaugcaggcgggaaagcggagccucagaccucagcccacagaacugaaauauuccuggaagaccuggggcaaggccaaaaugcugagcacggagucucauaaucaaaccuuccucaucgaugggccugaaacagcugagugccccaacaccaaucgcgccuggaacucccuggagguggaagacuacggauuuggcgucuucacaaccaauauuuggcuuaagcugcgggagaaacaggacguguuuugugauagcaagcucaugucugcugccaucaaagacaacagagcgguucacgccgauaugggcuauuggaucgaauccgcucugaaugacacauggaagauggagaaggccagcuucauugaggugaaaucuugccacuggccuaagagccauacccugugguccaacgggguccuugaaagcgagaugaucauucccaaaaauuucgcuggaccggugucucagcacaacuaccgcccuggcuaucauacgcagacagccgggcccuggcaccucggaaagcuggaaauggauuuugacuucugugagggcaccaccguggucguuacagaagauugcgggaaccggggacccucccugagaaccacgacagccagcggcaaacucaucaccgaguggugcugucgguccugcacacugccuccgcuucgcuacagaggcgaggacggguguugguacggaauggaaauucggccccugaaggagaaggaagagaaucucgugaacucucuggugaccgcuggccaugggcaaaucgauaauuuuagccugggaguccuuggcauggcgcucuuccuggaagagaugcugagaacacgcguggggaccaaacacgccaugcuccugguuguggucuccuuugugacgcuuauuaccggaaacaugucuuuccgggaccugggcagaguuauggugauggucggcgcuacaaugaccgaugacaucgggaugggaaucacauaucucgcccugcuggccgcuuuuaaggugcgcccuaccuucgccgcgggccuucugcucagaaaacugacgagcaaggagcucaugauggcuacaauugggaucgcccugcuuucccagucuaccauucccgaaacaauccuggagcucaccgaugcccuggcucugagcaugaugguucuuaaaauugugcggaauauggaaaaguaccagcuggccgucaccaucauggcgaucuccugcgugccuaacgcugugauucuccaaaaugccuggaaggucagcuguacaauccuggccgcuguuucuguguccccccuccugcuuacgagcucucagcagaaagccgacuggauuccucuggcucucaccaucaagggacugaaccccacagccauuuuucugaccacacuuucccgcaccagcaaaaagagaucuuggccgcugaaugaggcgaucauggccgugggcauggucuccauccucgcuagcucccugcucaaaaacgacauuccuaugacggggccccugguggccggaggccuucugacaguuugcuaugugcugaccggccggagcgcugaucucgaacuggagcgcgccgccgacgucaagugggaggaucaggcugaaaucucugggagcuccccuauucuuucuaucaccauuagcgaggacggauccaugucuaucaaaaaugaagaggaggaacaaacacugaccauucucaucagaacaggccugcucgugaucagcgggguuuuccccguguccauuccgaucacggcggccgcuugguaccugugggaggucaagaagcagcgggccggagugcuuugggaugucccuucucccccucccgugggcaaagccgaacuggaggacggggcuuaucgcauuaagcagagaggaauccugggcuacagccagauuggcgccgggguuuauaaagaaggaaccuuucacacaauguggcaugugacccggggcgcgguccucaugcaccgcgggaagagaaucgagcccuccugggcugaugugaaaaaggaccugaucagcuacggaggcggguggaagcuugagggagaauggaaagagggcgaagagguucaagugcuggcccucgaaccuggcaagaacccgcgggccguccagacaaaacccgggcuguucaagaccaauacgggaaccauuggcgcugugucucucgauuuuuccccugggacaagcggaucucccaucguggacagaaaaggcaagguugucgggcuguacggaaacggcguggugacccgcuccggcgccuaugucagcgcgauugcucagacagagaaguccaucgaggauaauccugaaauugaggacgauaucuuccggaaaaagagacuuaccaucauggaccugcaucccggggccggaaaaacaaagcgcuaccugccugccauugugcgggaagcuaucaaaagaggccuccgcacgcugauucuugccccgacccggguuguggcugccgagauggaagaggcgcugagagggcuccccauccgcuaucagacaccugccauucgggcugagcacaccggaagagaaaucgucgaccugaugugucaugccaccuucacaaugcggcuccugucucccgugcgcguuccuaacuacaaccuuauuaucauggaugaggcucacuuuacggaccccgccagcaucgccgcuagaggcuauauuuccacccggguggaaaugggggaggcggccggcaucuucaugacagcuaccccgccuggaagccgcgaucccuuuccccaaucuaaugccccuauuauggacgaggaaagagagauccccgaacgguccuggaacagcggccacgagugggucacagauuucaaggggaagaccgugugguuuguuccuucuauuaaagccggaaaugacaucgcugccugccugagaaagaacggcaaaaaggugauccagcugagccgcaaaacguucgauuccgaauacgucaagacacgggcgaaugacugggauuuuguggugaccaccgacauuucugagaugggggcuaacuucaaggccgagagagucaucgauccgcgccgguguaugaaacccguuauucucacagacggagaagagagagugauccuggccggcccuaugcccgugacccauagcuccgcugcccagcgccgggggagaauuggccgcaauccuaagaacgaaaaugaccaauauaucuacaugggagagccccuugaaaacgaugaggacugcgcgcacuggaaagaggccaagaugcugcucgauaauaucaacacaccggaaggcauuaucccuucuauguuugagcccgaaagagagaaagucgacgcuauugauggggaauaccggcugcgcggagaggccagaaagaccuucguggaccugaugcggcgcggcgaucucccuguuuggcuugcuuauagaguggccgcugaggggaucaauuacgccgaccggagaugguguuuugauggaauuaaaaacaaucagauccuggaagagaacgucgaaguggagauuuggacgaaggagggcgaacgcaagaaacugaagccccgguggcucgacgcgagaaucuauagcgauccucuggcccuuaaagaguucaaggaauucgcugccgggcgcaaaucccugacacucaaccugaucaccgagaugggccggcugcccacauuuaugacccagaaggcuagagacgcccucgauaaucuugccguucugcauacggcugaagcgggaggccgggccuacaaccacgcucugagcgagcucccggagacccuggaaacacuucugcuccugacccugcucgccacagugaccgggggaauuuuccuuuuucugaugucuggcaaggggaucggaaaaaugacacugggcaugugcugcauuaucaccgccuccauucuccugugguaugcucagauccaaccucacuggaucgccgcgagcauuauccuugaguucuuucugauuguccuccugauccccgaacccgagaagcagcgcacgccucaggacaaucagcugacauacguggucauugccauccucaccgugguugcugccaccauggcuaacgaaaugggcuuccuugagaaaacaaagaaagaccuggggcugggauccaucgccacccaagagucugaaagcaauauucucgauaucgaccugagaccggcguccgccuggacacuuuaugcuguggccacgaccuuugugacacccaugcugcggcauucuauugagaacagcuccgucaauguuagccucaccgcuaucgccaaccaggcuacagugcugaugggccuggggaagggauggccucucucuaagauggauauuggcgugccccuucuggccaucggguguuacucccaggucaauccuauuacccugacggcggcccuccugcuucugguggcucacuacgccaucaucggacccggccuccaggcuaaagccacccgcgaagcccaaaagagagcggcugccggcauuaugaaaaacccuacaguugacgggaucaccgugauugaucuggagccgauccccuaugacccuaaguucgaaaaacagcugggacaggucaugcuccuuauucugugcgugacacagguccugaugaugcggaccacgugggcucucugugaggcccugacacuugccaccggccccaucagcacacugugggaggggaauccuggacgcuuuuggaacaccaccaucgcugugucuauggccaauauuuucagaggcuccuaccucgcgggggccggacugcuguuuagcaucaugaagaacacaacgaauacccggcgcggcacaggcaacauuggggaaacccucggagagaaguggaaaucuagacuuaaugcucugggcaagagcgaauuccaaaucuauaaaaaguccgggauucaggagguugaucggacacuggccaaagagggaaucaagagaggcgaaaccgaccaucacgcugugucucgcgggagcgccaaacuccggugguuugucgagagaaacauggugacgcccgaaggaaagguuguggaucugggcugcggccgcgggggaugguccuacuauuguggcgggcuuaagaacguccgggaggugaaaggacugacaaagggcgggccgggacaugaagagccuauccccaugagcaccuacggcuggaaucucgugagacugcaguccggcguugacgucuucuucacccccccugagaaaugcgauacacugcucugugacauuggggaaucuagccccaacccuaccaucgaggcgggacgcacacuucgggugcugaaucugguggaaaacuggcucaauaacaauacgcaauuuugcauuaagguccugaacccguauaugcccuccguuaucgagaaaauggaaacccuucagagaaaguacggcggggcccuggugcgcaauccucucucucggaacagcacacacgagauguacuggguguccaaugcuaccggaaacauugucucuagcgugaauaugaucuccagaaugcugaucaaccgcuucacaaugaagcacaaaaaggccaccuaugagcccgauguugaccugggcagcgggacgcggaauauuggaaucgaaucugagauuccuaaccucgacaucauuggcaaaagaaucgaaaagauuaaacaggagcaugaaaccuccuggcacuacgaucaggaccaucccuauaagacaugggcuuaccacggcagcuaugagaccaagcaaacagggucugccuccagcauggugaacggagucgugcgccuucugaccaaaccgugggauguugugccuauggucacacagauggcuaugaccgacacgacacccuuuggccagcagagaguguucaaggagaaaguggauacccggacccaagaaccuaaggaggggacaaaaaagcugaugaagaucacggccgaauggcucuggaaagagcugggaaagaaaaagaccccccgcauguguacaagagaggaauuuacccggaaagucagaucuaaugcggcccuuggcgcuaucuucacagacgagaacaaguggaaauccgcccgggaagcuguugaggauagccgcuuuugggaacugauugacagagagcggaaucuccaccuggaggggaagugcgaaaccuguguguacaacaugaugggaaagcgcgagaaaaagcugggcgaauucggcaaagccaagggguccagagccaucugguauauguggcucggagcgcgguuucuggaguucgaagcucuuggcuuucugaaugaggaucauugguucagccgcgggaacucucucagcggaguggagggcgaagggcugcacagacuuggcuacauucugcgggacgucuccaaaaaggagggaggcgccauguacgccgaugacacagcugggugggacacccgcaucacgcucgaagaucugaagaaugaggaaauggugaccaaccauaugaaaggagagcacaagaaacuggccgaggcuauuuuuaagcucacauaucagaauaaaguugugagaguccagcggccuaccccccgcggcacagugauggacaucaucucuagacgggaucagcgcgggagcggacaaguuggcaccuacgggcugaacacguucacaaauauggaagcccagcuuauuagacagauggagggcgaaggaaucuucaaguccauucaacaucugaccgugacagaggagaucgcgguccagaacuggcucgcccgggugggcagagaacgccugucucggauggcuauuagcggggacgauugcguugugaagccgcuugacgauagauuugccuccgcucugaccgcccucaaugacaugggaaaaguccgcaaggauauccagcagugggagccuucucggggcuggaacgacuggacgcaagugcccuucugcagccaccacuuucaugaacuggucaugaaagaugggagagugcugguugugcccugucgcaaucaggacgagcucaucggacgggcgagaauuucccagggcgccggguggagccugaaggaaaccgcuugccuuggcaaaucuuaugcccagauguggacacugauguacuuccaccgccgggaucucagacuggcugccaacgcuaucuguuccgccgucccuagccauugggugccgaccucucgcacaaccugguccauucacgcgaagcacgaguggaugacaaccgaggacaugcuugccguguggaaccggguuuggauccaagaaaaucccuggauggaggacaagacgccuguggaaagcugggaggaaguccccuaucugggaaaaagagaggaucaguggugcggcucccucauugggcugacaucucgggcuaccugggccaagaacauccagaccgccauuaaucaggugagaagccugaucggaaacgaggaauacacagacuauaugccuuccaugaaacgcuuucggagagaggaagaggaagcuggcguucucugguga

SEQ ID NO: 19996 - RNA, 9876 nt, Artificial Sequence
  derived and/or modified CDS sequence (opt5) from DENV-2__EU482739__SS-prME
accgccggcgugaucauuaugcugauccccaccgcuauggccuuccaccucacgacccggaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaagaccgaggcuaagcagccugccacgcugagaaaguauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggugaugguccaggccgacagcggaugugugguuucuuggaagaauaaagaacugaagugcggcuccgggauuuucaucaccgauaacgugcacacauggacggagcaguacaaguuucagccugaaagccccuccaaacuugccucugcuauucaaaaggcccaugaggaaggcaucuguggaaucagaagcgucacccgccuggagaaucucauguggaaacagauuacaccggagcugaaccacauccuguccgaaaaugaggugaaacuuaccauuaugacaggcgacaucaaagggauuaugcaggcuggaaagcggucucucagaccucagcccaccgaacugaaauauagcuggaagacguggggcaaggccaaaaugcuguccaccgagagccauaaccaaacauuccucaucgaugggccugaaaccgcggagugccccaauacaaaccgcgccuggaacucucuggagguugaagacuacggauuuggcguguucuccaccaacaucuggcuuaagcugcgggagaaacaggacgucuuuugugauagcaagcucaugucugcugccauuaaagacaauagagcugugcacgccgauaugggcuauuggaucgaauccgcgcugaacgacacauggaagauggagaaggccagcuucauugagguuaaaucuugccacuggccuaagagccauacccugugguccaauggggugcuugaaagcgagaugaucauucccaaaaacuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaucggggacccucccugagaaccacgacagcuagcggcaaacucaucaccgaguggugcugucgguccugcacacugccuccgcuucgcuacagaggcgaggacggguguugguacggaauggaaauucggccccugaaggagaaggaagagaaccucguuaauucucuggugaccgccggccaugggcaaaucgauaacuuuagccugggagugcuuggcauggcccucuuccuggaagagaugcugagaacacgcgucgggaccaaacacgcuauccuccugguggcgguuuccuuugugacgcuuauuaccggaaauaugucuuuccgggaccugggcagagucauggugaugguuggcgccacaaugaccgaugacaucgggaugggagugacauaucucgcucugcuggccgccuuuaagguccgcccuaccuucgcugccggccuucugcucagaaaacugacgagcaaggagcucaugauggcgacaauugggaucgcucugcuuucccagucuaccauucccgaaacaauccuggagcucaccgaugcccuggcccugggaaugauggugcuuaaaaucguucggaaccuggaaaaguaccagcucgcugugaccauuauggccaucagcugcgucccuaaugcggugauucugcaaaacgcuuggaagguguccuguacaauccucgccgccgucagcguuucuccccugcuucugacguccagccagcagaaagcugacuggauuccucucgcccugaccaucaagggccugaaucccacagcuaucuuucuuaccacacugucucgcaccuccaaaaagagaagcuggccgcucaacgaggccgugauggcgguggggauggucucuauucuggccuccagccuccugaaaaaugacaucccuaugacgggaccccuuguggcuggcggccugcugacaguuugcuaugugcucaccgggcgguccgccgaucuggaacuugagcgcgcugccgacgucaagugggaggaucaggccgaaauuagcggaucuagcccuauccuguccauuaccaucucugaggacggcagcauguccauuaaaaacgaagaggaggaacaaacacucaccauccugaucagaacagggcuccuggugauuucuggaguuuuccccgugagcaucccgauuacggcugcggccugguaccuuugggaggucaagaagcagcgggcuggcgugcugugggaugucccuucucccccucccguggggaaagccgaacuggaggacggagccuaucgcaucaagcagagaggcauuuuuggcuacagccagaucggggcuggaguuuauaaagaaggcaccuuccacacaauguggcaugugaccagaggggccguccucaugcaccgcggaaagagaaucgagcccagcugggcggaugugaaaaaggaccugauuuccuacggcgggggauggaaacuugagggcgaauggaaagagggcgaagagguucaagugcuggcucucgaaccugggaagaauccgcgggccguccagacaaaacccggacuguuuaagaccaacacgggcaccaucggggccgugagccucgauuucucuccuggaacauccggcagccccauuguggacagaaaagggaagguugucggacuguacggcaauggcguggugacccgcucuggggcuuaugucuccgccaucgcgcagacagaaaagagcauugaggauaacccugaaaucgaggacgauaucuuccggaaaaagagacuuaccauuauggaccugcaucccggagcuggcaaaacaaagcgcuaccugccugccaucgugcgggaagccauuaaaagagggcuccgcacgcugauccuugcuccgacccggguuguggccgcugagauggaagaggcccugagaggacuccccauucgcuaucagaccccugcgauccgggccgagcacaccggcagagaaauugucgaccugaugugucaugcuaccuuuacaaugcggcuccugucccccgugcgcguuccuaacuacaaucuuaucaucauggaugaggcccacuucacggaccccgcuucuauugccgccagaggguauaucagcacccggguggaaaugggcgaggcugcgggaauuuuuaugacagccaccccgccuggcucccgcgaucccuucccccaaagcaacgcuccuaucauggacgaggaaagagagauucccgaacggucuuggaacuccgggcacgagugggucacagauuuuaagggaaagaccgugugguucguuccuagcaucaaagccggcaacgacaucgccgcuugccugagaaagaaugggaaaaaggugauucagcugucucgcaaaacguuugauagcgaauacgucaagacacgggccaacgacugggauuucguggugaccaccgacaucuccgagaugggagcgaauuuuagagcugagcgcgucauugauccgcggagauguaugaagcccguuauccucacagacggcgaggaacgcgugauucuggccgggccuaugcccgugacccauucuagcgccgcucagcggagaggccgcaucggaagaaacccuaaaaaugaaaacgaccaauauaucuacaugggcgagccccuugaaaaugaugaggacugcgcccacuggaaggaggcgaaaaugcugcucgauaacauuaauacaccggaagggaucauuccuuccauguucgagcccgaacgggagaaggucgacgccaucgauggagaauaccgccugagaggcgaggcucggaaaaccuuuguggaccugaugcgcagaggggaucucccuguuuggcuugccuaucggguggcugccgagggaauuaacuacgcugacagacgcugguguuucgauggcaucaagaauaaccagauucuggaagagaacgucgaaguggagaucuggacgaaagagggggaacggaagaagcugaaacccagauggcucgacgcccgcaucuauucugauccucuggcgcuuaaggaguucaaagaauuugccgcuggccggaagucccugacacucaaucugauuaccgagaugggaagacugcccacauucaugacccagaaagcccgggacgcucucgauaaccuugccguucugcauacggccgaagugggcgggcgcgcuuacaaucacgcgcuguccgagcucccggagacccuggaaacacuucugcuccugacccugcucgccacagucaccggaggcaucuuucuuuuccugaugagcgggaagggaauuggcaagaugacacugggcaugugcugcaucauuaccgcuucuauccuccugugguaugcccagauccaaccucacuggauugccgcuuccaucauucuugaguuuuuccugaucgugcuccugauucccgaacccgagaaacagagaacgccucaggacaaccagcugacauacgucgugaucgccauccucaccguuguggcggccaccauggcuaaugaaaugggguuucuugagaagaccaagaaggaccugggacugggcagcauuaccacacaagaguccgaaucuaacauccucgauauugaccugcggccggccagcgcuuggacgcuuuaugccguggcgaccacauucgucacccccaugcugcgccauuccaucgaaaauucuagcguuaacgugucccucacagccauugcuaaucaggccaccgugcugauggggcugggaagaggcuggccucucagcaaaauggauaucggggucccccuucuggcuauuggauguuacucucaggugaacccuaucacgcugaccgccgcucuccugcuucugguugcccacuacgcgaucauuggccccggccuccaggccaaggcuacacgggaagcccaaaagcgcgcugccgccgggaucaugaaaaauccuaccguggacggaauuacagucaucgaucuggagccgauucccuaugacccuaaguuugaaaaacagcugggccaggugaugcuccuuguccugugcgugacccagguucugaugaugagaacgacaugggcgcucugugaggcucugacccuugccacagggcccaucuccacccugugggagggaaacccuggccgguucuggaauaccacaaucgcugugagcauggccaacauuuuucgcgggucuuaccucgccggagcuggccugcuguucuccaucaugaagaauacgaccaacacaagacggggcaccgggaauauuggagaaacacucggcgagaaauggaaaagcagacuuaacgcccuggggaagucugaauuucaaaccuauaaaaagagcggaauccaggaggucgaucgcacgcuggcgaaagagggcauuaagagaggggaaacagaccaucacgccguguccagaggaucugcuaaacuccgcugguucguugagcggaacauggugacccccgaaggcaaggucguggaucugggcugcgggagaggaggcuggagcuacuauugugggggacuuaaaaaugugcgcgagguuaagggccugaccaaagggggaccgggccaugaggagccuauccccauguccacauacggcuggaaccucguccggcugcagagcgggguggacguguucuuuacacccccugagaaaugcgauacacugcucugugacaucggagaauccucucccaauccuacgauugaggccggcagaacccuucgcguccugaaccugguugaaaauuggcucaacaauaacacacaauucugcaucaaggugcugaauccguauaugcccagcgugauugagaaaauggaaacccuucagcggaaguacgggggagcucuggucagaaacccucucucccgcaauucuacacacgagauguacugggugagcaacgccaccggcaauaucguuuccucugugaacaugauuagccggaugcugaucaauagauuuacgaugaaacacaagaaggcgaccuaugagcccgaugucgaccugggguccggaacacgcaacaucggcauugaaaacgagaucccuaaucucgacauuaucggcaaaagaauugaaaagaucaaacaggagcaugaaaccagcuggcacuacgaucaggaccaucccuauaagacaugggccuaccacgggucuuaugagaccaaacaaacaggauccgcuagcucuauggugaacggcguugugcggcuucugaccaagccgugggaugucgugccuauggugacgcagauggccaugacagacaccacccccuucgggcagcagcgcgucuuuaaggagaaaguugauacaagaacgcaagaaccuaaggagggaaccaaaaagcugaugcggauuacagcugaauggcucuggaaagagcugggcaagaagaaaacccccagaauguguacacgggaggaguucacccgcaaggugagauccaaugccgcucuuggggccaucuuuacagacgagaacaaauggaaaagcgcgcgggaagccguggaggauucucgcuucugggaacuggucgacagagagcggaaucuccaccuggagggaaaaugcgaaaccuguguguacaacaugaugggcaagcgcgagaaaaagcugggcgaauuugggaaggcuaaaggauccagagccaucugguauauguggcucggcgcucgguuccuggaguuugaagcccuuggguuccugaaugaggaucauugguuuagccgcggaaacucccucagcggcguugagggggaaggccugcacaaacuuggauacauucugagagacgugucuaaaaaggagggcggggccauguacgcggaugacacggcuggaugggacacccggaucacacucgaagaucugaaaaaugaggaaauggucaccaaccauaugaagggcgagcacaagaaacuggccgaggccauuuucaagcucacauaucagaauaaagugguucgcgugcagagaccuacaccccgggggacggucauggacaucauuagccgcaaggaucagagaggauccggccaaguggggacauacggccugaacaccuucacaaauauggaagcucagcuuauccggcagauggagggagaaggcaucuuuaaaucuauucaacaucugaccguuacggaggagaucgccgugcagaacuggcucgcuagagucgggcgcgaacggcugagcagaauggccauuuccggagacgauugcguggucaagccgcuugacgaucgcuucgcgucugcccugaccgcucucaaugacaugggcaaggugcggaaagauauccagcagugggagccuagcagaggguggaacgacuggacacaaguucccuuuugcucccaccacuuccaugaacuggugaugaaggauggacgcguccugguggugcccugucggaaccaggacgagcucauuggcagagcccgcaucucucagggggcuggcuggagccugaaagaaaccgccugccuuggaaaguccuaugcgcagauguggacacugauguacuuucaccggagagaucuccgccuggccgcuaaugccaucuguagcgcuguuccuucucauugggugccgaccucccggacaaccuggagcauucacgccaaacacgaguggaugacgacagaggacaugcuugcugucuggaacagaguguggauccaagaaaaucccuggauggaggacaagaccccuguugaaucuugggaggaagugcccuaucugggcaagcgggaggaucaguggugcgggucccucauuggacugaccagcagagccacaugggcgaaaaacauccagaccgccauuaaucagguccgcucccugaucggcaacgaggaauacacagacuauaugccuucuaugaagcgguucagaaaagaggaagaggaagcuggggugcucugguga

SEQ ID NO: 19997 - RNA, 9876 nt, Artificial Sequence
  derived and/or modified CDS sequence (opt5) from DENV-2__EU482740__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagagcaggacaaacgcuuugugugcaagcauuccaugguggauagaggcuggggcaacggguguggacuguucggcaaggggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaagcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugacacuguaucucggggccaugguccaggccgacagcggaugugugguuucuuggaaguccaaagaacugaagugcggcagcgggaucuucauuaccgauaaugugcacacauggacggagcaguacaaguuucagccugaaucccccucuaaacuugcuagcgccauccaaaaggcucaugaggaaggcauuuguggaaucagauccgucacccgccuggagaaccucauguggaaacagaucacaccggagcugaaucacauucugucugaaaacgaggugaagcuuaccaucaugacaggcgacauuaaagggaucaugcagccuggaaagcggagccucagaccccagccuaccgaacugaaauauuccuggaagacguggggcaaggccaaaaugcugagcaccgagucucauaaucaaacauuccucauugaugggcccgaaaccgcggagugcccuaacacaaaucgcgccuggaacucccuggagguugaagacuacggauuuggcguguucaccacaaauaucuggcuuaagcugcgggagaaacaggacgucuuuugugauagcaagcucaugucugcugccaucaaagacaacagagcugugcacgccgauaugggcuauuggauugaauccgcgcugaaugacaccuggaagauggagaaggccagcuucaucgagguuaaaucuugccacuggcccaagagccauacgcugugguccaacggggugcuugaaagcgagaugauuaucccgaaaaauuucgcuggaccugucucucagcacaacuaccgccccggcuaucauacacagaccgccgggcccuggcaccucggaaagcuggaaauggauuuugacuucugugagggcaccacagugguggucaccgaagauugcgggaaccggggaccuucccugagaacgacaaccgcuagcggcaaacucauuacagaguggugcugucgguccugcacccugccgccccuucgcuacagaggcgaggacggguguugguacggaauggaaauccggccucugaaggagaaggaagagaaucucguuaacucucuggugacagccggccaugggcaaauugauaauuuuagccugggagugcuuggcauggcccucuuccuggaagagaugcugagaacccgcgucgggacgaaacacgcuauccuccugguggcgguuuccuuugugacccuuaucacaggaaacaugucuuuccgggaccugggcagagucauggugaugguuggcgccaccaugacagaugacauugggaugggagugaccuaucucgcucugcuggccgccuuuaagguccgccccacguucgcugccggccuucugcucagaaaacugacaagcaaggagcucaugauggcgaccaucgggauugcucugcuuucccagucuacaaucccugaaaccauucuggagcucaccgaugcccuggcccugggaaugauggugcuuaaaaucguucggaauauggaaaaguaccagcuggcugugacaaucauggccauuagcugcguccccaacgcggugauccuccaaaaugcuuggaagguguccuguacgauucuggccgucguuagcgugucuccucuccugcuuaccuccagccagcagaaagccgacuggaucccccuggcucucacaauuaagggccugaacccgaccgccaucuuucugacaacccuuucucgcacguccaaaaagagaagcuggccucugaaugaggcuaucauggccguggggauggucucuauucucgcguccagccugcucaaaaacgacauccccaugacaggaccucugguggccggcggccuucugaccguuugcuaugugcugaccgggcgguccgcugaucucgaacuggagcgcgccgcugacgucaagugggaggaucaggccgaaauuagcggaucuagccccauccuuuccauuacaaucucugaggacggcagcauguccauuaaaaaugaagaggaggaacaaacccugacaauccucaucagaacggggcugcucgugauuucuggaguuuucccggugagcaucccuauuaccgccgcugcgugguaccugugggaggucaagaagcagcgggccggcgugcuuugggauguccccuccccuccccccguggggaaagcugaacuggaggacggagccuaucgcaucaagcagagaggcauucugggcuacucucagaucggggccggaguuuauaaagaaggcacauuucacaccauguggcaugugacacggggggcuguccucaugcaccgcggaaagagaaucgagccuagcugggccgaugugaaaaaggaccugauuuccuacggcgggggauggaagcuugagggcgaauggaaagagggcgaagagguucaagugcuggcgcucgaaccggggaagaacccccgggcuguccagaccaaaccuggacuguucaagacgaauaccggcacaaucggggccgugagccucgauuuuucucccggaaccuccggcagcccuauuguggacagaaaagggaagguugucggacuguacggcaacggcguggugacacgcucuggggccuaugucuccgcuaucgcccagaccgagaagagcauugaggauaaucccgaaaucgaggacgauaucuuccggaaaaagagacuuacaauuauggaccugcauccuggagcgggcaaaacgaagcgcuaccugccggcuaucgugcgggaagccauuaaaagagggcuccgcacccugauccuugcccccacacggguuguggcugccgagauggaagaggcucugagaggacucccuauucgcuaucagacccccgccauccgggcggagcacaccggcagagaaauugucgaccugaugugucaugccacauucacgaugcggcuccuguccccugugcgcguucccaacuacaaccuuaucaucauggaugaggcucacuuuaccgacccggccucuauugcugccagaggguauaucagcacacggguggaaaugggcgaggccgcuggaauuuucaugaccgcgacaccucccggcucccgcgaucccuuuccucaaagcaaugcccccaucauggacgaggaaagagagauuccugaacggucuuggaacuccgggcacgagugggucaccgauuucaagggaaagacggugugguuuguuccgagcaucaaagcuggcaaugacaucgccgccugccugagaaagaacgggaaacgcgugauucagcugucucggaagacauucgauagcgaauacgucaaaaccagagcuaaugacugggauuuuguggugaccacagacaucuccgagaugggagccaacuucaaggcggagcgcgucauugauccccggagauguaugaagccuguuauccucaccgacggcgaagagcgcgugauucuggcugggcccaugccugugacacauucuagcgccgcccagcggagaggccgcaucggaagaaaucccaaaaacgaaaaugaccaauauaucuacaugggcgagccgcuugaaaacgaugaggacugcgcucacuggaaggaggccaaaaugcugcucgauaauauuaacaccccugaagggaucauucccuccauguuugagccugaacgggagaaggucgacgcgaucgauggagaauaccgccugagaggcgaggcccggaaaacguucguggaccugaugcgcagaggggaucuccccguuuggcuugcuuaucggguggccgcugagggaauuaauuacgccgacagacgcugguguuuugauggcaucaagaacaaucagauucuggaagagaacgucgaaguggagaucuggacaaaagagggggaacggaagaagcugaaaccuagauggcucgacgcucgcaucuauucugauccccuggcccuuaaggaguucaaagaauucgcggccggccggaagagccugacccucaaccugauuacagagaugggaagacugccgaccuuuaugacgcagaaagcucgggacgcccucgauaaucuugcuguucugcauaccgccgaagccggcgggcgcgcuuacaaccacgcgcuguccgagcucccugagacacuggaaacccuucugcuccugacacugcucgccaccgugacaggaggcaucuuccuuuuucugaugagcgggaagggaauuggcaagaugacccugggcaugugcugcaucauuacggcuucuauccuccugugguaugcccagauccaaccccacuggauugccgcuuccaucauucuugaguucuuucugaucguccuccugauucccgaaccugagaaacagagaacaccgcaggacaaucagcugaccuacguggucaucgccauccucaccgugguugcggccacaauggcuaacgaaaugggguuccuugagaagaccaaaaaggaccugggacugggcagcauuacaacgcaagaguccgaaucuaauauccucgauauugaccugcggcccgccagcgcuuggacccuuuaugccguggcgacaaccuuugugacaccuaugcugcgccauuccaucgagaacucuagcgucaauguuucccucaccgccauugcuaaccaggccacggugcugauggggcugggaaaaggcuggccccucagcaagauggauaucggggugccucuucuggcuauuggauguuacucucaggucaaucccaucacccugacagccgcucuccugcuucugguggcccacuacgcgaucauuggcccuggccuccaggccaaggcuaccagagaagcccaaaaacgggcugccgccgggaucaugaagaacccgacaguugacggaauuaccgugaucgaucuggagcccauuccuuaugaccccaaauucgaaaagcagcugggccaggucaugcuccuuauccugugcgugacgcagguccugaugaugcgcacaaccugggcgcucugugaggcucugacacuugccaccgggccuaucuccacccugugggagggaaaucccggcagauuuuggaacacaacgauugcugugagcauggccaauaucuuccgggggucuuaccucgccggagcuggccugcuguuuuccauuaugaaaaacaccacaaauacccgcagaggcacagggaacaucggagaaacccucggcgagaaguggaagagccggcuuaaugcccuggggaaaucugaauuccaaauuuauaagaaaagcggaauccaggagguugauagaacgcuggcgaaggagggcaucaaacgcggggaaacagaccaucacgccgugucccggggaucugcuaagcucagaugguuugucgagcgcaacauggugaccccggaaggcaaaguuguggaucugggcugcgggcggggaggcuggagcuacuauugugggggacuuaagaacgucagagaggugaagggccugaccaaagggggaccuggccaugaagagcccauucccauguccacauacggcuggaaucucgugcgccugcagagcgggguugacgucuucuucaccccucccgagaagugcgauacacugcucugugacaucggagaauccucuccuaacccgacgauugaggccggccggacccuuagagugcugaaucugguggaaaacuggcucaauaacaauacacaauuuugcgucaaaguucugaaccccuauaugccuagcgugaucgagaagauggaaacccuucagcgcaaauacgggggagcucuggugcggaauccccucuccagaaacucuacacacgagauguacugggucagcaaugccaccggcaacauuguguccucuguuaauaugaucagccgcaugcugaucaaccgguucacgaugaagcacaagaaagcgaccuaugagccugauguggaccugggguccggaacaagaaauauuggcaucgaaagcgagauucccaaccucgacaucauuggcaagcgcaucgaaaaaauuaagcaggagcaugaaaccucuuggcacuacgaucaggaccauccguauaaaacaugggccuaccacggguccuaugagaccaagcaaacaggaagcgcuucuuccauggucaacggcgugguuagacuucugaccaagccuugggaugugguccccauggugacgcagauggccaugacagacaccaccccuuuugggcagcagcggguguucaaagagaaggucgauacacgcacgcaagaacccaaagagggaaccaagaaacugaugaagaucacagcugaauggcucuggaaggagcugggcaaaaagaaaaccccuagaauguguacacgggaggaauuuaccagaaagguucggagcaaugccgcucuuggggccaucuucacagacgagaacaaauggaagucugcgcgcgaagccguggaggauuccagauuuugggaacugauugaccgggagcgcaaucuccaccuggagggaaaaugcgaaaccuguguguacaacaugaugggcaagagagagaagaaacugggcgaauucgggaaggcuaaaggaagccgggccaucugguauauguggcucggcgcucgcuuucuggaguucgaagcccuuggguuucugaaugaggaucauugguucuccagaggaaacagccucucuggcgucgagggggaaggccugcaccggcuuggauacauucugcgcgacgugagcaagaaagagggcggggccauguacgcggaugacacggcuggaugggacaccagaaucacacucgaagaucugaagaaugaggaaaugguuaccaaccauaugaagggcgagcacaaaaagcuggccgaggccauuuuuaaacucacauaucagaauaaggugguccgggugcagcgccccaccccgagagggacgguuauggacaucaucucccggcgcgaucagagaggaucuggccaaguggggacauacggccugaacaccuucacaaauauggaagcucagcuuauucggcagauggagggagaaggcaucuucaaaagcauucaacaucugaccgucacggaggagaucgccgugcagaacuggcucgcuagaguugggcgcgaacggcuguccagaauggccauuucuggagacgauugcguggucaagccucuugacgaucgcuuugcgagcgcccugaccgcucucaaugacaugggcaaggugcggaaagauauccagcagugggagcccuccagaggguggaacgacuggacacaaguccccuucugcucucaccacuuucaugaacuggugaugaaggauggacgcguucugguggucccuugucggaaucaggacgagcucaucggcagagcccgcauuagccagggggcuggcuggucccugaaagaaaccgccugccuuggaaagagcuaugcgcagauguggacacugauguacuuccaccggagagaucuccgccuggccgcuaacgccaucuguucugcugugccgucccauugggugcccaccagccggacaaccuggucuauucacgccaaacacgaguggaugacgacagaggacaugcuugcuguuuggaacagaguguggauccaagaaaauccuuggauggaggacaagacccccgucgaauccugggaggaagugccuuaucugggcaagcgggaggaucaguggugcgggagccucauuggacugaccuccagagccacaugggcgaaaaacauccagaccgccauuaaucagguucgcucucugaucggcaacgaggaauacacagacuauaugcccagcaugaagcgguuuagacgcgaggaagaggaagcuggggugcucugguga

SEQ ID NO: 19998 - RNA, 9876 nt, Artificial Sequence
  derived and/or modified CDS sequence (opt5) from DENV-2__EU482741__SS-prME
accgccggagugaucauuaugcugauccccaccgcuauggccuuccaccucacgaccagaaacggggaaccucauaugauugucggacggcaggaaaagggcaaaucccugcuuuuuaagaccgaagacgggguuaauaugugcacccugauggcgaucgaucucggagaacugugugaagacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggagugcuuggcauggcccucuuccuggaagagaugcugagaacacgcgucgggaccaaacacgccaugcuccuggugguuguguccuuugucacgcuuaucaccggaaacaugucuuuccgggaccugggcagagugaugguuauggugggcgcuacaaugaccgaugacaucgggaugggaauuacauaucucgcccugcuggccgcuuuuaagguccgcccuaccuucgccgcgggccuucugcucagaaaacugacgagcaaggagcucaugauggcuacaaucgggauugcccugcuuucccagucuaccauccccgaaacaauucuggagcucaccgaugcccuggcucugggaaugauggugcuuaaaaucguucggaauauggaaaaguaccagcuggccgugaccaucauggcgauuagcugcgucccuaacgcugugauccuccaaaaugccuggaagguguccuguacaauucuggccgcugucagcguuucuccccuccugcuuacguccagccagcagaaagccgacuggaucccucuggcucucaccauuaagggccugaaccccacagccaucuuucugaccacacuuucucgcaccuccaaaaagagaagcuggccgcugaaugaggcgaucauggccguggggauggugucuauucucgcuuccagccugcucaaaaacgacaucccuaugacgggaccccuggucgccggcggccuucugacagugugcuauguucugaccgggcgguccgcugaucucgaacuggagcgcgccgccgacgugaagugggaggaucaggcugaaauuagcggaucuagcccuauccuuuccauuaccaucucugaggacggcagcauguccauuaaaaaugaagaggaggaacaaacacugaccauccucaucagaacagggcugcucgucauuucuggaguguuccccguuagcaucccgauuacggcggccgcuugguaccugugggaggugaagaagcagcgggccggcguccuuugggaugugccuucucccccucccgucgaaaaagccgagcuggaagacggggcuuaucgcaucaagcagagaggcauucugggcuacagccagaucggcgccgggguguauaaagagggaaccuuucacacaauguggcauguuacccggggcgcggugcucaugcaccgcgggaagagaaucgagcccagcugggcugaugucaaaaaggaccugauuuccuacggaggcggguggaaacuugaaggagaguggaaagaaggcgaggaagugcaaguucuggcccucgagccuggcaagaacccgcgggccgugcagacaaaacccgggcuguucaagaccaauacgggaaccaucggcgcugucagccucgauuuuucuccugggacauccggaagccccauuguggacagaaaaggcaaggugguugggcuguacggaaacggcgucgugacccgcucuggcgccuauguguccgcgaucgcucagacagaaaagagcauugaagauaauccugagaucgaagacgauaucuuccggaaaaagagacuuaccauuauggaccugcaucccggggccggaaaaacaaagcgcuaccugccugccaucguccgggaggcuauuaaaagaggccuccgcacgcugauccuugccccgacccgggugguugcugccgaaauggaggaggcgcugagagggcuccccauucgcuaucagaccccugcgauccgggcugaacacaccggaagagagauuguggaccugaugugucaugccaccuucacaaugcggcuccugucccccguccgcgugccuaacuacaaccuuaucaucauggaugaagcucacuuuacggaccccgccucuauugccgcuagaggcuauaucagcacccggguugagaugggggaggcggccggcauuuucaugacagcuaccccgccuggaucccgcgaucccuuuccccaaagcaaugccccuaucauggacgaagagagagaaauucccgagcggucuuggaacuccggccacgaaugggugacagauuucaaggggaagaccgucugguuugugccuagcaucaaagccggaaaugacaucgcugccugccugagaaagaacggcaaaaagguuauucagcugucucgcaaaacguucgauagcgaguacgugaagacacgggcgaaugacugggauuuugucgugaccaccgacaucuccgagaugggggcuaacuucaaggccgaaagagugauugauccgcgccgguguaugaaacccgucauccucacagacggagaggaaagaguuauucuggccggcccuaugcccgugacccauucuagcgcugcccagcgccgggggagaaucggccgcaauccuaagaacgagaaugaccaauauaucuacaugggagaaccccuugagaacgaugaggacugcgcgcacuggaaagaagccaagaugcugcucgauaauauuaacacaccggagggcaucauuccuuccauguuugaacccgagagagaaaaaguggacgcuaucgauggggaguaccggcugcgcggagaggccagaaagaccuucgucgaccugaugcggcgcggcgaucucccuguguggcuugcuuauagaguugccgcugaagggauuaauuacgccgaccggagaugguguuuugauggaaucaaaaacaaucagauucuggaggaaaacguggaggucgagaucuggacgaaggaaggcgagcgcaagaaacugaagccccgguggcucgacgcgagaaucuauucugauccucuggcccuuaaagaguucaaggaguucgcugccgggcgcaaaagccugacacucaaccugauuaccgaaaugggccggcugcccacauuuaugacccagaaggcuagagacgcccucgauaaucuugccgugcugcauacggcugaggcgggaggccgggccuacaaccacgcucuguccgagcucccggaaacccuggagacacuucugcuccugacccugcucgccacaguuaccgggggaaucuuccuuuuucugaugagcggcaaggggauuggaaaaaugacacugggcaugugcugcaucauuaccgccucuauccuccugugguaugcucagauccaaccucacuggauugccgcguccaucauucuugaguucuuucugaucgugcuccugauucccgagcccgaaaagcagcgcacgccucaggacaaucagcugacauacgucgugaucgccauccucaccgucguggcugccaccauggcuaacgagaugggcuuccuugagaaaacaaagaaagaccuggggcugggaagcauugccacccaagaauccgagucuaauauccucgauauugaccugagaccggcgagcgccuggacacuuuaugcuguugccacgaccuuugugacacccaugcugcggcauuccaucgaaaacucuagcgugaaugucucccucaccgcuauugccaaccaggcuacaguucugaugggccuggggaagggauggccucucagcaagauggauaucggcgugccccuucuggccauuggguguuacucucaggugaauccuaucacccugacggcggcccuccugcuucuggucgcucacuacgccaucauuggacccggccuccaggcuaaagccacccgcgaggcccaaaagagagcggcugccggcaucaugaaaaacccuacaguggacgggauuaccguuaucgaucuggaaccgauucccuaugacccuaaguucgagaaacagcugggacaggugaugcuccuuauccugugcgucacacaggugcugaugaugcggaccacgugggcucucugugaggcccugacacuugccaccggccccaucuccacacugugggaagggaauccuggacgcuuuuggaacaccaccauugcugucagcauggccaauaucuucagaggcucuuaccucgcgggggccggacugcuguuuuccauuaugaagaacacaacgaauacccggcgcggcacaggcaacaucggggagacccucggagaaaaguggaaaagcagacuuaaugcucugggcaagucugaguuccaaauuuauaaaaagagcgggauccaggagguggaucggacacuggccaaagaaggaaucaagagaggcgagaccgaccaucacgcuguuucccgcgggucugccaaacuccggugguuuguggaaagaaacauggucacgcccgagggaaaggugguugaucugggcugcggccgcgggggauggagcuacuauuguggcgggcuuaagaacgugcgggaagucaaaggacugacaaagggcgggccgggacaugaggagccuauucccauguccaccuacggcuggaaucucgugagacugcagagcggcguggacguuuucuucacacccccugaaaaaugcgauacacugcucugugacaucggggaguccucucccaacccuaccauugaagcgggacgcacacuucggguccugaaucugguggagaacuggcucaauaacaauacgcaauuuugcaucaaggugcugaacccguauaugcccagcgucauugagaagauggagacccuucagagaaaguacggcggggcccugguucgcaauccucucucccggaacucuacacacgagauguacugggugagcaaugcuaccggaaacaucguguccucugucaauaugaucagcagaaugcugauuaaccgcuucacaaugaagcacaaaaaggccaccuaugaacccgauguggaccugggcuccgggacgcggaauaucggaauugagagcgaaaucccuaaccucgacauuaucggcaaaagaauugagaagaucaaacaggaacaugagaccucuuggcacuacgaucaggaccaucccuauaagacaugggcuuaccacggcuccuaugagaccaagcaaacagggagcgccucuuccaugguuaacggagugguccgccuucugaccaaaccgugggaugugguuccuauggugacacagauggcuaugaccgacacgacacccuuuggccagcagagagucuucaaggaaaaaguggauacccggacccaagagccuaaggaagggaccaagaagcugaugaagaucacggccgaguggcucuggaaagagcugggaaagaaaaagacaccccgcauguguacaagagaagaguuuacccggaaagugagaagcaaugcggcccuuggcgcuauuuucacagacgaaaacaaguggaaaucugcccgggaggcugucgaagauucccgcuuuugggagcugaucgacagagagcggaaucuccaccuggaagggaagugcgagaccuguguuuacaacaugaugggaaagcgcgagaaaaagcugggcgaguucggcaaagccaaggggagcagagccauuugguauauguggcucggagcgcgguuucuggaguucgaggcucuuggcuuucugaaugaggaucauugguucucccgcgggaacagccucucuggaguggaaggcgaggggcugcacagacuuggcuacauccugcgggacgugagcaaaaaggaaggaggcgccauguacgccgaugacacagcugggugggacacccgcauuacgcucgaggaucugaagaaugaagagauggucaccaaccauaugaaaggagagcacaagaaacuggccgaagcuaucuuuaagcucacauaucagaauaaagugguuagagugcagcggccuacaccccgcggcacagucauggacaucauuuccagacgggaucagcgcgggucuggacaagugggcaccuacgggcugaacacguucacaaauauggaggcccagcuuaucagacagauggaaggcgagggaauuuucaagagcauccaacaucugaccguuacagaggaaauugcggugcagaacuggcucgcccgggucggcagagagcgccugucccggauggcuaucucuggggacgauugcgugguuaagccgcuugacgauagauuugccagcgcucugaccgcccucaaugacaugggaaaagugcgcaaggauauccagcagugggaaccuucccggggcuggaacgacuggacgcaaguccccuucugcucucaccacuuucaugagcuggugaugaaagaugggagaguccuggugguucccugucgcaaucaggacgaacucauuggacgggcgagaaucagccagggcgccggguggucccugaaggagaccgcuugccuuggcaaaagcuaugcccagauguggacacugauguacuuccaccgccgggaucucagacuggcugccaacgcuauuuguucugccgugccuucccauugggucccgaccagccgcacaaccuggucuauccacgcgaagcacgaguggaugacaaccgaagacaugcuugccguguggaaccggguguggauucaagagaaucccuggauggaagacaagacgccuguugaguccugggaagaggugcccuaucugggaaaaagagaggaucaguggugcggcagccucaucgggcugacaucccgggcuaccugggccaagaacauucagaccgccaucaaucaggucagaucucugaucggaaacgaagaguacacagacuauaugccuagcaugaaacgcuuucggagagaagaggaagaggcuggcgugcucugguga

SEQ ID NO: 19999 - RNA, 9876 nt, Artificial Sequence
  derived and/or modified CDS sequence (opt5) from DENV-2__EU482742__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagagcaggacaaacgcuuugugugcaagcauuccaugguggauagaggcuggggcaacggguguggacuguucggcaaggggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaagcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcucccgagauucagaugagcuccggaaaucugcucuuuacaggccaucugaaaugcagacuucggauggauaagcugcagcucaaagggaugucuuacagcauguguaccggaaaguucaagaucgucaaagaaauugcggagacccaacacggcacaaucgugaucagaguccaguaugagggggacggaucccccugcaagauuccuuucgaaaucauggaucuggagaaacgccaugugcugggccggcucauuacgguuaacccgaucgugaccgaaaaggacagccccgucaacauugaggccgaaccucccuuuggggauucuuacaucauuaucggcguggagccuggacagcugaaacuuaauugguucaagaagggcuccagcaucgggcagauguuugagacaaccaugagaggagcuaaacgcauggccauucugggcgacacagccugggauuucgggucucucggaggcguuuuuaccagcaucgggaaggcucugcaccaaguguucggcgccauuuacggagcggcuuuuuccggcgucucuuggacgaugaaaauccugauuggggugaucaucacauggauuggaaugaacagccgguccaccagccuuucugugucccucguucuggucggcguggugacccuguaucucggggccaugguccaggccgacagcggaugugugguuucuuggaaguccaaagaacugaagugcggcagcgggaucuucauuacagauaaugugcacaccuggacagagcaguacaaguuucagcccgaauccccgucuaaacuugcuagcgccauccaaaaggcucaugaggaaggcauuuguggaaucagauccgucacgcgccuggagaaccucauguggaaacagaucaccccugagcugaaucacauucugucugaaaacgaggugaagcuuacaaucaugaccggcgacauuaaagggaucaugcaggccggaaagcggagccucagaccccagccuacagaacugaaauauuccuggaagaccuggggcaaggcgaaaaugcugagcacggagucucauaaucaaaccuuccucauugaugggcccgaaacagccgagugcccuaacaccaaucgcgcuuggaacucccuggagguugaagacuacggauuuggcguguucacaaccaauaucuggcuuaagcugcgggagaaacaggacgucuuuugugauagcaagcucaugucugccgcuaucaaagacaacagagccgugcacgcggauaugggcuauuggauugaauccgcccugaaugacacauggaagauggagaaggcuagcuucaucgagguuaaaucuugccacuggcccaagagccauacccugugguccaacggggugcuugaaagcgagaugauuaucccgaaaaauuucgccggaccugucucucagcacaacuaccgccccggcuaucauacgcagacagcugggcccuggcaccucggaaagcuggaaauggauuuugacuucugugagggcaccaccgugguggucacagaagauugcgggaaccggggaccuucccugagaaccacgacagccagcggcaaacucauuaccgaguggugcugucgguccugcacacugccgccccuucgcuacagaggcgaggacggguguugguacggaauggaaauccggccucugaaggagaaggaagagaaucucguuaacucucuggugaccgccggccaugggcaaauugauaauuuuagccugggagugcuuggcauggcucucuuccuggaagagaugcugagaacacgcgucgggaccaaacacgcgauccuccugguggccguuuccuuugugacgcuuaucaccggaaacaugucuuuccgggaccugggcagagucauggugaugguuggcgcuacaaugaccgaugacauugggaugggagugacauaucucgcccugcuggccgcuuuuaagguccgccccaccuucgccgcgggccuucugcucagaaaacugacgagcaaggagcucaugauggcuacaaucgggauugcccugcuuucccagucuaccaucccugaaacaauucuggagcucaccgaugcccuggcucugggaaugauggugcuuaaaaucguucggaauauggaaaaguaccagcuggccgugaccaucauggcgauuagcugcguccccaacgcugugauccuccaaaaugccuggaagguguccuguacaauucuggccgcugucagcguuucuccucuccugcuuacguccagccagcagaaagccgacuggaucccccuggcucucaccauuaagggccugaacccgacagccaucuuucugaccacacuuucucgcaccuccaaaaagagaagcuggccucugaaugaggcgaucauggccguggggauggugucuauucucgcuuccagccugcucaaaaacgacauccccaugacgggaccucuggucgccggcggccuucugacagugugcuauguucugaccgggcgguccgcugaucucgaacuggagcgcgccgccgacgugaagugggaggaucaggcugaaauuagcggaucuagccccauccuuuccauuaccaucucugaggacggcagcauguccauuaaaaaugaagaggaggaacaaacacugaccauccucaucagaacagggcugcucgucauuucuggaguguucccgguuagcaucccuauuacggcggccgcuugguaccugugggaggugaagaagcagcgggccggcguccuuugggaugugcccuccccuccccccgucgggaaagccgaacuggaggacggagcuuaucgcaucaagcagagaggcauucugggcuacucucagaucggggccggaguguauaaagaaggcaccuuucacacaauguggcauguuacccggggggcggugcucaugcaccgcggaaagagaaucgagccuagcugggcugaugucaaaaaggaccugauuuccuacggcgggggauggaagcuugagggcgaauggaaagagggcgaagaggugcaaguucuggcccucgaaccggggaagaacccccgggccgugcagacaaaaccuggacuguucaagaccaauacgggcaccaucggggcugucagccucgauuuuucucccggaacauccggcagcccuauuguggacagaaaagggaaggugguuggacuguacggcaacggcgucgugacccgcucuggggccuauguguccgcgaucgcucagacagagaagagcauugaggauaaucccgaaaucgaggacgauaucuuccggaaaaagagacuuaccauuauggaccugcauccuggagccggcaaaacaaagcgcuaccugccggccaucguccgggaagcuauuaaaagagggcuccgcacgcugauccuugcccccacccgggugguugcugccgagauggaagaggcgcugagaggacucccuauucgcuaucagacacccgccauccgggcugagcacaccggcagagaaauuguggaccugaugugucaugccaccuucacaaugcggcuccuguccccuguccgcgugcccaacuacaaccuuaucaucauggaugaggcucacuuuacggacccggccucuauugccgcuagaggguauaucagcacccggguugaaaugggcgaggcggccggaauuuucaugacagcuaccccucccggcucccgcgaucccuuuccucaaagcaaugcccccaucauggacgaggaaagagagauuccugaacggucuuggaacuccgggcacgagugggugacagauuucaagggaaagaccgucugguuugugccgagcaucaaagccggcaaugacaucgcugccugccugagaaagaacgggaaaaagguuauucagcugucucgcaaaacguucgauagcgaauacgugaagacacgggcgaaugacugggauuuugucgugaccaccgacaucuccgagaugggagcuaacuucaaggccgagagagugauugauccccgccgguguaugaaaccugucauccucacagacggcgaagagagaguuauucuggccgggcccaugccugugacccauucuagcgcugcccagcgccggggcagaaucggacgcaaucccaagaacgaaaaugaccaauauaucuacaugggcgagccgcuugaaaacgaugaggacugcgcgcacuggaaagaggccaagaugcugcucgauaauauuaacacaccugaagggaucauucccuccauguuugagccugaaagagagaaaguggacgcuaucgauggagaauaccggcugcgcggcgaggccagaaagaccuucgucgaccugaugcggcgcggggaucuccccguguggcuugcuuauagaguugccgcugagggaauuaauuacgccgaccggagaugguguuuugauggcaucaaaaacaaucagauucuggaagagaacguggaagucgagaucuggacgaaggagggggaacgcaagaaacugaagccucgguggcucgacgcgagaaucuauucugauccccuggcccuuaaagaguucaaggaauucgcugccggccgcaaaagccugacacucaaccugauuaccgagaugggacggcugccgacauuuaugacccagaaggcuagagacgcccucgauaaucuugccgugcugcauacggcugaagcgggcgggcgggccuacaaccacgcucuguccgagcucccugagacccuggaaacacuucugcuccugacccugcucgccgccguuacaggaggcaucuuccuuuuucugaugagcgggaagggaauuggcaaaaugacccugggcaugugcugcaucauuacagcuucuauccuccugugguaugcccagauccaaccccacuggauugcggccuccaucauucuugaguucuuucugaucgugcuccugauucccgaaccugagaagcagcgcaccccgcaggacaaucagcugacguacgucgugaucgcuauccucacagucguggccgcuaccauggccaacgaaaugggguuccuugagaaaaccaagaaagaccugggacugggcagcauuacaacccaagaguccgaaucuaauauccucgauauugaccugagacccgcgagcgccuggacacuuuaugcuguugccacgaccuuugugacaccuaugcugcggcauuccaucgagaacucuagcgugaaugucucccucaccgcuauugccaaccaggcuacaguucugauggggcugggaaagggcuggccccucagcaagauggauaucggggugccucuucuggccauuggauguuacucucaggugaaucccaucacccugacggcggcccuccugcuucuggucgcucacuacgccaucauuggcccuggccuccaggcuaaagccacccgcgaagcccaaaagagagcggcugccgggaucaugaaaaacccgacaguggacggaauuaccguuaucgaucuggagcccauuccuuaugaccccaaguucgaaaaacagcugggccaggugaugcuccuuauccugugcgucacacaggugcugaugaugcggaccacgugggcucucugugaggcccugacacuugccaccgggccuaucuccacacugugggagggaaaucccggccgcuuuuggaacaccaccauugcugucagcauggccaauaucuucagagggucuuaccucgcgggagccggccugcuguuuuccauuaugaagaacacaacgaauacccggcgcggcacagggaacaucggagaaacccucggcgagaaguggaaaagcagacuuaaugcucuggggaagucugaauuccaaauuuauaaaaagagcggaauccaggagguggaucggacacuggccaaagagggcaucaagagaggggaaaccgaccaucacgcuguuucccgcggaucugccaaacuccggugguuuguggagagaaacauggucacgccggaaggcaaggugguugaucugggcugcgggcgcggaggcuggagcuacuauugugggggacuuaagaacgugcgggaggucaaaggccugacaaaggggggaccuggccaugaagagcccauucccauguccaccuacggcuggaaucucgugagacugcagagcgggguggacguuuucuucaccccucccgagaaaugcgauacacugcucugugacaucggagaauccucuccuaacccgaccauugaggcgggccgcacacuucggguccugaaucugguggaaaacuggcucaauaacaauacgcaauuuugcaucaaggugcugaaccccuauaugccuagcgucauugagaaaauggaaacccuucagagaaaguacgggggagcccugguucgcaauccccucucccggaacucuacacacgagauguacugggugagcaaugcuaccggcaacaucguguccucugucaauaugaucagcagaaugcugauuaaccgcuucacaaugaagcacaaaaaggccaccuaugagccugauguggaccugggguccggaacgcggaauaucggcauugaaagcgagauccccaaccucgacauuaucggcaaaagaauugaaaagaucaaacaggagcaugaaaccucuuggcacuacgaucaggaccauccguauaagacaugggcuuaccacggguccuaugagaccaagcaaacaggaagcgccucuuccaugguuaacggcgugguccgccuucugaccaaaccuugggaugugguucccauggugacacagauggcuaugaccgacacgacaccuuuugggcagcagagagucuucaaggagaaaguggauacccggacccaagaacccaaggagggaacaaaaaagcugaugaagaucacggccgaauggcucuggaaagagcugggcaagaaaaagaccccucgcauguguacaagagaggaauuuacccggaaagugagaagcaaugcggcccuuggggcuauuuucacagacgagaacaaguggaaaucugcccgggaagcugucgaggauucccgcuuuugggaacugaucgacagagagcggaaucuccaccuggagggaaagugcgaaaccuguguuuacaacaugaugggcaagcgcgagaaaaagcugggcgaauucgggaaagccaagggaagcagagccauuugguauauguggcucggcgcgcgguuucuggaguucgaagcucuuggguuucugaaugaggaucauugguucucccgcggaaacagccucucuggcguggagggggaaggccugcacagacuuggauacauccugcgggacgugagcaaaaaggagggcggggccauguacgccgaugacacagcuggaugggacacccgcauuacgcucgaagaucugaagaaugaggaaauggucaccaaccauaugaaaggcgagcacaagaaacuggccgaggcuaucuuuaagcucacauaucagaauaaagugguuagagugcagcggcccaccccgcgcgggacagucauggacaucauuuccagacgggaucagcgcggaucuggccaaguggggaccuacggccugaacacguucacaaauauggaagcccagcuuaucagacagauggagggagaaggcauuuucaagagcauccaacaucugaccguuacagaggagauugcggugcagaacuggcucgcccgggucgggagagaacgccugucccggauggcuaucucuggagacgauugcgugguuaagccucuugacgauagauuugccagcgcucugaccgcccucaaugacaugggcaaagugcgcaaggauauccagcagugggagcccucccggggguggaacgacuggacgcaaguccccuucugcucucaccacuuucaugaacuggugaugaaagauggaagaguccuggugguuccuugucgcaaucaggacgagcucauuggccgggcgagaaucagccagggggccggcuggucccugaaggaaaccgcuugccuuggaaaaagcuaugcccagauguggacacugauguacuuccaccgccgggaucucagacuggcugccaacgcuauuuguucugccgugccgucccauuggguccccaccagccgcacaaccuggucuauccacgcgaagcacgaguggaugacaaccgaggacaugcuugccguguggaaccggguguggauucaagaaaauccuuggauggaggacaagacgcccguugaauccugggaggaagugccuuaucugggcaaaagagaggaucaguggugcgggagccucaucggacugacaucccgggcuaccugggccaagaacauucagaccgccaucaaucaggucagaucucugaucggcaacgaggaauacacagacuauaugcccagcaugaaacgcuuucggagagaggaagaggaagcuggggugcucugguga

SEQ ID NO: 20000 - RNA, 9876 nt, Artificial Sequence
  derived and/or modified CDS sequence (opt5) from DENV-2__EU482744__SS-prME
acagccggcgugaucauuaugcugauccccacagcuauggccuuccaccucacgacccggaauggggagccucauaugauugucggacggcaggaaaagggcaagucccugcuuuuuaagacagaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugacacuguaucucggggccaugguccaggccgacagcggaugugugguuucuuggaagaauaaagaacugaagugcggcuccgggaucuucauuaccgauaacgugcacacauggacggagcaguacaaguuucagccugaaagccccuccaaacuugcuucugccauccaaaaggcucaugaggaaggcauuuguggaaucagaagcgucacccgccuggagaaucucauguggaaacagaucacaccggagcugaaccacauucuguccgaaaaugaggugaaacuuaccaucaugacaggcgacauuaaagggaucaugcaggccggaaagcggucucucagaccucagcccaccgaacugaaauauagcuggaagacguggggcaaggcgaaaaugcuguccaccgagagccauaaccaaacauuccucauugaugggccugaaaccgccgagugccccaauacaaaccgcgcuuggaacucucuggagguugaagacuacggauuuggcguguucaccacaaacaucuggcuuaagcugcgggagaaacaggacgucuuuugugauuccaagcucaugagcgccgcuaucaaagacaauagagccgugcacgcggauaugggcuauuggauugaaucugcccugaacgacaccuggaagauggagaaggcuuccuucaucgagguuaaaagcugccacuggccuaagucucauacgcuguggagcaauggggugcuugaauccgagaugauuauccccaaaaacuucgccggaccggucagccagcacaacuaccgcccuggcuaucauacacagaccgcugggcccuggcaccucggaaagcuggaaauggauuuugacuucugugagggcaccacagugguggucaccgaagauugcgggaaucggggacccucucugagaacgacaaccgccuccggcaaacucauuacagaguggugcugucggagcugcacccugccuccgcuucgcuacagaggcgaggacggguguugguacggaauggaaauccggccccugaaggagaaggaagagaaccucguuaauucccuggugacagccggccaugggcaaauugauaacuuuucucugggagugcuuggcauggcucucuuccuggaagagaugcugagaacccgcgucgggacgaaacacgcgauccuccugguggccguuagcuuugugacccuuaucacaggaaauauguccuuccgggaccugggcagagucauggugaugguuggcgcuaccaugacagaugacauugggaugggagugaccuaucucgcccugcuggccgcuuuuaagguccgcccuacguucgccgcgggccuucugcucagaaaacugacaucuaaggagcucaugauggcuaccaucgggauugcccugcuuagccaguccacaauccccgaaaccauucuggagcucaccgaugcccuggcucugggaaugauggugcuuaaaaucguucggaacauggaaaaguaccagcuggccgugucuaucauggcgauuagcugcgucccuaaugcugugauccuccaaaacgccuggaagguguccuguacaauucuggccgcugucagcguuucuccccuccugcuuacguccagccagcagaaagccgacuggaucccucuggcucucaccauuaagggccugaaucccacagccaucuuucugaccacacuuucucgcaccuccaaaaagagaagcuggccgcugaacgaggcgaucauggccguggggauggugucuauucucgcuuccagccugcucaaaaaugacaucccuaugacgggaccccuggucgccggcggccuucugacagugugcuauguucugaccgggcgguccgcugaucucgaacuggagcgcgccgccgacgugaagugggaggaucaggcugaaauuagcggaucuagcccuauccuuuccauuaccaucucugaggacggcagcauguccauuaaaaacgaagaggaggaacaaacacugaccauccucaucagaacagggcugcucgucauuucuggaguguuccccguuagcaucccgauuacggcggccgcuugguaccugugggaggugaagaagcagcgggccggcguccuuugggaugugccuucucccccucccgucgggaaagccgaacuggaggacggagcuuaucgcaucaagcagagaggcauucugggcuacagccagaucggggccggaguguauaaagaaggcaccuuucacacaauguggcauguuaccagaggggcggugcucaugcaccgcggaaagagaaucgagcccagcugggcugaugucaaaaaggaccugauuuccuacggcgggggauggaaacuugagggcgaauggaaagagggcgaagaggugcaaguucuggcccucgaaccugggaagaauccgcgggccgugcagacaaaacccggacuguucaagaccaacacgggcaccaucggggcugucagccucgauuuuucuccuggaacauccggcagccccauuguggacagaaaagggaaggugguuggacuguacggcaauggcgucgugacccgcucuggggccuauguguccgcgaucgcucagacagaaaagagcauugaggauaacccugaaaucgaggacgauaucuuccggaaaaagagacuuaccauuauggaccugcaucccggagccggcaaaacaaagcgcuaccugccugccaucguccgggaagcuauuaaaagagggcuccgcacgcugauccuugccccgacccgggugguugcugccgagauggaagaggcgcugagaggacuccccauucgcuaucagaccccugccauccgggcugagcacaccggcagagaaauuguggaccugaugugucaugccaccuucacaaugcggcuccugucccccguccgcgugccuaacuacaaucuuaucaucauggaugaggcucacuuuacggaccccgccucuauugccgcuagaggguauaucagcacccggguugaaaugggcgaggcggccggaauuuucaugacagcuaccccgccuggcucccgcgaucccuuuccccaaagcaacgccccuaucauggacgaggaaagagagauucccgaacggucuuggaacuccgggcacgagugggugacagauuucaagggaaagaccgucugguuugugccuagcaucaaagccggcaacgacaucgcugccugccugagaaagaaugggaaaaagguuauucagcugucucgcaaaacguucgauagcgaauacgugaagacacgggcgaacgacugggauuuugucgugaccaccgacaucuccgagaugggagcuaauuucaaggccgagagagugauugauccgcgccgguguaugaaacccgucauccucacagacggcgaagagagaguuauucuggccgggccuaugcccgugacccauucuagcgcugcccagcgccggggcagaaucggacgcaacccuaagaaugaaaacgaccaauauaucuacaugggcgagccccuugaaaaugaugaggacugcgcgcacuggaaagaggccaagaugcugcucgauaacauuaauacaccggaagggaucauuccuuccauguuugagcccgaaagagagaaaguggacgcuaucgauggagaauaccggcugcgcggcgaggccagaaagaccuucgucgaccugaugcggcgcggggaucucccuguguggcuugcuuauagaguugccgcugagggaauuaacuacgccgaccggagaugguguuuugauggcaucaaaaauaaccagauucuggaagagaacguggaagucgagaucuggacgaaggagggggaacgcaagaaacugaagccccgguggcucgacgcgagaaucuauucugauccucuggcccuuaaagaguucaaggaguucgcugccggccgcaaaagccugacacucaaucugauuaccgagaugggacggcugcccacauuuaugacccagaaggcuagagacgcccucgauaaccuugccgugcugcauacggcugaagcgggcgggcgggccuacaaucacgcucuguccgagcucccggagacccuggaaacacuucugcuccugacccugcucgccacaguuaccggaggcaucuuccuuuuucugaugagcgggaagggaauuggcaaaaugacacugggcaugugcugcaucauuaccgccucuauccuccugugguaugcucagauccaaccucacuggauugccgcguccaucauucuugaguucuuucugaucgugcuccugauucccgaacccgagaagcagcgcacgccucaggacaaccagcugacauacgucgugaucgccauccucaccgucguggcugccaccauggcuaaugaaaugggguuccuugagaaaacaaagaaagaccugggacugggcagcauuaccacacaagaguccgaaucuaacauccucgauauugaccugagaccggccagcgcguggacgcuuuaugccguugcuaccacauuugugacccccaugcugcggcauuccaucgaaaauucuagcgugaacgucucccucacagccauugcuaaucaggccaccguucugauggggcugggaaagggcuggccucucagcaagauggauaucggggugccccuucuggcuauuggauguuacucucaggugaacccuaucacgcugaccgccgcgcuccugcuucuggucgcccacuacgcuaucauuggccccggccuccaggccaaagcuacacgcgaagcccaaaagagagccgcggcugggaucaugaaaaauccuaccguggacggaauuacaguuaucgaucuggagccgauucccuaugacccuaaguucgaaaaacagcugggccaggugaugcuccuuauccugugcgucacccaggugcugaugaugcggacgacaugggcccucugugaggcucugacccuugccacagggcccaucuccacccugugggagggaaacccuggccgcuuuuggaauaccacaauugccgucagcauggcuaacaucuucagagggucuuaccucgccggagcgggccugcuguuuuccauuaugaagaauacgaccaacacacggcgcggcaccgggaauaucggagaaacacucggcgagaaguggaaaagcagacuuaacgcccuggggaagucugaguuccaaauuuauaaaaagagcggaauccaggagguggaucggacccuggcuaaagagggcaucaagagaggggaaacggaccaucacgccguuucccgcggaucugcuaaacuccggugguuuguggagagaaacauggucacacccgaaggcaaggugguugaucugggcugcgggcgcggaggcuggagcuacuauugugggggacuuaagaaugugcgggaggucaaaggccugaccaaagggggaccgggccaugaagaaccuauucccauguccaccuacggcuggaaccucgugagacugcagagcgggguggacguuuucuucacacccccugagaaaugcgauacccugcucugugacaucggagaauccucucccaauccuacaauugaggccggccgcacgcuucggguccugaaccugguggaaaauuggcucaacaauaacacccaauuuugcaucaaggugcugaauccguauaugcccagcgucauugagaaaauggaaacacuucagagaaaguacgggggagcgcugguucgcaacccucucuccagaaauucuacccacgagauguacugggugagcaacgccacaggcaauaucguguccucugucaacaugaucagcagaaugcugauuaaucgcuucaccaugaagcacaaaaaggcuacguaugagcccgauguggaccugggguccggaacccggaacaucggcauugaaagcgagaucccuaaccucgacauuaucggcaaaagaauugaaaagaucaaacaggagcaugaaacaucuuggcacuacgaucaggaccaucccuauaagaccugggccuaccacggguccuaugagacaaagcaaaccggaagcgcuucuuccaugguuaauggcgugguccgccuucugacaaaaccgugggaugugguuccuauggugacccagauggccaugacggacacaacccccuuugggcagcagagagucuucaaggagaaaguggauacccggacacaagaaccuaaggagggaacgaaaaagcugaugaagaucaccgcugaauggcucuggaaagagcugggcaagaaaaagacaccccgcauguguaccagagaggaauuuacacggaaagugagaagcaacgccgcgcuuggggccauuuucaccgacgagaauaaguggaaaucugcucgggaagccgucgaggauucccgcuuuugggaacugaucgacagagagcggaaccuccaccuggagggaaagugcgaaacauguguuuacaauaugaugggcaagcgcgagaaaaagcugggcgaguucgggaaagcuaagggaagcagagccauuugguauauguggcucggcgcccgguuucuggaguucgaagcgcuuggguuucugaacgaggaucauugguucucccgcggaaauagccucucuggcguggagggggaaggccugcacagacuuggauacauccugcgggacgugagcaaaaaggagggcggggcuauguacgccgaugacaccgccggaugggacacgcgcauuacccucgaagaucugaagaacgaggaaauggucacaaaucauaugaaaggcgagcacaagaaacuggcugaggccaucuuuaagcucaccuaucagaacaaagugguuagagugcagcggccuacaccccgcgggaccgucauggacaucauuuccagacgggaucagcgcggaucuggccaaguggggacguacggccugaauacauucaccaacauggaagcucagcuuaucagacagauggagggagaaggcauuuucaagagcauccaacaucugacaguuaccgaggagauugccgugcagaauuggcucgcgcgggucgggagagaacgccugucccggauggccaucucuggagacgauugcgugguuaagccgcuugacgauagauuugcuagcgcccugacggcucucaacgacaugggcaaagugcgcaaggauauccagcagugggagccuucccggggguggaaugacuggacccaaguccccuucugcucucaccacuuucaugaacuggugaugaaagauggaagaguccuggugguucccugucgcaaccaggacgagcucauuggccgggccagaaucagccagggggcgggcuggucccugaaggaaacagccugccuuggaaaaagcuaugcucagauguggacccugauguacuuccaccgccgggaucucagacuggccgcuaacgccauuuguucugcugugccuucccauugggucccgacaagccgcaccacauggucuauccacgccaagcacgaguggaugaccacggaggacaugcuugcgguguggaaucggguguggauucaagaaaaccccuggauggaggacaagacaccuguugaauccugggaggaagugcccuaucugggcaaaagagaggaucaguggugcgggagccucaucggacugaccucccgggccaccugggcuaagaauauucagacagccaucaaccaggucagaucucugaucggcaaugaggaauacaccgacuauaugccuagcaugaaacgcuuucggaaggaggaagaggaagccggggugcucugguga

SEQ ID NO: 20001 - RNA, 9876 nt, Artificial Sequence
  derived and/or modified CDS sequence (opt5) from DENV-2__EU482745__SS-prME
accgccggcgugaucauuaugcugauccccacggcuauggccuuccaccucacgaccagaaacggggagccucauaugauugucggacggcaggaaaagggcaaaagccugcuuuuuaagaccgaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugacacuguaucucggggccaugguccaggccgacagcggaugugugguuucuuggaaguccaaagaacugaagugcggcagcgggaucuucauuaccgauaaugugcacacauggacggagcaguacaaguuucagccugaaucccccucuaaacuugcuagcgccauccaaaaggcucaugaggaaggcauuuguggaaucagauccgucacccgccuggagaaccucauguggaaacagaucacaccggagcugaaucacauucugucugaaaacgaggugaaacuuaccaucaugacaggcgacauuaaagggaucaugcaggccggaaagcggagccucagaccucagcccaccgaacugaaauauuccuggaagacguggggcaaggcgaaaaugcugagcaccgagucucauaaucgcacauuccucauugaugggccugaaaccgccgagugccccaacacaaaucgggcuuggaacucccuggagguugaagacuacggauuuggcguguucaccacaaauaucuggcuuaagcugagagagaaacaagacgucuuuugugauagcaagcucaugucugccgcuaucaaagacaaccgcgccgugcacgcggauaugggcuauuggauugaauccgcccugaaugacaccuggaagauggagaaggcuagcuucaucgagguuaaaucuugccacuggccuaagagccauacgcugugguccaacggggugcuugaaagcgagaugauuauccccaaaaauuucgccggaccggucucucagcacaacuaccggccuggcuaucauacacagaccgcugggcccuggcaccucggaaagcuggaaauggauuuugacuucugugagggcaccacagugguggucaccgaagauugcgggaacagaggacccucccugcggacgacaaccgccagcggcaaacucauuacagaguggugcugucgcuccugcacccugccuccgcuuagauaccggggcgaggacggguguugguacggaauggaaaucagaccccugaaggagaaggaagagaaucucguuaacucucuggugacagccggccaugggcagauugauaauuuuagccugggagugcuuggcauggcucucuuccuggaagagaugcugcgcacccgggucgggacgaaacacgcgauccuccugguggccguuuccuuugugacccuuaucacaggaaacaugucuuucagagaccugggccgcgucauggugaugguuggcgcuaccaugacagaugacauugggaugggagugaccuaucucgcccugcuggccgcuuuuaaggucagaccuacguucgccgcgggccuucugcuccggaaacugacaagcaaggagcucaugauggcuaccaucgggauugcccugcuuucccaaucuacaauccccgaaaccauucuggagcucaccgaugcccuggcucugggaaugauggugcuuaaaaucguucgcaauauggaaaaguaccagcuggccgugacaaucauggcgauuagcugcgucccuaacgcugugauccuccagaaugccuggaagguguccuguacgauucuggccgcugucagcguuucuccccuccugcuuaccuccagccaacagaaagccgacuggaucccucuggcucucacaauuaagggccugaaccccaccgccaucuuucugacaacccuuucuagaacguccaaaaagcggagcuggccgcugaaugaggcgaucauggccguggggauggugucuauucucgcuuccagccugcucaaaaacgacaucccuaugacaggaccccuggucgccggcggccuucugaccgugugcuauguucugaccgggcgcuccgcugaucucgaacuggagagagccgccgacgugaagugggaggaucaggcugaaauuagcggaucuagcccuauccuuuccauuacaaucucugaggacggcagcauguccauuaaaaaugaagaggaggaacagacccugacaauccucauccggacggggcugcucgucauuucuggaguguuccccguuagcaucccgauuaccgcggccgcuugguaccugugggaggugaagaagcaacgcgccggcguccuuugggaugugccuucucccccucccgucgggaaagccgaacuggaggacggagcuuauagaaucaagcagcggggcauucugggcuacagccagaucggggccggaguguauaaagaaggcacauuucacaccauguggcauguuacacgcggggcggugcucaugcacagaggaaagcggaucgagcccagcugggcugaugucaaaaaggaccugauuuccuacggcgggggauggaaacuugagggcgaauggaaagagggcgaagaggugcagguucuggcccucgaaccugggaagaacccgagagccgugcaaaccaaacccggacuguucaagacgaauaccggcacaaucggggcugucagccucgauuuuucuccuggaaccuccggcagccccauuguggaccgcaaagggaaggugguuggacuguacggcaacggcgucgugacacggucuggggccuauguguccgcgaucgcucagaccgaaaagagcauugaggauaauccugaaaucgaggacgauaucuuccgcaagaagcgccuuacaauuauggaccugcaucccggagccggcaaaacgaagcgguaccugccugccaucgucagagaagcuauuaaacgcgggcuccggacccugauccuugccccgacaagagugguugcugccgagauggaagaggcgcugcgcggacuccccauucgguaucagaccccugccaucagagcugagcacaccggccgggaaauuguggaccugaugugucaugccacauucacgaugcgccuccugucccccgucagagugccuaacuacaaccuuaucaucauggaugaggcucacuuuaccgaccccgccucuauugccgcucggggguauaucagcacacgcguugaaaugggcgaggcggccggaauuuucaugaccgcuacaccgccuggcuccagagaucccuuuccccagagcaaugccccuaucauggacgaggaacgggagauucccgaaagaucuuggaacuccgggcacgagugggugaccgauuucaagggaaagacggucugguuugugccuagcaucaaagccggcaaugacaucgcugccugccugcgcaagaacgggaaaaagguuauucaacugucucggaaaacauucgauagcgaauacgugaagaccagagcgaaugacugggauuuugucgugaccacagacaucuccgagaugggagcuaacuucaaggccgagcgcgugauugauccgcggagauguaugaaacccgucauccucaccgacggcgaagaaagaguuauucuggccgggccuaugcccgugacacauucuagcgcugcccagcggagaggccgcaucggaagaaauccuaagaacgaaaaugaccaguauaucuacaugggcgagccccuugaaaacgaugaggacugcgcgcacuggaaagaggccaagaugcugcucgauaauauuaacaccccggaagggaucauuccuuccauguuugagcccgaacgggagaaaguggacgcuaucgauggagaauaccgccugagaggcgaggcccggaagacguucgucgaccugaugcgcagaggggaucucccuguguggcuugcuuaucggguugccgcugagggaauuaauuacgccgacagacgcugguguuuugauggcaucaaaaacaaucaaauucuggaagagaacguggaagucgagaucuggacaaaggagggggaacggaagaaacugaagcccagauggcucgacgcgcgcaucuauucugauccucuggcccuuaaagaguucaaggaguucgcugccggccggaaaagccugacccucaaccugauuacagagaugggaagacugcccaccuuuaugacgcagaaggcucgggacgcccucgauaaucuugccgugcugcauaccgcugaagcgggcgggcgcgccuacaaccacgcucuguccgagcucccggagacacuggaaacccuucugcuccugacacugcucgccaccguuacaggaggcaucuuccuuuuucugaugagcgggaagggaauuggcaaaaugacccugggcaugugcugcaucauuacggccucuauccuccugugguaugcucagauccagccucacuggauugccgcguccaucauucuugaguucuuucugaucgugcuccugauucccgaacccgagaagcaaagaacaccucaggacaaucagcugaccuacgucgugaucgccauccucaccgucguggcugccacaauggcuaacgaaaugggguuccuugagaaaaccaagaaagaccugggacugggcagcauuacaacgaaggaguccgaaucuaauauccucgauauugaccugcggccggccagcgcguggacccuuuaugccguugcuacaaccuuugugacacccaugcugcgccauuccaucgagaacucuagcgugaaugucucccucaccgccauugcuaaccaggccacgguucugauggggcugggaaagggcuggccucucagcaaaauggauaucggggugccccuucuggcuauuggauguuacucucaagugaauccuaucacccugacagccgcgcuccugcuucuggucgcccacuacgcuaucauuggccccggccuccaggccaaggcuaccagagaagcccagaaacgggccgcggcugggaucaugaagaacccuacaguggacggaauuaccguuaucgaucuggagccgauucccuaugacccuaaauucgaaaagcagcugggccaagugaugcuccuuauccugugcgucacacaggugcugaugaugcgcacaaccugggcccucugugaggcucugacacuugccaccgggcccaucuccacccugugggagggaaauccuggcagauuuuggaacacaacgauugccgucagcauggcuaauaucuuccgggggucuuaccucgccggagcgggccugcuguuuuccauuaugaagaacaccacaaauacccgcagaggcacagggaacaucggagaaacccucggcgagaaauggaagucccggcuuaaugcccuggggaaaucugaguuccagauuuauaagaaaagcggaauccaggagguggauagaacgcuggcuaaggagggcaucaaacgcggggaaacagaccaucacgccguuucccggggaucugcuaagcucagaugguuuguggagcgcaacauggucacccccgaaggcaaggugguugaucugggcugcgggcggggaggcuggagcuacuauugugggggacuuaaaaacgugagagaggucaagggccugaccaaagggggaccgggccaugaagaaccuauucccauguccacauacggcuggaaucucgugcgccugcaaagcgggguggacguuuucuucacacccccugagaagugcgauacacugcucugugacaucggagaauccucucccaacccuacgauugaggccggccggacccuuagaguccugaaucugguggaaaacuggcucaauaacaauacacaguuuugcaucaaagugcugaacccguauaugcccagcgucauugagaagauggaaacccuucagcgcaaguacgggggagcgcugguucggaauccucucuccagaaacucuacacacgagauguacugggugagcaaugccaccggcaacaucguguccucugucaauaugaucagccgcaugcugauuaaccgguucacgaugaaacacaagaaagcuaccuaugagcccgauguggaccugggguccggaacaagaaauaucggcauugaaagcgagaucccuaaccucgacauuaucggcaagcgcauugagaagaucaagcaagagcaugaaaccucuuggcacuacgaucaggaccaucccuauaagacaugggccuaccacggguccuaugagaccaaacagacaggaagcgcuucuuccaugguuaacggcguggucagacuucugaccaagccgugggaugugguuccuauggugacgcagauggccaugacagacaccacccccuuugggcaacagcgggucuucaaagagaagguggauacacgcacgcaggaaccuaaagagggaaccaagaagcugaugaaaaucacagcugaauggcucuggaaggagcugggcaaaaagaaaacccccagaauguguacacgggaggaauuuaccagaaaggugcggagcaaugccgcgcuuggggccauuuucacagacgagaacaaauggaagucugcucgcgaagccgucgaggauuccagauuuugggaacugaucgaccgggagcgcaaucuccaccuggagggaaagugcgaaaccuguguuuacaacaugaugggcaaaagagagaagaaacugggcgaguucgggaaggcuaaaggaagccgggccauuugguauauguggcucggcgcccgcuuucuggaguucgaagcgcuuggguuucugaaugaggaucauugguucuccagaggaaacagccucucuggcguggagggggaaggccugcaccggcuuggauacauccugcgcgacgugagcaagaaggagggcggggcuauguacgccgaugacacggccggaugggacaccagaauuacacucgaagaucugaaaaaugaggaaauggucaccaaccauaugaagggcgagcacaaaaagcuggcugaggccaucuuuaaacucacauaucagaauaaggugguucgggugcaacgcccuacccccagagggacggucauggacaucauuucccggcgcgaucagagaggaucuggccagguggggacauacggccugaacaccuucacaaauauggaagcucagcuuauccggcaaauggagggagaaggcauuuucaagagcauccagcaucugaccguuacggaggagauugccgugcagaacuggcucgcgagagucgggcgcgaacggcuguccagaauggccaucucuggagacgauugcgugguuaaaccgcuugacgaucgcuuugcuagcgcccugaccgcucucaaugacaugggcaaggugcggaaagauauccaacagugggagccuuccagaggguggaacgacuggacacagguccccuucugcucucaccacuuucaugaacuggugaugaaggauggacgcguccuggugguucccugucggaaucaggacgagcucauuggcagagcccgcaucagccaaggggcgggcuggucccugaaagaaaccgccugccuuggaaagagcuaugcucagauguggacacugauguacuuccaccggagagaucuccgccuggccgcuaacgccauuuguucugcugugccuucccauugggucccgaccagccggacaaccuggucuauccacgccaagcacgaguggaugacgacagaggacaugcuugcgguguggaacagaguguggauucaggaaaaucccuggauggaggacaaaaccccuguugaauccugggaggaagugcccuaucugggcaagcgggaggaucaguggugcgggagccucaucggacugaccuccagagccacaugggcuaaaaacauucaaaccgccaucaaucaggucaagucucugaucggcaacgaggaauacacagacuauaugccuagcaugaaacgcuuucggagagaggaagaggaagccggggugcucugguga

SEQ ID NO: 20002 - RNA, 9876 nt, Artificial Sequence
  derived and/or modified CDS sequence (opt5) from DENV-2__EU482746__SS-prME
accgccggcgugaucauuaugcugauccccacggcuauggccuuccaccucacgaccagaaacggggagccucauaugauugucggacggcaggaaaagggcaagucccugcuuuuuaagaccgaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugacacuguaucucggggccaugguccaggccgacagcggaugugugguuucuuggaaguccaaagaacugaagugcggcagcgggaucuucauuaccgauaaugugcacacauggacggagcaguacaaguuucagccugaaucccccucuaaacuugcuagcgccauccaaaaggcucaugaggaaggcauuuguggaaucagauccgucacccgccuggagaaccucauguggaaacagaucacaccggagcugaaucacauucugucugaaaacgaggugaaacuuaccaucaugacaggcgacauuaaagggaucaugcaggccggaaagcggagccucagaccucagcccaccgaacugaaauauuccuggaagacguggggcaaggcgaaaaugcugagcaccgagucucauaaucgcacauuccucauugaugggccugaaaccgccgagugccccaacacaaaucgggcuuggaacucccuggagguugaagacuacggauuuggcguguucaccacaaauaucuggcuuaagcugagagagaaacaagacgucuuuugugauagcaagcucaugucugccgcuaucaaagacaaccgcgccgugcacgcggauaugggcuauuggauugaauccgcccugaaugacaccuggaagauggagaaggcuagcuucaucgagguuaaaucuugccacuggccuaagagccauacgcugugguccaacggggugcuugaaagcgagaugauuauccccaaaaauuucgccggaccggucucucagcacaacuaccggccuggcuaucauacacagaccgcugggcccuggcaccucggaaagcuggaaauggauuuugacuucugugagggcaccacagugguggucaccgaagauugcgggaacagaggacccucccugcggacgacaaccgccagcggcaaacucauuacagaguggugcugucgcuccugcacccugccuccgcuuagauaccggggcgaggacggguguugguacggaauggaaaucagaccccugaaggagaaggaagagaaucucguuaacucucuggugacagccggccaugggcagauugauaauuuuagccugggagugcuuggcauggcucucuuccuggaagagaugcugcgcacccgggucgggacgaaacacgcgauccuccugguggccguuuccuuugugacccuuaucacaggaaacaugucuuucagagaccugggccgcgucauggugaugguuggcgcuaccaugacagaugacauugggaugggagugaccuaucucgcccugcuggccgcuuuuaaggucagaccuacguucgccgcgggccuucugcuccggaaacugacaagcaaggagcucaugauggcuaccaucgggauugcccugcuuucccaaucuacaauccccgaaaccauucuggagcucaccgaugcccuggcucugggaaugauggugcuuaaaaucguucgcaauauggaaaaguaccagcuggccgugacaaucauggcgauuagcugcgucccuaacgcugugauccuccagaaugccuggaagguguccuguacgauucuggccgcugucagcguuucuccccuccugcuuaccuccagccaacagaaagccgacuggaucccucuggcucucacaauuaagggccugaaccccaccgccaucuuucugacaacccuuucuagaacguccaaaaagcggagcuggccgcugaaugaggcgaucauggccguggggauggugucuauucucgcuuccagccugcucaaaaacgacaucccuaugacaggaccccuggucgccggcggccuucugaccgugugcuauguucugaccgggcgcuccgcugaucucgaacuggagagagccgccgacgugaagugggaggaucaggcugaaauuagcggaucuagcccuauccuuuccauuacaaucucugaggacggcagcauguccauuaaaaaugaagaggaggaacagacccugacaauccucauccggacggggcugcucgucauuucuggaguguuccccguuagcaucccgauuaccgcggccgcuugguaccugugggaggugaagaagcaacgcgccggcguccuuugggaugugccuucucccccucccgucgggaaagccgaacuggaggacggagcuuauagaaucaagcagcggggcauucugggcuacagccagaucggggccggaguguauaaagaaggcacauuucacaccauguggcauguuacacgcggggcggugcucaugcacagaggaaagcggaucgagcccagcugggcugaugucaaaaaggaccugauuuccuacggcgggggauggaaacuugagggcgaauggaaagagggcgaagaggugcagguucuggcccucgaaccugggaagaacccgagagccgugcaaaccaaacccggacuguucaagacgaauaccggcacaaucggggcugucagccucgauuuuucuccuggaaccuccggcagccccauuguggaccgcaaagggaaggugguuggacuguacggcaacggcgucgugacacggucuggggccuauguguccgcgaucgcucagaccgaaaagagcauugaggauaauccugaaaucgaggacgauaucuuccgcaagaagcgccuuacaauuauggaccugcaucccggagccggcaaaacgaagcgguaccugccugccaucgucagagaagcuauuaaacgcgggcuccggacccugauccuugccccgacaagagugguugcugccgagauggaagaggcgcugcgcggacuccccauucgguaucagaccccugccaucagagcugagcacaccggccgggaaauuguggaccugaugugucaugccacauucacgaugcgccuccugucccccgucagagugccuaacuacaaccuuaucaucauggaugaggcucacuuuaccgaccccgccucuauugccgcucggggguauaucagcacacgcguugaaaugggcgaggcggccggaauuuucaugaccgcuacaccgccuggcuccagagaucccuuuccccagagcaaugccccuaucauggacgaggaacgggagauucccgaaagaucuuggaacuccgggcacgagugggugaccgauuucaagggaaagacggucugguuugugccuagcaucaaagccggcaaugacaucgcugccugccugcgcaagaacgggaaaaagguuauucaacugucucggaaaacauucgauagcgaauacgugaagaccagagcgaaugacugggauuuugucgugaccacagacaucuccgagaugggagcuaacuucaaggccgagcgcgugauugauccgcggagauguaugaaacccgucauccucaccgacggcgaagaaagaguuauucuggccgggccuaugcccgugacacauucuagcgcugcccagcggagaggccgcaucggaagaaauccuaagaacgaaaaugaccaguauaucuacaugggcgagccccuugaaaacgaugaggacugcgcgcacuggaaagaggccaagaugcugcucgauaauauuaacaccccggaagggaucauuccuuccauguuugagcccgaacgggagaaaguggacgcuaucgauggagaauaccgccugagaggcgaggcccggaagacguucgucgaccugaugcgcagaggggaucucccuguguggcuugcuuaucggguugccgcugagggaauuaauuacgccgacagacgcugguguuuugauggcaucaaaaacaaucaaauucuggaagagaacguggaagucgagaucuggacaaaggagggggaacggaagaaacugaagcccagauggcucgacgcgcgcaucuauucugauccucuggcccuuaaagaguucaaggaguucgcugccggccggaaaagccugacccucaaccugauuacagagaugggaagacugcccaccuuuaugacgcagaaggcucgggacgcccucgauaaucuugccgugcugcauaccgcugaagcgggcgggcgcgccuacaaccacgcucuguccgagcucccggagacacuggaaacccuucugcuccugacacugcucgccaccguuacaggaggcaucuuccuuuuucugaugagcgggaagggaauuggcaaaaugacccugggcaugugcugcaucauuacggccucuauccuccugugguaugcucagauccagccucacuggauugccgcguccaucauucuugaguucuuucugaucgugcuccugauucccgaacccgagaagcaaagaacaccucaggacaaucagcugaccuacgucgugaucgccauccucaccgucguggcugccacaauggcuaacgaaaugggguuccuugagaaaaccaagaaagaccugggacugggcagcauuacaacgcaggaguccgaaucuaauauccucgauauugaccugcggccggccagcgcguggacccuuuaugccguugcuacaaccuuugugacacccaugcugcgccauuccaucgagaacucuagcgugaaugucucccucaccgccauugcuaaccaagccacgguucugauggggcugggaaagggcuggccucucagcaagauggauaucggggugccccuucuggcuauuggauguuacucucaggugaauccuaucacccugacagccgcgcuccugcuucuggucgcccacuacgcuaucauuggccccggccuccaggccaaagcuaccagagaagcccagaagcgggccgcggcugggaucaugaaaaacccuacaguggacggaauuaccguuaucgaucuggagccgauucccuaugacccuaaguucgaaaaacaacugggccaggugaugcuccuuauccugugcgucacacaggugcugaugaugcgcacaaccugggcccucugugaggcucugacacuugccaccgggcccaucuccacccugugggagggaaauccuggcagauuuuggaacacaacgauugccgucagcauggcuaauaucuuccgggggucuuaccucgccggagcgggccugcuguuuuccauuaugaagaacaccacaaauacccgcagaggcacagggaacaucggagaaacccucggcgagaaguggaaaagccggcuuaaugcccuggggaagucugaguuccagauuuauaaaaagagcggaauccaagagguggauagaacgcuggcuaaagagggcaucaagcgcggggaaacagaccaucacgccguuucccggggaucugcuaaacucagaugguuuguggagcgcaacauggucacccccgaaggcaaggugguugaucugggcugcgggcggggaggcuggagcuacuauugugggggacuuaagaacgugagagaggucaaaggccugaccaaagggggaccgggccaugaggaaccuauucccauguccacauacggcuggaaucucgugcgccugcagagcgggguggacguuuucuucacacccccugagaaaugcgauacacugcucugugacaucggagaauccucucccaacccuacgauugaggccggccggacccuuagaguccugaaucugguggaaaacuggcucaauaacaauacacaguuuugcaucaaggugcugaacccguauaugcccagcgucauugagaaaauggaaacccuucaacgcaaguacgggggagcgcugguucggaauccucucuccagaaacucuacacacgagauguacugggugagcaaugccaccggcaacaucguguccucugucaauaugaucagccgcaugcugauuaaccgguucacgaugaagcacaaaaaggcuaccuaugagcccgauguggaccugggguccggaacaagaaauaucggcauugaaagcgagaucccuaaccucgacauuaucggcaaacgcauugaaaagaucaaacaggagcaugaaaccucuuggcacuacgaucaggaccaucccuauaagacaugggccuaccacggguccuaugagaccaagcagacaggaagcgcuucuuccaugguuaacggcguggucagacuucugaccaaaccgugggaugugguuccuauggugacgcaaauggccaugacagacaccacccccuuugggcagcagcgggucuucaaggagaaaguggauacacgcacgcaggaaccuaaggagggaaccaaaaagcugaugaagaucacagcugaauggcucuggaaagagcugggcaagaaaaagacccccagaauguguacacgggaggaauuuaccagaaaagugcggagcaaugccgcgcuuggggccauuuucacagacgagaacaaguggaaaucugcucgcgaagccgucgaggauuccagauuuugggaacugaucgaccgggagcgcaaucuccaccuggagggaaagugcgaaaccuguguuuacaacaugaugggcaagagagagaaaaagcugggcgaguucgggaaagcuaagggaagccgggccauuugguauauguggcucggcgcccgcuuucuggaguucgaagcgcuuggguuucugaaugaggaucauugguucuccagaggaaacagccucucuggcguggagggggaaggccugcaccggcuuggauacauccugcgcgacgugagcaaaaaggagggcggggcuauguacgccgaugacacggccggaugggacaccagaauuacacucgaagaucugaagaaugaggaaauggucaccaaccauaugaaaggcgagcacaagaaacuggcugaggccaucuuuaagcucacauaucaaaauaaagugguucgggugcagcgcccuacccccagagggacggucauggacaucauuucccggcgcgaucagagaggaucuggccagguggggacauacggccugaacaccuucacaaauauggaagcucaacuuauccggcagauggagggagaaggcauuuucaagagcauccagcaucugaccguuacggaggagauugccgugcaaaacuggcucgcgagagucgggcgcgaacggcuguccagaauggccaucucuggagacgauugcgugguuaagccgcuugacgaucgcuuugcuagcgcccugaccgcucucaaugacaugggcaaagugcggaaggauauccagcagugggagccuuccagaggguggaacgacuggacacagguccccuucugcucucaccacuuucaugaacuggugaugaaagauggacgcguccuggugguucccugucggaaucaagacgagcucauuggcagagcccgcaucagccagggggcgggcuggucccugaaggaaaccgccugccuuggaaaaagcuaugcucagauguggacacugauguacuuccaccggagagaucuccgccuggccgcuaacgccauuuguucugcugugccuucccauugggucccgaccagccggacaaccuggucuauccacgccaagcacgaguggaugacgacagaggacaugcuugcgguguggaacagaguguggauucaggaaaaucccuggauggaggacaagaccccuguugaauccugggaggaagugcccuaucugggcaaacgggaggaucaauggugcgggagccucaucggacugaccuccagagccacaugggcuaagaacauucagaccgccaucaaucagguccgcucucugaucggcaacgaggaauacacagacuauaugccuagcaugaaacgguuuagacgcgaggaagaggaagccggggugcucugguga

SEQ ID NO: 20003 - RNA, 9876 nt, Artificial Sequence
  derived and/or modified CDS sequence (opt5) from DENV-2__EU482590__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagagcaggacaaacgcuuugugugcaagcauuccaugguggauagaggcuggggcaacggguguggacuguucggcaaggggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaagcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccguucugggcgacaccgccugggauuucgggucucucggaggcguguuuacgagcauugggaaggcucugcaccaagucuucggcgccaucuacggagcggcuuuuuccggcgugucuuggacaaugaaaauucugaucggggugauuaucaccuggaucggaaugaacagccgguccaccagccuuucuguuucccucguccuggugggcguggucacacuguaucucggggccauggugcaggccgacagcggauguguugugucuuggaagaauaaagaacugaagugcggcuccgggauuuucaucaccgauaacguccacacauggacggagcaguacaaguuucagccugaaagccccuccaaacuugcuucugccauucaaaaggcucaugaggaaggcaucuguggaauuagaagcgugacccgccuggagaaucucauguggaaacagaucacaccggagcugaaccacauccuguccgaaaaugagguuaagcuuaccauuaugacaggcgacaucaaagggauuaugcaggccggaaagcggucucucagaccucagcccaccgaacugaaauauagcuggaagacguggggcaaggcgaaaaugcuguccaccgagccucauaaccaaacauuccucaucgaugggcccgaaaccgccgagugcccuaauacaaaccgcgcuuggaauagccuggagguggaagacuacggauuuggcgucuucaccacaaacauuuggcuuaagcugcgggagaaacaggacguguuuugugauucuaagcucauguccgccgcuaucaaagacaauagagccguucacgcggauaugggcuauuggaucgaaagcgcccugaacgacaccuggaagauggagaaggcuucuuucauugaggugaaauccugccacuggcccaagagccauacgcuguggucuaaugggguccuugaaagcgagaugaucauuccgaaaaacuucgccggaccugugucccagcacaacuaccgccccggcuaucauacacagaccgcugggcccuggcaccucggaaagcuggaaauggauuuugacuucugugagggcaccacaguggucguuaccgaagauugcgggaaucggggaccuagccugagaacgacaaccgccucuggcaaacucaucacagaguggugcugucgguccugcacccugccgccccuucgcuacagaggcgaggacggguguugguacggaauggaaauucggccucugaaggagaaggaagagaaccucgugaauagccuggugacagccggccaugggcaaaucgauaacuuuucccugggaguccuuggcauggcucucuuccuggaagagaugcugagaacccgcguggggacgaaacacgcgauucuccugguugccgugucuuuugucacccuuaucacaggaaauaugagcuuccgggaccugggcagagugaugguuauggugggcgcuaccaugacagaugacaucgggaugggagucaccuaucucgcccugcuggccgcuuuuaaggugcgccccacguucgccgcgggccuucugcucagaaaacugacauccaaggagcucaugauggcuaccauugggaucgcccugcuuucucagagcacaauuccugaaaccauccuggagcucaccgaugcccuggcucugggaaugaugguucuuaaaauugugcggaacauggaaaaguaccagcuggccgucacaaucauggcgaucuccugcgugcccaaugcugugauucuccaaaacgccuggaaggucucuuguacgauccuggccgcuguuagcguguccccucuccugcuuaccagcucucagcagaaagccgacuggauuccccuggcucucacaaucaagggccugaauccgaccgccauuuuucugacaacccuuucccgcacgagcaaaaagagaucuuggccucugaacgaggcgaucauggccguggggauggucuccauccucgcuagcucucugcucaaaaaugacauucccaugacaggaccucugguggccggcggccuucugaccguuugcuaugugcugaccgggcgguccgcugaucucgaacuggagcgcgccgccgacgucaagugggaggaucaggcugaaaucagcggauccagccccauucuuucuaucacaauuagcgaggacggcuccaugucuaucaaaaacgaagaggaggaacaaacccugacaauucucaucagaacggggcugcucgugaucagcggaguuuucccgguguccauuccuaucaccgcggccgcuugguaccugugggaggucaagaagcagcgggccggcgugcuuugggauguccccucuccuccccccguggggaaagccgaacuggaggacggagcuuaucgcauuaagcagagaggcauccugggcuacagccagauuggggccggaguuuauaaagaaggcacauuucacaccauguggcaugugacacggggggcgguccucaugcaccgcggaaagagaaucgagccuuccugggcugaugugaaaaaggaccugaucucuuacggcgggggauggaagcuugagggcgaauggaaagagggcgaagagguucaagugcuggcccucgaaccggggaagaauccccgggccguccagaccaaaccuggacuguucaagacgaacaccggcacaauuggggcugugagccucgauuuuucccccggaaccagcggcucuccuaucguggacagaaaagggaagguugucggacuguacggcaauggcguggugacacgcuccggggccuaugucagcgcgauugcucagaccgagaagucuaucgaggauaaccccgaaauugaggacgauaucuuccggaaaaagagacuuacaaucauggaccugcauccuggagccggcaaaacgaagcgcuaccugccggccauugugcgggaagcuaucaaaagagggcuccgcacccugauucuugcccccacacggguuguggcugccgagauggaagaggcgcugagaggacucccuauccgcuaucagacccccgccauucgggcugagcacaccggcagagaaaucgucgaccugaugugucaugccacauucacgaugcggcuccuguccccugugcgcguucccaacuacaaucuuauuaucauggaugaggcucacuuuaccgacccggccagcaucgccgcuagaggguauauuuccacacggguggaaaugggcgaggcggccggaaucuucaugaccgcuacaccucccggcucucgcgaucccuuuccucaaagcaacgcccccauucuggacgaggaaagagagaucccugaacgguccuggaauagcgggcacgagugggucaccgauuucaagggaaagacggugugguuuguuccgucuauuaaagccggcaacgacaucgcugccugccugagaaagaaugggaaaaaggugauccagcucucccgcaaaacauucgauagcgaauacgucaagacccgggcgaacgacugggauuuuguggugaccacagacauuucugagaugggagcuaauuucaaggccgagagagucaucgauccccgccgguguaugaaaccuguuauucugaccgacggcgaagagagagugauccuugccgggcccaugccugugacacauagcuccgcugcccagcgccggggcagaauuggacgcaaccccaagaaugaaaacgaccaauauaucuacaugggcgagccgcuggaaaaugaugaggacugcgcgcacuggaaagaggccaagaugcuccuggauaacaucaauaccccugaagggauuauccccucuauguuugagccugaaagagagaaagucgacgcuauugauggagaauaccggcugcgcggcgaggccagaaagacguucguggaccucaugcggcgcggggaucuucccguuuggcuggcuuauagaguggccgcugagggaaucaacuacgccgaccggagaugguguuuugauggcauuaaaaauaaccagauccuggaagagaacgucgaaguggagauuuggacaaaggagggggaacgcaagaaacucaagccucgguggcuggacgcgagaaucuauagcgauccccuugcccugaaagaguucaaggaauucgcugccggccgcaaaucccucacccugaaucugaucacagagaugggacggcucccgaccuuuaugacgcagaaggcuagagacgcccuugauaaccuggccguucugcauaccgcugaagugggcgggcgggcguacaaucacgcccucucugagcugccugagacacuugaaacccugcuccugcugacacuccuugcuaccgucacaggaggcauuuuccuguuucugaugagcgggaagggaaucggcaaaaugacccucggcaugugcugcauuaucacggccuccauucugcuuugguaugcccagauccaaccccacuggaucgcugccagcauuauccuggaguucuuucucauugugcugcugauccccgaaccugagaagcagcgcacaccgcaggacaaccagcucaccuacgucgugauugcgauccuuaccguuguggccgcuacaauggccaaugaaaugggguuccuggagaaaaccaagaaagaccugggacucggcucuaucacaacgcaagaguccgaaagcaacauucuggauaucgaccuuagacccgcuuccgccuggacccuguaugcgguggccacaaccuuugucacaccuaugcuccggcauucuauugagaauagcuccguuaacaucucucugaccgcuauugccaaucaggcuacggugcugauggggcucggaaagggcuggccccuuagcaagauggauaucggggugccucugcuggccauuggauguuacucccaggucaaccccaucacccucacagcugcccugcuucugcucguggcgcacuacgccaucauuggcccuggccugcaggcuaaagccacccgcgaagcucaaaagagagccgccgcggggaucaugaaaaauccgacaguugacggaauuaccgugaucgaucuggagcccauuccuuaugaccccaaguucgaaaaacagcucggccaggucaugcuucugauccugugcgugacgcagguccucaugaugcggacaaccugggcucugugugaggcccuuacacuggcuaccgggccuaucagcacccucugggagggaaaccccggccgcuuuuggaauacaacgauugccgugucuauggccaacaucuucagaggguccuaccuggcuggagccggccugcucuuuagcauuaugaagaauaccacaaacacccggcgcggcacagggaauaucggagaaacccuuggcgagaaguggaaaucuagacugaacgcgcuggggaaguccgaauuccaaauuuauaaaaagagcggaauccaggagguugaucggacgcucgccaaagagggcaucaagagaggggaaacagaccaucacgcugugucucgcggaagcgccaaacugcggugguuugucgagagaaacauggugaccccggaaggcaagguuguggaucuuggcugcgggcgcggaggcugguccuacuauugugggggacugaagaauguccgggaggugaaaggccucaccaaggggggaccuggccaugaagagcccauucccaugucuacauacggcuggaaccuggugagacugcagagcgggguugacgucuucuucaccccucccgagaaaugcgauacacuccuuugugacaucggagaauccagcccuaauccgacgauugaggcuggccgcacccugcgggugcugaaccucguggaaaauuggcugaacaauaacacacaauuuugcaucaagguccuuaaucccuauaugccuuccguuauugagaaaauggaaacccugcagagaaaguacgggggagcccucgugcgcaacccccugucucggaauagcacacacgagauguacuggguguccaacgcgaccggcaauaucgucucuagcgugaacaugaucuccagaaugcugauuaaucgcuucacgaugaagcacaaaaaggccaccuaugagccugauguugaccucgggucuggaacacggaacaucggcauugaaagcgagauccccaaccuugacauuaucggcaaaagaauugaaaagaucaaacaggagcaugaaaccuccuggcacuacgaucaggaccauccguauaagacaugggcuuaccacgggagcuaugagaccaagcaaacaggaucugccuccagcauggugaauggcgucgugcgccugcugaccaaaccuugggauguugugcccauggucacgcagauggcuaugacagacaccaccccuuuugggcagcagagaguguucaaggagaaaguggauacacggacgcaagaacccaaggagggaaccaaaaagcucaugaagaucacagccgaauggcuguggaaagagcuuggcaagaaaaagaccccucgcauguguacaagagaggaauuuacccggaaagucagaucuaacgcugcccugggggcgauuuucacagacgagaauaaguggaaauccgcccgggaagcuguugaggauagccgcuuuugggaacucaucgacagagagcggaaccugcaccuggagggaaagugcgaaaccuguguguacaauaugaugggcaagcgcgagaaaaagcucggcgaauucgggaaagccaagggaucuagagcuauuugguauauguggcugggcgcccgguuucuugaguucgaagcccugggguuucucaacgaggaucauugguucucccgcggaaauagccuguccggcguggagggggaaggccuucacagacugggauacauccuccgggacgucagcaaaaaggagggcggggcgauguacgcugaugacacggccggaugggacacccgcauuacacuggaagaucugaagaacgaggaaauggugaccaaucauaugaaaggcgagcacaagaaacucgccgaggcuaucuuuaagcugacauaucagaacaaaguugugagaguccagcggcccaccccgcgcgggacggugauggacaucauuucuagacgggaucagcgcggaagcggccaaguugggacauacggccuuaauaccuucacaaacauggaagcccagcugaucagacagauggagggagaaggcauuuucaaguccauccaacaucucaccgugacggaggagauugcuguccagaauuggcuggcccggguggggagagaacgccuuucucggauggcgaucagcggagacgauugcguugugaagccucuggacgauagauuugccuccgcucucaccgcccugaacgacaugggcaaaguccgcaaggauauccagcagugggagcccucucggggguggaaugacuggacacaagugcccuucugcagccaccacuuucaugaacuggucaugaaagauggaagagugcucguugugccuugucgcaaccaggacgagcugauuggccgggcuagaaucucccagggggccggcuggucucuuaaggaaaccgcgugccugggaaaaagcuaugcccagauguggacacucauguacuuccaccgccgggaucugagacuugcugccaacgcuauuuguuccgccgucccgagccauugggugcccaccucucgcacaaccugguccauccacgcuaagcacgaguggaugacgacagaggacaugcuggccguguggaaucggguuuggauucaagaaaacccuuggauggaggacaagacccccguggaaagcugggaggaagucccuuaucucggcaaaagagaggaucaguggugcgggucucugaucggacugaccucccgggcgacaugggccaagaauauucagaccgcuaucaaccaggugagaagccucaucggcaaugaggaauacacagacuauaugcccuccaugaaacgcuuucggagagaggaagaggaagccgggguucugugguga

SEQ ID NO: 20004 - RNA, 9876 nt, Artificial Sequence
  derived and/or modified CDS sequence (opt5) from DENV-2__EU482594__SS-prME
accgcgggcgugaucauuaugcugauccccaccgcuauggccuuccaccucacgacccggaacggggaaccucauaugauugucggacggcaggaaaagggcaaaucccugcuuuuuaagaccgaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucguggccgaaaaggacagcccggucaacauugaggcugaacccccuuuuggggauucuuacaucauuaucggcguggagcccggacagcugaaacuuaauugguucaagaagggcuccagcaucgggcagauguuugagacaaccaugagaggagccaaacgcauggccauucugggcgacacagcuugggauuucgggucucucggaggcguuuuuaccagcaucgggaaggcccugcaccaaguguucggcgcgauuuacggagcugccuuuuccggcgucucuuggacgaugaaaauccugauuggggugaucaucacauggauuggaaugaacagccgguccaccagccuuucugugucccucguucuggucggcguggugacccuguaucucggggccaugguccaggcugacagcggaugugugguuucuuggaaguccaaagaacugaagugcggcagcgggaucuucauuacagauaaugugcacaccuggacagagcaguacaaguuucagccugaaucccccucuaaacuugccagcgcuauccaaaaggcccaugaggaaggcauuuguggaaucagauccgucacgcgccuggagaaccucauguggaaacagaucaccccggagcugaaucacauucugucugaaaacgaggugaaacuuacaaucaugaccggcgacauuaaagggaucaugcaggcgggaaagcggagccucagaccucagcccacagaacugaaauauuccuggaagaccuggggcaaggccaaaaugcugagcacggagucucauaaucaaaccuuccucauugaugggccugaaacagcugagugccccaacaccaaucgcgccuggaacucccuggagguugaagacuacggauuuggcguguucacaaccaauaucuggcuuaagcugcgggagaaacaggacgucuuuugugauagcaagcucaugucugcugccaucaaagacaacagagcggugcacgccgauaugggcuauuggauugaauccgcucugaaugacacauggaagauggagaaggccagcuucaucgagguuaaaucuugccacuggccuaagagccauacccugugguccaacggggugcuugaaagcgagaugauuauccccaaaaauuucgcuggaccggucucucagcacaacuaccgcccuggcuaucauacgcagacagccgggcccuggcaccucggaaagcuggaaauggauuuugacuucugugagggcaccaccgugguggucacagaagauugcgggaaccggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaucucguuaacucucuggugaccgcuggccaugggcaaauugauaauuuuagccugggagugcuuggcauggcccucuuccuggaagagaugcugagaacacgcgucgggaccaaacacgccauccuccugguggcuguuuccuuugugacgcuuaucaccggaaacaugucuuuccgggaccugggcagagucauggugaugguuggcgccacaaugaccgaugacauugggaugggaaucacauaucucgcccugcuggcugccuuuaaggugcgcccuaccuucgcggcuggccuucugcucaaaaagcugacgagcaaagagcucaugauggccacaauugggaucgcccugcuuucccagucuaccauucccgaaacaauccuggagcucaccgaugcucuggcccugggaaugaugguccuuaagaucgugagaaauauggaaaaguaccagcuggcgguuaccauuauggcuaucagcugcgugccuaacgccgucauucuccaaaaugccuggaaaguguccuguacaauccuggcugccgugagcgucucuccccuccugcuuacguccagccagcagaaggcugacuggauuccucuggcccucaccaucaaaggccugaaccccacagcgaucuuucugaccacacuuucucggaccuccaagaaacgcagcuggccgcugaaugaggccauuauggcuguugggauggugucuauccucgccuccagccugcucaagaacgacauuccuaugacgggaccccugguggcuggcggccuucugacagucugcuaugugcugaccgggagauccgccgaucucgaacuggagcgggccgcugacguuaaaugggaggaucaggcggaaaucagcggaucuagcccuauucuuuccaucaccauuucugaggacggcagcauguccaucaagaaugaagaggaggaacaaacacugaccauccucauucgcacagggcugcucgugaucucuggagucuuccccgugagcauuccgaucacggccgcugccugguaccugugggagguuaagaaacagagagccggcgugcuuugggaugucccuucucccccucccguggggaaggcugaacuggaggacggagccuaucggauuaaacagcgcggcauccugggcuacagccagaucggggcgggagucuauaaggaaggcaccuuucacacaauguggcaugugaccagaggggcuguucucaugcaccggggaaaacgcauugagcccagcugggccgaugugaagaaggaccugaucuccuacggcgggggauggaaacuugagggcgaauggaaggagggcgaagagguccaagugcuggcccucgaaccugggaaaaacccgagagcuguucagacaaagcccggacuguucaaaaccaauacgggcaccauuggggccgugagccucgauuuuucuccuggaacauccggcagccccaucgucgaccggaaggggaagguggugggacuguacggcaacggcguugucaccagaucuggggcguauguguccgcuauugcccagacagagaaaagcaucgaggauaauccugaaaucgaggacgauauuuuccgcaagaaacggcuuaccaucauggaccugcaucccggagccggcaagacaaaaagauaccugccugcuauugugcgcgaagccaucaagcgggggcucagaacgcugauucuugcuccgacccgcgucguggccgcggagauggaagaggcccugcggggacuccccaucagauaucagaccccugcuauucgcgccgagcacaccggccgggaaaucguugaccugaugugucaugcuaccuucacaaugagacuccugucccccgugcgggucccuaacuacaaccuuaucauuauggaugaggcccacuuuacggaccccgccucuaucgcugcgcgcggguauauuagcaccagaguggaaaugggcgaggccgcuggaaucuucaugacagccaccccgccuggcucccgggaucccuuuccccaaagcaaugccccuauuauggacgaggaacgcgagauccccgaaagaucuuggaacuccgggcacgaguggguuacagauuucaagggaaaaaccgugugguuugucccuagcaucaaggcuggcaaugacauugccgcgugccugcggaaaaacgggaagaaagugauccagcugucuagaaagacguucgauagcgaauacguuaagacacgcgcuaaugacugggauuuuguggucaccaccgacauuuccgagaugggagccaacuucaaagccgagcgggugaucgauccgagacgcuguaugaagcccgugauucucacagaaggcgaggaacgggucauccuggcugggccuaugcccguuacccauucuagcgccgcgcagagacgcggccggaucggaagaaauccuaaaaacgagaaugaccaauauauuuacaugggcgaaccccuugagaacgacgaggauugcgcccacuggaaggaagcuaaaaugcugcucgacaauaucaacacaccggaggggauuaucccuuccauguuugaacccgagcgcgaaaagguggaugccauugacggagaguacagacugcggggcgaggcucgcaaaaccuucguggaucugaugagaagaggggaccucccugucuggcuugccuaucgcguggcugccgaaggaaucaauuacgcggauagacggugguguuuugacggcauuaagaacaaucagauccuggaggaaaacguugagguggagaucuggacgaaggaaggggagcgcaagaagcugaaaccccgcuggcucgaugcccggauuuauucugacccucuggcucuuaaggaguucaaagaguucgccgcuggcagaaagagccugacacucaaccugaucaccgaaaugggacgccugcccacauuuaugacccagaaggcccgggaugcccucgacaaucuugcuguccugcauacggcggaggccggcgggagagcuuacaaccacgcccuguccgagcucccggaaacccuggagacacuucugcuccugacccugcucgccacagugaccggaggcauuuuccuuuuucugaugagcgggaaaggaaucggcaagaugacacugggcaugugcugcauuaucaccgcuucuauccuccugugguaugcccagauucaaccucacuggaucgcggccuccauuauccuugaguucuuucugauuguucuccugauccccgagcccgaaaaacagcggacgccucaggauaaucagcugacauacguggucaucgcuauucucaccguggucgccgcuaccauggccaacgagaugggguuccuugagaagaccaaaaaggaccugggacugggcagcaucgcgacccaagaauccgagucuaauauucucgacaucgaucugcgcccggccagcgcuuggacacuuuaugccguggcuacgaccuuuguuacacccaugcugagacauuccauugaaaacucuagcgugaaugugucccucaccgccaucgcuaaccaggccacaguccugauggggcugggaaagggcuggccucucagcaaaauggacauugggguuccccuucuggcgaucggauguuacucucaggugaauccuaucacccugacggccgcucuccugcuucugguggcccacuacgcuauuaucggccccggccuccaggccaaggccacccgggaggcgcaaaaacgcgcugccgcugggauuaugaagaacccuacagucgauggaaucaccgugauugaccuggaaccgauccccuaugauccuaaauucgagaagcagcugggccagguuaugcuccuuauccugugcgugacacagguccugaugaugagaaccacgugggcccucugugaggcccugacacuugcuaccgggcccauuuccacacugugggaaggaaauccuggccgguuuuggaacaccaccaucgccgugagcauggcgaauauuuuccgcgggucuuaccucgccggagcuggccugcuguuuuccaucaugaagaacacaacgaauaccagacggggcacagggaacauuggagagacccucggcgaaaaauggaaaagccgccuuaaugcccuggggaagucugaguuccaaaucuauaagaaaagcggaauccaggaggucgacagaacacuggcuaaggaaggcauuaaaagaggggaaaccgaucaucacgccguguccagaggaucugcgaagcuccgcugguuuguugaacggaacauggugacgcccgagggcaaggucguggaccugggcugcgggagaggaggcuggagcuacuauugugggggacuuaaaaacguucgcgaagugaagggccugacaaaagggggaccgggccaugaggagccuauccccauguccaccuacggcuggaaucucguccggcugcagagcgggguggauguguucuucacacccccugaaaagugcgacacacugcucugugauauuggagaguccucucccaacccuaccaucgaagccggcagaacacuucgcguucugaaucuggucgagaacuggcucaauaacaauacgcaauuuugcauuaaagugcugaacccguauaugcccagcgugaucgaaaagauggagacccuucagcggaaguacgggggagcucuggucagaaauccucucucccgcaacucuacacacgagauguacuggguuagcaaugccaccggcaacaucguguccucugugaauaugauuagccggaugcugaucaacagauucacaaugaaacacaagaaagcuaccuaugaacccgacgucgaucugggguccggaacgcgcaauauuggcaucgagagcgaaauuccuaaccucgacaucauuggcaagcggaucgagaaaaucaagcaggaacaugagaccucuuggcacuacgaccaggaucaucccuauaagacaugggccuaccacggguccuaugagaccaaacaaacaggaagcgcuucuuccauggugaacggcguugugagacuucugaccaagccgugggacgucgugccuaugguuacacagauggccaugaccgauacgacacccuuugggcagcagcgcguguucaaagaaaaggucgacaccagaacccaagagccuaaagaaggaacaaagaagcugaugaaaauuacggcggaguggcucuggaaggagcugggcaaaaagaaaacaccccggauguguacacgcgaagaguuuaccagaaaggugcggagcaaugccgcucuuggggccaucuucacagaugaaaacaaauggaagucugcuagagaggccguggaagacucccgguuuugggagcugauugaucgcgagagaaaucuccaccuggaaggaaagugcgagaccugugucuacaacaugaugggcaaacgggaaaagaaacugggcgaguucgggaaggccaaaggaagccgcgcgaucugguauauguggcucggcgcuagauuucuggaguucgaggcccuuggguuucugaaugaggaccauugguucucccggggaaacagccucucuggcguugaaggggagggccugcaccgccuuggauacauucugagagaugugagcaagaaggaaggcggggccauguacgcugacgauacagccggaugggacacccggaucacgcucgaggaccugaaaaaugaagagauggugaccaaccauaugaagggcgagcacaaaaagcuggcugaagccaucuuuaaacucacauaucagaauaaggucgugcgcguucagagaccuacaccccgggggacagugauggauauuaucucccgcagagaccagcggggaucuggccaagucgggaccuacggccugaacacguucacaaauauggaggcgcagcuuauucgccagauggaaggagagggcaucuucaagagcauucaacaucugaccgugacagaggaaaucgccguucagaacuggcucgcuagaguggggcgggagagacugucccgcauggccaucucuggagaugacugcgucgugaaaccgcuugaugaccgguuugcuagcgcccugaccgcgcucaaugauaugggcaagguuagaaaagacauucagcagugggaaccuucccgcggguggaacgauuggacgcaagugcccuucugcucucaccacuuucaugagcuggucaugaaggacggacgggugcuggucgugcccuguagaaaucaggaugaacucaucggccgcgcccggauuagccagggggcuggcuggucccugaaagagaccgccugccuuggaaagagcuaugcucagauguggacacugauguacuuccacagacgcgaccuccggcuggccgcuaacgccaucuguucugcgguuccuucccauugggugccgaccagcagaacaaccuggucuauucacgccaagcacgaguggaugacaaccgaagauaugcuugcugucuggaaccgcguguggauccaagagaaucccuggauggaagacaaaacgccuguggaguccugggaagagguucccuaucugggcaagcgggaggaccaguggugcgggagccucauuggacugacauccagagccaccugggccaaaaacauccagaccgcuaucaaucaggugcggucucugauuggcaacgaagaguacacagauuauaugccuagcaugaagagauuucgccgggaagaggaagaggccgggguccucugguga

SEQ ID NO: 20005 - RNA, 9876 nt, Artificial Sequence
  derived and/or modified CDS sequence (opt5) from DENV-2__EU482604__SS-prME
accgccggcgugaucauuaugcugauccccacagcuauggccuuccaccucacgaccagaaauggggaaccucauaugauugucggacggcaggaaaagggcaagagccugcuuuuuaagacagaggacgggguuaauaugugcacccugauggcgaucgaucucggagaacugugugaggacacaauuaccuacaagugcccgcuucugagacaaaaugaacccgaggauaucgacuguuggugcaauagcacaucuaccugggugacguauggcaccuguacaaccacaggggagcacagacgggaaaagagaagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcauugggaaggcucuccaccagguguucggcgccaucuacggagcggcuuuuuccggcguuucuuggacaaugaaaauccugauugggguggucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcaucuguggaauuagaagcgugacccgccuugagaaucugauguggaaacagaucacaccggagcucaaccacauucuguccgaaaaugaggucaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgauccugcucgucgccgugagcuuuguuacacugauuaccggaaauauguccuuccgggaccuuggcagagugauggucauggugggcgcuacaaugaccgaugacaucgggaugggaguuacguaucuggcccuccuggccgcuuuuaaggugcgcccuacauucgccgcgggccugcuucugagaaaacucaccucuaaggagcugaugauggcuacaauugggaucacccuccugagccaguccaccauucccgaaacaauccuugagcugacggaugcccucgcccugggaaugaugguccugaaaaucgugcggaacauggaaaaguaccaacuugcuguuaccauuauggccaucucuugcgugccuaaugcggucauucugcgcaacgcuuggaaggugagcuguacaauccucgccgccguguccgucagcccccugcuccugaccucuucccagcagaaagcugacuggauuccucuugcccugacaaucaagggccucaaucccaccgcuaucuuucugacgacacugagcagaaccucuaaaaagcgguccuggccgcuuaacgaggccauuauggcgguugggauggugagcauccuggccucuucccuccugaaaaaugacauuccuaugaccggaccccucguggcuggcggccugcuuacagucugcuaugugcugaccgggcgcagcgccgaucuggaacucgagagagcugccgacguuaagugggaggaucaggccgaaaucuccggaagcucuccuauucugagcaucacaauuuccgaggacggcucuaugagcaucaaaaacgaagaggaggaacaaacgcuuaccauccugauucggacagggcuccuggugaucuccggagucuuccccgugucuauuccgaucaccgcugcggccugguaccucugggagguuaagaagcagcgcgcuggcgugcugugggaugucccuucucccccucccguggggaaagccgaacuugaggacggagccuauagaauuaagcagcggggcauccugggcuacucccagaucggggcuggagucuauaaagaaggcacauuucacaccauguggcaugugacgcgcggggccguucugaugcacagaggaaagcggauugagcccuccugggcggaugugaaaaaggaccucaucagcuacggcgggggauggaagcuggagggcgaauggaaagagggcgaagagguccaagugcuugcucuggaaccugggaagaauccgagagccguucagaccaaacccggaauuuucaagacaaacaccggcacaaucggggccgugucccucgauuuuagcccuggaaccucuggcucccccauugucgaccgcaaagggaagguggugggacuguacggcaauggcguugucacacggagcggggcuuaugugucugccaucgcgcagacggagaaguccaucgaggauaacccugaaauugaggacgauaucuuccgcaagaagcgccucaccauuauggaccugcaucccggagcuggcaaaacaaagcgguaccuuccugccaucgugagagaagccauuaaacgcgggcugcggacccugauccucgcuccgaccagagucguggccgcugagauggaagaggcccugcgcggacuucccauucgguaucagaccccugcgaucaaggccgagcacacgggcagagaaaucguugaccugaugugucaugcuaccuucacaaugcggcuccugagccccgugcgcgucccuaacuacaaucucauuaucauggaugaggcccacuuuaccgaccccgcuuccauugccgccagaggguauaucucuacacggguggaaaugggcgaggcugcgggaauuuucaugaccgccacgccgccuggcagccgcgaucccuuuccccaauccaacgcuccuaucauggacgaggaaagagagauccccgaacggagcuggaacucugggcacgaguggguuacagauuucaagggaaaaaccgugugguuugucccuuccauuaaggccggcaacgacaucgccgcuugccugcgcaagaaugggaagaaagugauucagcuuagccgcaagaccuucgauucugaauacguuaagacacgggccaacgacugggauuuuguggucaccacagacaucagcgagaugggagcgaauuucaaagcugagagagugauugauccgcgccgguguaugaagcccgugauccugaccgacggcgaagagagagucauccuggccgggccuaugcccguuacgcauuccucugccgcucagcgccggggcagaauuggacgcaacccuaaaaaugaaaacgaccaauauaucuacaugggcgagccccucgaaaaugaugaggacugcgcccacuggaaggaggcgaaaaugcugcuugauaacauuaauacaccggaagggaucauuccuagcauguuugagcccgaaagagagaagguggacgccaucgauggagaauaccggcugcgcggcgaggcuagaaaaaccuucguggaccucaugcggcgcggggaucugccugucuggcuggccuauaagguggcugccgagggaauuaacuacgcugacagaaagugguguuuugauggcaucaaaaauaaccagauccucgaagagaacguugaaguggagauuuggacaaaggagggggaacggaagaaacuuaaacccagauggcuggacgcccgcaucuauuccgauccucuggcgcucaaagaguucaaggaguucgccgcuggccggaaaucucugacccuuaaucugauuacggagaugggaagacuccccaccuuuaugacacagaaggcccgcaacgcucuggacaaucuggccguccuccauaccgccgaagcuggcgggcgggcguacaaccacgcccuuagcgagcugccggagacacuggaaacccuccugcuucugacacuccuggcuaccgugacgggaggcaucuuccuguuucucauguccgggaaaggaauuggcaagaugacacuuggcaugugcugcaucaucaccgccagcguucugcugugguaugcccagauucaaccucacuggaucgcugccucuauuauccucgaguucuuucugauugugcuucugauccccgaacccgagaaacagagaaccccucaggauaaucagcucacauacgucgugaucgcgauucugaccgucguggccgcuacaauggccaacgaaaugggguuccuggagaagacgaagaaagaccucggacuuggcuccaucaccacacaagagagcgaauccaauauucuggacaucgaucugcggccggcuucugccuggacccucuaugcgguugccacaaccuuugugacgcccaugcugcgccauagcauugagaacuccucugugaaugucagccuuaccgcuaucgccaaccaggcuacaguucugauggggcucggaaagggcuggccucuguccaaaauggacauuggggugccccugcucgccaucggauguuacagccaggugaauccuaucacccuuacagcugcccugcugcuccuggucgcgcacuacgccauuaucggccccggccuucaggcuaaggccaccagagaagcucaaaaacgggccgccgcggggauuaugaagaacccuacgguggauggaaucacaguuauugaccuggagccgauccccuaugauccuaaguucgaaaaacagcucggccaggugaugcugcugauccucugcgucacccaggugcuuaugaugcgcacaaccugggcucugugugaggcccugacccucgcuacagggcccauuucuacgcugugggagggaaauccuggcagauuuuggaacaccacaaucgccgucuccauggccaauauuuuccgggggagcuaccuugcuggagccggccugcucuuuucuaucaugaagaacaccacaaauacccgcagaggcacggggaacauuggagaaacacugggcgagaaauggaagucccggcugaacgcgcucgggaaaagcgaguuccaaaucuauaagaaaucuggaauccaggagguggaccgcacccuugccaaggagggcauuaagagaggggaaaccgaucaucacgcuguuagccggggauccgccaaacugagaugguuuguggagcgcaauauggucacacccgaaggcaaggugguugaccugggcugcgggcggggaggcuggucuuacuauugugggggacucaaaaacgugagagaggucaagggccugaccaaagggggaccgggccaugaagaaccuauccccaugagcacauacggcuggaaucuugugcgccugcaguccgggguggauguuuucuucacgcccccugagaagugcgacacccuccugugugauauuggagaaagcucccccaacccuacaaucgaggcuggccggacccugagaguccucaaucuuguggaaaacuggcugaauaacaauacacaauuuugcauuaaggugcugaacccguauaugcccucugucaucgagaaaauggaaacccuccagcgcaaguacgggggagcccugguucggaauccucuuagcagaaacuccacgcacgagauguacugggugucuaaugcgaccggcaacaucgugagcuccgucaauaugauuucucgcaugcugaucaaccgguucacaaugaaacacaagaaagccaccuaugagcccgacguggaucucgggagcggaacaagaaacauuggcaucgaauccgagauuccuaaucuggacaucauuggcaagcgcaucgaaaagaucaaacaggagcaugaaaccagcuggcacuacgaccaggaucaucccuauaagacaugggcuuaccacgggucuuaugagaccaaacaaacgggauccgccagcucuaugguuaacggcgugguccggcugcucacaaagccgugggacgugguuccuauggugacccagauggcuaugaccgauacaacgcccuuugggcagcagagagucuucaaagagaagguggacacccgcacacaagaaccuaaggagggaaccaagaaacuuaugagaauuacagccgaauggcuguggaaagagcugggcaaaaagaaaacaccccggauguguacacgcgaggaauuuaccagaaaagugcgguccaaugcugcccucggggcgaucuucacggaugagaacaaguggaaaagcgccagagaagcugucgaggacggacgguuuugggaacugguugauaaagagcgcaaucuucaccuggagggcaagugcgaaaccuguguguacaacaugaugggcaaaagagagaagaaacucggggaguucggaaaggccaagggcucucgggcuauuugguauauguggcugggggcccgcuuucuggaguucgaagcccucggauuucugaaugaggaccauugguucuccagaggcaacagccuuuccgggguggagggcgaaggacugcaccggcucggcuacauccugcgcgaugucgggaaaaaggagggaggcgcgauguacgcugacgauacagccgggugggacaccagaauuacacuugaagaccugaaaaaugaggaaauggugaccaaccauaugaagggagagcacaaaaagcucgccgaggcuaucuuuaagcugacguaucagaauaaaguugugcggguccagcgcccuacacccagaggcaccgugauggauaucauuagccggcgcgaccagagagggucuggccaaguuggaacauacggccugaacaccuucacgaauauggaagcccagcucauccggcagauggagggggaaggaauuuucaagagcauccaacaucugaccgcuacagaggagauugccgugcagaacuggcuugcgcgcgucggcagagaacggcuguccagaauggccaucucuggggaugacugcgugguuaaaccgaucgaugaccgcuuugcuagcgcccucaccgcucugaaugauaugggaaaggugcggaaagacauucagcagugggagccuuccagaggcuggaacgauuggacacaaguccccuucugcucucaccacuuucaugaacuugugaugaaggacgggcgcguccuggugguucccugucggaaccaggaugagcucaucggcagagcccgcauuagccagggagcgggcuggucccugaaggaaaccgccugccuggggaaaucuuaugcucagauguggacacucauguacuuccaccggagagaccugcgccuugccgcuaaugccaucuguagcgcugugccuucccauugggucccgaccagccggacgacauggucuauucacgccaagcacgaguggaugaccaccgaggauaugcuggcgguguggaacagaguguggauccaagaaaaucccuggauggaggacaaaacaccuguugaauccugggaggaagugcccuaucucggaaagcgcgaggaccaguggugcggcagccugauugggcuuaccucucgggccacaugggcuaaaaacauccagacggccaucaaucaggucagaucccugauuggaaacgaggaauacaccgauuauaugccuagcaugaagcgguuuagacgcgaggaagaggaagccggcgugcucugguga

SEQ ID NO: 20006 - RNA, 9876 nt, Artificial Sequence
  derived and/or modified CDS sequence (opt5) from DENV-2__EU482605__SS-prME
accgccggcgugaucauuaugcugauccccacagcuauggccuuccaccucacgaccagaaauggggaaccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcacagacgggaaaagagaagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuggugaccggccaucucaaaugcagacugcggauggauaaacuucaacugaaagggaugucuuacagcauguguaccggaaaguuuaagauugucaaagaaaucgcggagacacagcacggcacgaucgugauuagaauccaguaugagggggacggaucccccugcaagauucccuucgaaaucaccgaucucgagaaacgccauguccugggccggcugauuacagugaacccuaucguuauugaaaaggacagcccggugaacaucgaggccgaacccccuuucggggauucuuacaucauuaucggcgucgagcccggacagcucaaacugaauugguuuaagaagggcuccagcauugggcaaauguucgagaccacaaugagaggagcuaaacgcauggccauccuuggcgacaccgccugggauuuugggucucugggaggcguguucacgagcauugggaaggcucuccaccagguuuuuggcgccaucuacggagcggcuuucuccggcgugucuuggacaaugaaaauccugauuggggucgugaucaccuggauuggaaugaacagccgguccaccagccugucugugucccuuguucucgucggcguggugacacuguaucugggggccaugguccaggccgacagcggaugugugguuucuuggaagaauaaagaacucaagugcggcuccgggaucuuuauuaccgauaacgugcacacauggacggagcaguacaaguuccaaccugaaagccccuccaaacuggcuucugccauccagaaggcucaugaggaaggcaucuguggaauuagaagcgucacccgccuugagaaucugauguggaaacagaucacaccggagcucaaccacauucuguccgaaaaugaggugaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuucugaucgaugggccugaaacagccgagugccccaauaccaaccgcgcuuggaacucucucgagguugaagacuacggauucggcguguuuacaaccaacaucuggcugaaacuucgggagaaacaggacgucuucugugauuccaagcugaugagcgccgcuauuaaagacaauagagccgugcacgcggauaugggcuauuggaucgaaucugcccucaacgacacguggaagauggagaaggcuuccuuuauugagguuaaaagcugccacuggccuaagucucauacacuguggagcaauggggugcuggaauccgagaugaucauucccaaaaacuucgccggaccggucagccagcacaacuaccgcccuggcuaucauacccaaaccgcugggcccuggcaccuuggaaagcucgaaauggauuucgacuuuugugagggcacaaccgugguggucacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccugguuaauucccucgugaccgccggccaugggcagaucgauaacuucucucugggagugcugggcauggcucuuuuucucgaagagaugcugagaacgcgcgucgggaccaaacacgcgauccugcucguggccguuagcuucgugacacugauuaccggaaauauguccuuucgggaccuuggcagagucauggugaugguuggcgcuacaaugaccgaugacaucgggaugggagugacguaucuggcccuccuggccgcuuucaagguccgcccuacauuugccgcgggccugcuucugagaaaacucaccucuaaggagcugaugauggcuacaauugggaucacccuccugagccaguccaccauucccgaaacaauccuugagcugacggaugcccucgcccugggaaugauggugcugaaaaucguucggaacauggaaaaguaccaacuugcugugaccauuauggccaucucuugcgucccuaaugcggugauucugcgcaacgcuuggaaggugagcuguacaauccucgccgccgucuccguuagcccccugcuccugaccucuucccagcagaaagcugacuggauuccucuugcccugacaaucaagggccucaaucccaccgcuaucuuccugacgacacugagcagaaccucuaaaaagcgguccuggccgcuuaacgaggccauuauggcgguggggauggugagcauccuggccucuucccuccugaaaaaugacauuccuaugaccggaccccucgucgcuggcggccugcuuacagugugcuauguucugaccgggcgcagcgccgaucuggaacucgagagagcugccgacgugaagugggaggaucaggccgaaaucuccggaagcucuccuauucugagcaucacaauuuccgaggacggcucuaugagcaucaaaaacgaagaggaggaacaaacgcuuaccauccugauucggacagggcuccuggucaucuccggaguguuucccguuucuauuccgaucaccgcugcggccugguaccucugggaggugaagaagcagcgcgcuggcguccugugggaugugccuucucccccucccgucgggaaagccgaacuugaggacggagccuauagaauuaagcagcggggcauccugggcuacucccagaucggggcuggaguguauaaagaaggcacauuccacaccauguggcauguuacgcgcggggccgugcugaugcacagaggaaagcggauugagcccuccugggcggaugucaaaaaggaccucaucagcuacggcgggggauggaagcuggagggcgaauggaaagagggcgaagaggugcaaguucuugcucuggaaccugggaagaauccgagagccgugcagaccaaacccggaauuuuuaagacaaacaccggcacaaucggggccgucucccucgauuucagcccuggaaccucuggcucccccauuguggaccgcaaagggaaggugguuggacuguacggcaauggcgucgugacacggagcggggcuuaugugucugccaucgcgcagacggagaaguccaucgaggcuaacccugaaauugaggaugccaucuuucgcaagaagcgccucaccauuauggaccugcaucccggagccggcaaaccuaagcggagccuuccggcuaucgucagagaagccauuaaacgcgggcugcggccccugauccucgcuccucccagagugguuccugccgagauggaggaaccccugcgcggacuuccgauucgguaccagaccccugcgaucaagcccgaucacaccggcagagagaucguggcccugaugugucaugcucccuucaccaugcggcuccuguccccuguccgcgugcccaacuauaaucucauuaucauggacgaagcccacuucacagacccugcuucuauugccgccagaggguacaucagcacgcggguugagaugggcgaagcugcgggaauuuuuaugaccgccacaccgcccggcucccgcgauccuuucccccaaagcaacgcuccuaucauggacgaggagagagaaauccccgagcggucuuggaauagcgggcacgaaugggugaccgauuuuaagggaaaaacagucugguucgugccgagcauuaaggccggcaacgacaucgccgcuugccugcgcaagaaugggaagaaaguuauucagcuuucucgcaagaccuuugauagcgaguaugugaagacgcgggccaacgacugggauuucgucgugacaaccgacaucuccgaaaugggagcgaauuuuaaagcugagagagugauugauccucgccgguguaugaagcccgucauccugaccgacggcgaggaaagaguuauccuggccgggccuaugcccgugacacauucuagcgccgcucagcgccggggcagaauuggacgcaacccuaaaaaugagaacgaucaauacaucuauaugggcgaaccccucgagaaugacgaagacugcgcccacuggaaggaggcgaaaaugcugcuugauaacauuaauaccccggaggggaucauuccuuccauguucgaacccgagagagaaaagguggacgccaucgauggagaguaccggcugcgcggcgaagcuagaaaaacauuugucgaccucaugcggcgcggggaucugcccguguggcuggccuacaagguugcugccgagggaauuaacuaugcugacagaaagugguguuucgauggcaucaaaaauaaccagauccucgaggaaaacguggaggucgaaauuuggaccaaggagggggagcggaagaaacuuaaaccuagauggcuggacgcccgcaucuacucugauccgcuggcgcucaaagaauuuaaggaguucgccgcuggccggaaaagccugacgcuuaaucugauuacagaaaugggaagacuccccaccuucaugacacagaaggcccgcaacgcucuggacaaucuggccgugcuccauaccgccgaggcuggcgggcgggcguauaaccacgcccuuuccgaacugccugagacgcuggagacccuccugcuucugacacuccuggcuaccguuacaggaggcaucuuucuguuccucaugagcgggaaaggaauuggcaagaugacccuuggcaugugcugcaucaucacagccucugugcugcugugguacgcccagauucaaccccacuggaucgcugccuccauuauccucgaauuuuuccugauuguccuucugaucccugagcccgaaaaacagagaaccccucaggauaaucagcucacguauguggucaucgcgauucugacagugguugccgcuaccauggccaacgagaugggguuucuggaaaagaccaagaaagaccucggacuuggcagcaucacaacccaagaguccgagucuaauauucuggauaucgaccugcggccggcuagcgccuggacacucuacgcgguggccacgaccuucgugacacccaugcugcgccauuccauugaaaacucuagcgucaauguuucccuuaccgcuaucgccaaccaggcuacagugcugauggggcucggaaagggcuggccucugagcaaaauggacauuggggugccccugcucgccaucggauguuauucucaggucaauccuaucacccuuacggcugcccugcugcuccugguggcgcacuacgccauuaucggccccggccuucaggcuaaggccaccagagaggcucaaaaacgggccgccgcggggauuaugaagaacccgacaguugauggaaucaccgugauugaccuggaaccuauccccuacgaucccaaguuugagaaacagcucggccaggucaugcugcugauccucugcgugacacagguccuuaugaugcgcaccacgugggcucugugugaagcccugacacucgcuaccgggccuauuuccacacugugggagggaaaucccggcagauucuggaacaccaccaucgccgugagcauggccaauauuuuucgggggucuuaucuugcuggagccggccuccuguucuccaucaugaagaacacaacgaauacccgcagaggcacagggaacauuggagagacccugggcgaaaaauggaaaagccggcugaacgcgcucgggaaaucugaguuucaaaucuacaagaaaagcggaauccaggaaguugaccgcacacuugccaaggagggcauuaagagaggggagaccgaucaucacgcugugucccggggaucugccaaacugagaugguucgucgaacgcaauauggugacgccugagggcaagguuguggaccugggcugcgggcggggaggcuggagcuauuacugugggggacucaaaaacgucagagaagugaagggccugacaaaagggggaccgggccaugaggaacccaucccuauguccaccuauggcuggaaucuugugcgccugcagagcgggguugaugucuuuuucacacccccugagaagugcgacacccuccugugugauauuggagaguccucucccaacccgaccaucgaagcuggccggacacugagagugcucaaucuuguggagaacuggcugaauaacaauacgcaauucugcauuaagguccugaacccuuacaugcccagcguuaucgagaagauggagacccuccagcgcaaguaugggggagcccuggugcggaauccucuuuccagaaacucuacacacgaaauguacugggugagcaaugcgaccggcaacaucgucuccucugugaauaugauuagccgcaugcugaucaaccgguuuacaaugaaacacaagaaagccaccuacgagcccgacguugaucucggguccggaacgagaaacauuggcaucgagagcgaaauuccuaaucuggacaucauuggcaagcgcaucgagaagaucaaacaggaacaugagaccucuuggcacuaugaucaggaccaucccuacaagacaugggcuuaucacggguccuacgaaaccaaacaaacaggaagcgccucuuccauggugaacggcgucgugcggcugcucaccaagccgugggacguugugccuauggucacacagauggcuaugaccgauacgacacccuucgggcagcagagaguguuuaaagagaagguggacacccgcacccaagagcccaaggaaggaacaaaaagacuuaugcggauuacggccgaguggcuguggaaggaacugggcaaaaagaaaaccccucgcauguguacaagagaggaguucacccggaaggucagaagcaaugcugcccucggggcgaucuuuacagaugaaaacaaauggaagucugcccgggaggcuguugaagacggacgcuucugggagcugguggauaaggaaagaaaucuucaccuggagggcaaaugcgagaccuguguguauaacaugaugggcaagcgggagaagaagcucggggaguuuggaaaagccaagggcucccgcgcuauuugguacauguggcugggggccagauuccuggaauuugaggcccucggauuccugaaugaagaccauugguuuagccggggcaacucccuuagcggggucgagggcgagggacugcaccgccucggcuauauccugagagauguggggaagaaagaaggaggcgcgauguacgcugacgauacagccgggugggacacccggauuacgcuugaggaucugaagaaugaagagaugguuaccaaccauaugaaaggagaacacaagaaacucgccgaggcuaucuucaagcugacauaccagaauaaggugguccgcgugcagagaccgacaccccggggcacaguuauggacaucauuucucgcagagaccagcgggggagcggccaagugggaaccuauggccugaacacguuuacaaauauggaggcccagcucauccgccagauggaaggggagggaauuuucaaauccauccaacaucugaccgcuacagaagagauugccguccagaacuggcuugcgagagugggccgggagagacugucucgcauggccaucagcggggaugacugcguugugaagccuaucgaugaccgguucgcuuccgcccucaccgcucugaaugauaugggaaaagucagaaaggacauucagcagugggaacccucucgcggcuggaacgauuggacgcaagugccuuuuugcagccaccacuuccaugagcuugucaugaaagacgggcgggugcugguugugcccuguagaaaccaggaugaacucaucggccgcgcccggauuucccagggagcgggcuggucucugaaggagaccgccugccugggaaagagcuacgcucagauguggacacucauguauuuucacagacgcgaccugcggcuugccgcuaaugccaucuguuccgcugucccuagccauugggugcccaccucuagaacaaccugguccauucacgccaaacacgaauggaugacaaccgaggauaugcuggcgguguggaaccgcguuuggauccaagagaauccguggauggaagacaagacgccuguggagagcugggaagagguccccuaccucggaaaacgggaagaucaguggugcggcucucugauugggcuuacauccagagccaccugggcuaagaacauccagaccgccaucaaucaggugcggagccugauuggaaacgaggaguauacagacuacaugccuuccaugaaaagauuccgccgggaagaggaagaggccggcguucucugguga

SEQ ID NO: 20007 - RNA, 9876 nt, Artificial Sequence
  derived and/or modified CDS sequence (opt5) from DENV-2__EU482606__SS-prME
acagccggcgugaucauuaugcugauccccacagcuauggccuuccaccucacgaccagaaauggggaaccucauaugauugucggacggcaggaaaagggcaagagccugcuuuuuaagacagaggacgggguuaauaugugcacccugauggcgaucgaucucggagaacugugugaggacacaauuaccuacaagugcccgcuucugagacaaaaugaacccgaggauaucgacuguuggugcaauagcacaucuaccugggugacguauggcaccuguacaaccacaggggagcacagacgggaaaagagaagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcauugggaaggcucuccaccagguguucggcgccaucuacggagcggcuuuuuccggcguuucuuggacaaugaaaauccugauugggguggucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcaucuguggaauuagaagcgugacccgccuugagaaucugauguggaaacagaucacaccggagcucaaccacauucuguccgaaaaugaggucaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgauccugcucgucgccgugagcuuuguuacacugauuaccggaaauauguccuuccgggaccuuggcagagugauggucauggugggcgcuacaaugaccgaugacaucgggaugggaguuacguaucuggcccuccuggccgcuuuuaaggugcgcccuacauucgccgcgggccugcuucugagaaaacucaccucuaaggagcugaugauggcuacaauugggaucacccuccugagccaguccaccauucccgaaacaauccuugagcugacggaugcccucgcccugggaaugaugguccugaaaaucgugcggaacauggaaaaguaccaacuugcuguuaccauuauggccaucucuugcgugccuaaugcggucauucugcgcaacgcuuggaaggugagcuguacaauccucgccgccguguccgucagcccccugcuccugaccucuucccagcagaaagcugacuggauuccucuugcccugacaaucaagggccucaaucccaccgcuaucuuucugacgacacugagcagaaccucuaaaaagcgguccuggccgcuuaacgaggccauuauggcgguugggauggugagcauccuggccucuucccuccugaaaaaugacauuccuaugaccggaccccucguggcuggcggccugcuuacagucugcuaugugcugaccgggcgcagcgccgaucuggaacucgagagagcugccgacguuaagugggaggaucaggccgaaaucuccggaagcucuccuauucugagcaucacaauuuccgaggacggcucuaugagcaucaaaaacgaagaggaggaacaaacgcuuaccauccugauucggacagggcuccuggugaucuccggagucuuccccgugucuauuccgaucaccgcugcggccugguaccucugggagguuaagaagcagcgcgcuggcgugcugugggaugucccuucucccccucccguggggaaagccgaacuugaggacggagccuauagaauuaagcagcggggcauccugggcuacucccagaucggggcuggagucuauaaagaaggcacauuucacaccauguggcaugugacgcgcggggccguucugaugcacagaggaaagcggauugagcccuccugggcggaugugaaaaaggaccucaucagcuacggcgggggauggaagcuggagggcgaauggaaagagggcgaagagguccaagugcuugcucuggaaccugggaagaauccgagagccguucagaccaaacccggaauuuucaagacaaacaccggcacaaucggggccgugucccucgauuuuagcccuggaaccucuggcucccccauugucgaccgcaaagggaagguggugggacuguacggcaauggcguugucacacggagcggggcuuaugugucugccaucgcgcagacggagaaguccaucgaggauaacccugaaauugaggacgauaucuuccgcaagaagcgccucaccauuauggaccugcaucccggagcuggcaaaacaaagcgguaccuuccugccaucgugagagaagccauuaaacgcgggcugcggacccugauccucgcuccgaccagagucguggccgcugagauggaagaggcccugcgcggacuucccauucgguaucagaccccugcgaucaaggccgagcacacgggcagagaaaucguugaccugaugugucaucccaccuucacaaugcggcuccugagcccugugcgcguccccaacuacaaucucauuaucauggaugaggcucacuuuaccgacccggccuccauugcugccagaggguauaucucuacacggguggaaaugggcgaggccgcuggaauuuucaugaccgcgacgccucccggcagccgcgaucccuuuccucaauccaacgcccccaucauggacgaggaaagagagaucccugaacggagcuggaacucugggcacgaguggguuacagauuucaagggaaaaaccgugugguuugucccguccauuaaggcuggcaacgacaucgccgccugccugcgcaagaaugggaagaaagugauucagcuuagccgcaagaccuucgauucugaauacguuaagacacgggcuaacgacugggauuuuguggucaccacagacaucagcgagaugggagccaauuucaaagcggagagagugauugauccccgccgguguaugaagccugugauccugaccgacggcgaagagagagucauccuggcugggcccaugccuguuacgcauuccucugccgcccagcgccggggcagaauuggacgcaaccccaaaaaugaaaacgaccaauauaucuacaugggcgagccgcucgaaaaugaugaggacugcgcucacuggaaggaggccaaaaugcugcuugauaacauuaauacaccugaagggaucauucccagcauguuugagccugaaagagagaagguggacgcgaucgauggagaauaccggcugcgcggcgaggccagaaaaaccuucguggaccucaugcggcgcggggaucugcccgucuggcuggcuuauaagguggccgcugagggaauuaacuacgccgacagaaagugguguuuugauggcaucaaaaauaaccagauccucgaagagaacguugaaguggagauuuggacaaaggagggggaacggaagaaacuuaaaccuagauggcuggacgcucgcaucuauuccgauccccuggcccucaaagaguucaaggaguucgcggccggccggaaaucucugacccuuaaucugauuacggagaugggaagacucccgaccuuuaugacacagaaggcucgcaacgcccuggacaaucuggcuguccuccauaccgccgaagccggcgggcgggcuuacaaccacgcgcuuagcgagcugccugagacacuggaaacccuccugcuucugacacuccuggccaccgugacgggaggcaucuuccuguuucucauguccgggaaaggaauuggcaagaugacacuuggcaugugcugcaucaucaccgcuagcguucugcugugguaugcccagauucaaccccacuggaucgccgcuucuauuauccucgaguucuuucugauugugcuucugauccccgaaccugagaaacagagaaccccgcaggauaaucagcucacauacgucgugaucgccauucugaccgucguggcggccacaauggcuaacgaaaugggguuccuggagaagacgaagaaagaccucggacuuggcuccaucaccacacaagagagcgaauccaauauucuggacaucgaucugcggcccgccucugcuuggacccucuaugccguugcgacaaccuuugugacgccuaugcugcgccauagcauugagaacuccucugugaaugucagccuuaccgccaucgcuaaccaggccacaguucugauggggcucggaaagggcuggccccuguccaaaauggacauuggggugccucugcucgcuaucggauguuacagccaggugaaucccaucacccuuacagccgcucugcugcuccuggucgcccacuacgcgauuaucggcccuggccuucaggccaaggcuaccagagaagcccaaaaacgggcugccgccgggauuaugaagaacccgacgguggauggaaucacaguuauugaccuggagcccaucccuuaugaucccaaguucgaaaaacagcucggccaggugaugcugcugauccucugcgucacccaggugcuuaugaugcgcacaaccugggcgcugugugaggcucugacccucgccacagggccuauuucuacgcugugggagggaaaucccggcagauuuuggaacaccacaaucgcugucuccauggccaauauuuuccgggggagcuaccuugccggagcuggccugcucuuuucuaucaugaagaacaccacaaauacccgcagaggcacggggaacauuggagaaacacugggcgagaaauggaagucccggcugaacgcccucgggaaaagcgaguuccaaaucuauaagaaaucuggaauccaggagguggaccgcacccuugcgaaggagggcauuaagagaggggaaaccgaucaucacgccguuagccggggauccgcuaaacugagaugguuuguggagcgcaauauggucacaccggaaggcaaggugguugaccugggcugcgggcggggaggcuggucuuacuauugugggggacucaaaaacgugagagaggucaagggccugaccaaagggggaccuggccaugaagaacccauccccaugagcacauacggcuggaaucuugugcgccugcaguccgggguggauguuuucuucacgccucccgagaagugcgacacccuccugugugauauuggagaaagcuccccuaacccgacaaucgaggccggccggacccugagaguccucaaucuuguggaaaacuggcugaauaacaauacacaauuuugcauuaaggugcugaaccccuauaugccuucugucaucgagaaaauggaaacccuccagcgcaaguacgggggagcucugguucggaauccccuuagcagaaacuccacgcacgagauguacugggugucuaaugccaccggcaacaucgugagcuccgucaauaugauuucucgcaugcugaucaaccgguucacaaugaaacacaagaaagcgaccuaugagccugacguggaucucgggagcggaacaagaaacauuggcaucgaauccgagauucccaaucuggacaucauuggcaagcgcaucgaaaagaucaaacaggagcaugaaaccagcuggcacuacgaccaggaucauccguauaagacaugggccuaccacgggucuuaugagaccaaacaaacgggauccgcuagcucuaugguuaacggcgugguccggcugcucacaaagccuugggacgugguucccauggugacccagauggccaugaccgauacaacgccuuuugggcagcagagagucuucaaagagaagguggacacccgcacacaagaacccaaggagggaaccaagaaacuuaugagaauuacagcugaauggcuguggaaagagcugggcaaaaagaaaaccccucggauguguacacgcgaggaauuuaccagaaaagugcgguccaaugccgcucucggggccaucuucacggaugagaacaaguggaaaagcgcgagagaagccgucgaggacggacgguuuugggaacugguugauaaagagcgcaaucuucaccuggagggcaagugcgaaaccuguguguacaacaugaugggcaaaagagagaagaaacucggggaguucggaaaggcuaagggcucucgggccauuugguauauguggcugggggcucgcuuucuggaguucgaagcccucggauuucugaaugaggaccauugguucuccagaggcaacagccuuuccgggguggagggcgaaggacugcaccggcucggcuacauccugcgcgaugucgggaaaaaggagggaggcgccauguacgcggacgauacagcugggugggacaccagaauuacacuugaagaccugaaaaaugaggaaauggugaccaaccauaugaagggagagcacaaaaagcucgccgaggccaucuuuaagcugacguaucagaauaaaguugugcggguccagcgccccacaccgagaggcaccgugauggauaucauuagccggcgcgaccagagagggucuggccaaguuggaacauacggccugaacaccuucacgaauauggaagcucagcucauccggcagauggagggggaaggaauuuucaagagcauccaacaucugaccgccacagaggagauugcugugcagaacuggcuugcccgcgucggcagagaacggcuguccagaauggcgaucucuggggaugacugcgugguuaaaccuaucgaugaccgcuuugccagcgcucucaccgcccugaaugauaugggaaaggugcggaaagacauucagcagugggagcccuccagaggcuggaacgauuggacacaaguccccuucugcucucaccacuuucaugaacuugugaugaaggacgggcgcguccuggugguuccuugucggaaccaggaugagcucaucggcagagcucgcauuagccagggagccggcuggucccugaaggaaaccgcgugccuggggaaaucuuaugcccagauguggacacucauguacuuccaccggagagaccugcgccuugcugccaaugcuaucuguagcgccgugccgucccauuggguccccaccagccggacgacauggucuauucacgcuaagcacgaguggaugaccaccgaggauaugcuggccguguggaacagaguguggauccaagaaaauccuuggauggaggacaaaacacccguugaauccugggaggaagugccuuaucucggaaagcgcgaggaccaguggugcggcagccugauugggcuuaccucucgggcgacaugggccaaaaacauccagacggcuaucaaucaggucagaucccugauuggaaacgaggaauacaccgauuauaugcccagcaugaagcgguuuagacgcgaggaagaggaagccggcgugcucugguga

SEQ ID NO: 20008 - RNA, 9876 nt, Artificial Sequence
  derived and/or modified CDS sequence (opt5) from DENV-2__EU482607__SS-prME
accgccggagugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaagacacaaucaccuacaaaugcccgcuucugagacaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcguguccaaccgcgauuuuguugaaggggugucuggaggcagcugggucgacauugugcucgagcacggguccugugugacaaccauggccaagaauaagcccacacuggauuucgaacuuaucaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccauggucgauagaggcuggggcaacggguguggacuguucggcaaagggggaaucguuacaugcgccauguuuacgugcaaaaagaauauggaaggcaaaguggugcagccugagaaccucgaauacaccauugucaucacaccccacagcggggaggagcaugcggugggaaaugacaccggcaagcacggcaaagaaauuaagaucacaccucagucuuccaucauugaggccgaacugaccggguauggaacgguuaccauggaguguagcccccggacaggccuugauuucaacgaaauggugcugcuccaaauggaggacaaggcuuggcugguccaccgccagugguuucuugaucugccgcucccuuggcugcccggggccgacacccagggaucuaauuggauccagaaggagacacuggugaccuucaagaacccucaugcuaaaaagcaagacguugugguccucggcucccaggaaggggccaugcacacggcccugacaggcgcuaccgagauucagaugagcuccggaaaucuucuguuuacaggccaucucaaaugcagacugcggauggauaaacuucaacugaaagggaugucuuacagcauguguaccggaaaguucaagaucgugaaagaaauugcggagacccagcacggcacaaucgucaucagagugcaguaugagggggacggaucccccugcaagauucccuucgaaaucacggaucucgagaaacgccauguucugggccggcugauuaccgugaacccuaucgucacagggaaggacagcccggugaacauugaagccgagcccccuuuuggcgauucuuacaucauuaucggaguugaacccggccagcucaaacugaauugguucaagaagggguccagcaucggacaaauguuugagaccacaaugagaggcgcuaaacgcauggccauucuuggggacaccgccugggauuucggaucucugggcgggguguuuacgagcaucggcaaggcucuccaccaggucuucggagccauuuacggcgcggcuuuuuccggggugucuuggacaaugaaaauccugauuggagugaucaucaccuggauuggcaugaacagccgguccaccagccugucuguuucccuuguccucguggggguggucacacuguaucugggagccauggugcaggccgacagcggcuguguugugucuuggaagaauaaagagcucaagugcggguccggcaucuucauuaccgauaacguccacacauggacggaacaguacaaguuucaaccugagagccccuccaaacuggcuucugccauccagaaggcucaugaagagggaauuuguggcaucagaagcgugacccgccuugaaaaucugauguggaaacagaucacaccggagcucaaccacauucuguccgagaaugaaguuaagcugaccaucaugacaggggacauuaaaggaaucaugcaggccggcaagcggucucuuagaccucaacccaccgagcucaaauauagcuggaagacgugggggaaggcgaaaaugcuguccaccgaaagccauaaccagacauuccugauugauggaccugagaccgccgaaugccccaauacaaaccgcgcuuggaacucucucgagguggaggacuacggcuuuggcgucuucaccacaaacaucuggcugaaacuucgggaaaaacaggacguguuuugugauuccaagcugaugagcgccgcuaucaaagacaauagagccguucacgcggauaugggguauuggauugagucugcccucaacgacaccuggaagauggaaaaggcuuccuucaucgaggugaaaagcugccacuggccuaagucucauacgcuguggagcaauggaguccuggaguccgaaaugauuauccccaaaaacuucgccggcccggugagccagcacaacuaccgcccuggguaucauacacaaaccgcuggacccuggcaccuuggcaagcucgagauggauuuugacuucugugaagggaccacaguggucguuaccgaggauugcggaaaucggggccccucucugagaacgacaaccgccuccggcaaacugauuacagaauggugcugucggagcugcacccucccuccgcugcgcuacagaggggaggacggauguugguacggcauggagauccggccccuuaaggaaaaggaggaaaaccuggugaauagccucgugacagccgggcauggacagauugauaacuuuucucugggcguccuggggauggcucuuuuccucgaggaaaugcugagaacccgcgugggaacgaaacacgcgauccugcucguugccgugagcuuugucacccugaucacaggcaauauguccuuccgggaccuuggcagagugaugguuauggugggggcuaccaugacagaugacauuggaaugggcgucaccuaucuggcccuccuggccgcuuuuaaggugcgcccuacguucgccgcggggcugcuucugagaaaacucacaucuaaggagcugaugauggcuaccaucggaauugcccuccugagccaguccacaauccccgagaccauucuugaacugaccgaugcccucgcucugggcaugaugguucugaaaaucgugcggaacauggagaaguaccaacuugccgucacagugauggcgaucucuugcgugccuaaugcugucauucugcagaacgccuggaagguuagcuguacgauccucgccgcuguguccgugagcccccugcuccugaccucuucccagcagaaagccgacuggauuccucuugcucugacaaucaaggggcucaaucccaccgccauuuuucugacaacccugagccgcacgucuaaaaagagauccuggccgcuuaacgaagcgaucauggccgucggaauggugagcauccuggcuucuucccuccugaaaaaugacauuccuaugacaggcccccucguugccggcgggcugcuuaccgugugcuauguccugaccggacggagcgcugaucuggagcucgaacgcgccgccgacgugaagugggaggaucaagcugagaucuccggcagcucuccuauucugagcaucacaauuuccgaagacgggucuaugagcaucaaaaacgaggaagaggagcagacccuuacaauucugaucagaacgggacuccugguuaucuccggcguguuccccgucucuauuccgaucaccgcggccgcuugguaccucugggaagugaagaagcagcgggccgggguccugugggaugugccuucucccccucccguuggaaaagccgagcuugaagacggcgcuuaucgcauuaagcagagaggcauccugggguacucccaaauuggagccggcguguauaaagaggggacauuucacaccauguggcaugucacacggggagcggugcugaugcaccgcggcaagagaaucgaacccuccugggcugauguuaaaaaggaccucaucagcuacgggggaggcuggaagcuggagggcgaguggaaagaaggggaggaagugcagguccuugcccuggagccuggaaagaauccgcgggccgugcagaccaaacccggcauuuucaagacggauaccgggacaaucggagcugugucccucgacuuuagcccuggcaccucugggucccccauuguugauagaaaaggaaaggucgugggccuguacggcaacgggguggucacacgcagcggagccuaugugucugcgaucgcucagaccgaaaaguccauugaggacaauccugagaucgaagaugacaucuuccggaaaaagagacucacaauuauggaccugcaucccggcgccgggaaaacgaagcgcuaccuuccugccaucguucgggaggcuauuaaaagaggacugcgcacccugauccucgccccgacacggguggucgcugccgaaauggaggaagcgcugagaggccuucccauucgcuaucaaaccccugccaucaaggcugagcacaccgggcgggagauuguggaucugaugugucaugccacauucacgaugagacuccugagccccguucgggugccuaacuacaaccucaucaucauggacgaagcucacuuuaccgaucccgccuccauugccgcucgcggcuauaucucuacaagagucgagaugggagaagcggccggcauuuucaugaccgcuacaccgccugggagccgggaccccuuuccccaguccaaugccccuaucauggaugaggagcgcgaaauucccgagagaagcuggaacucuggacacgaaugggugaccgacuucaagggcaaaacgguuugguuugugccuuccaucaaggccgggaaugauaucgcugccugccugcggaaaaacggaaagaaagucauucagcuuagcagaaagacauucgacucugaguacgugaagacccgcgcgaaugauugggacuuuguggucaccacagauaucagcgaaaugggcgcuaacuucaaagccgagcggguuauugacccgagacgcuguaugaagcccgugauccugaccgacggggaggaacgggugauucuggccggcccuaugcccgucacacauuccucugcugcccaaagacgcggacggaucggcagaaauccuaaaaacgagaaugaucaguauaucuacaugggggaaccccucgagaacgacgaagauugcgcgcacuggaaggaggccaaaaugcugcuugacaauauuaacaccccggagggaaucauuccuagcauguuugaacccgagcgcgaaaagguggaugcuaucgacggcgaguacagacugagaggggaagcccgcaaaacguucguugaucucaugagacggggagaccugccuguguggcuggcuuauaaggucgccgcugagggcauuaauuacgccgaucgcaagugguguuuugacgggaucaaaaacaaucagauucucgaggaaaacguggagguugaaaucuggacaaaggagggcgagcgcaagaaacuuaaaccccgguggcuggaugcgagaaucuauuccgacccucuggcccucaaggaguucaaggaguucgcugccggacgcaaaucucuggcucuuaaccugauuaccgaaaugggccggcuccccacauuuaugacccagaaggccagaaaugcccuggauaaccuggcugugcuccauacggcggaggccgggggacgcgcuuacaaucacgcccuuagcgaacugccggagacccuggagacacuccugcuucugacccuccuggccacagucaccggcgggaucuuccuguuucucauguccggaaaaggcauuggcaagaugacacuugggaugugcugcaucauuaccgcuagcgugcugcugugguaugcccaaauccagccucacuggaucgcggccucuauuauccucgaguucuuucugauuguccuucugauccccgagcccgaaaaacagcggacgccucaggacaaccaacucacauacgugguuauugcuauccugaccgugguggccgcuaccauggccaaugagaugggauuccuggaaaagacaaagaaagaccucggccuuggguccaucaccacacaggagagcgaguccaacauucuggauaucgaccugagaccggcgucugccuggacgcucuaugcugucgccaccacauuuguuacccccaugcugcggcauagcauugaaaauuccucugugaacgugagccuuacagcuaucgccaaucaggcuaccguccugaugggacucggcaagggguggccucuguccaaaauggauauuggagugccccugcucgccaucggcuguuacagccagguuaacccuauuacgcuuaccgcggcccugcugcuccugguggcucacuacgccaucaucggccccgggcuucaagcuaaggccacacgcgaggcccagaaaagagcggcugccggaauuaugaagaauccuaccgucgacggcaucacagugauugaucuggaaccgauccccuaugacccuaaguucgagaaacagcucgggcaggucaugcugcugauucucugcgugacccaaguucuuaugaugcggacgacaugggcucugugugaagcccugacccucgccacaggacccaucucuacccugugggagggcaacccugggcgcuuuuggaauaccacaaucgcuguguccauggccaacauuuucagaggaagcuaccuugcgggcgccggccugcucuuuucuaucaugaagaauacgaccaacacacggcgcgggaccggaaauauuggcgagacacugggggaaaaauggaaguccagacugaacgcucucggaaaaagcgaguuccagaucuauaagaaaucuggcauucaggaagucgaucggacccuugccaaggaggggaucaagcgcggagagacggaccaucacgcugugagcagaggcuccgccaaacugcggugguuuguugaaagaaacauggugacacccgagggcaaggucguggaucuggggugcggacgcggcggguggucuuacuauuguggaggccucaaaaaugugcgggaaguuaaggggcugaccaaaggaggcccgggccaugaggaaccuauccccaugagcaccuacggguggaaccuugucagacugcaauccggaguggacguguucuucacacccccugagaagugcgauacccuccugugugacauuggcgagagcucccccaauccuacaaucgaagcggggcgcacgcugcggguccucaaccuuguugagaauuggcugaacaauaacacccaguuuugcauuaaggugcugaauccguauaugcccucugugaucgagaagauggagacacuccagagaaaguacggaggcgcccugguccgcaacccucuuagcagaaauuccacccacgaaauguacugggugucuaacgcuacagggaauauuguuagcuccgugaacaugaucucuagaaugcugaucaaucgcuucaccaugaaacacaagaaagccacguaugagcccgaugucgaccucggaagcggcacccggaacauuggcaucgaguccgaaauuccuaaccuggacaucauugggaagagaaucgagaagauuaaacaggaacaugagacaagcuggcacuacgaucaagaccaucccuauaagaccugggcuuaccacggaucuuaugaaacaaaacagaccggcuccgccagcucuauggugaaugggguugugcgccugcucacaaagccgugggaugucgugccuauggugacccagauggcuaugacggacacaacccccuuuggacagcaacgggucuucaaagagaagguugauaccagaacacaggagccuaaggaaggcacgaagaaacuuaugaaaaucaccgccgaguggcuguggaaagaacuggggaaaaagaaaacaccccgcauguguaccagagaggaguuuacacggaaggugcgcuccaacgcggcccucggagcuaucuucaccgacgaaaauaaguggaaaagcgccagagaggcuguggaagauggccgguuuugggagcuggucgacagagaacggaaccuucaccuggagggcaagugcgagacauguguguacaauaugauggggaaacgcgaaaagaaacucggagaguucggcaaggccaaggggucuagagccauuugguauauguggcugggagcgcgguuucuggaguucgaggcucucggcuuucugaacgaagaucauugguucucccgcgggaauagccuuuccggcguugagggagagggccugcacagacucggguacauccugcgggacgugggcaagaaggaaggcggggccauguacgccgaugacaccgcuggaugggacacgcgcauuacccuugaggaucugaaaaacgaagagauggucacaaaucauaugaagggcgaacacaaaaagcucgccgaggcuaucuuuaagcugaccuaucagaacaaagugguuagagugcagcggccuacaccccgcgggaccgucauggacauuaucagcagaaaggaucaacggggcucuggacaggugggcacguacgggcugaauacauucaccaacauggaggcccagcucauccgccaaauggaaggagagggcauuuucaaaagcauccagcaucugacagcgaccgaagagauugccguucagaauuggcuuacgagaguggggcgggagcgccuguccagaauggcuaucucuggagacgauugcgucgugaagccgauugacgaucgguuugccagcgcucucaccgcccugaacgacaugggcaaagucagaaaggauauccagcaaugggaaccuucccgcggguggaaugacuggacacaggugcccuucugcucucaccacuuucaugagcuuguuaugaaggauggccgggugcuggucgugcccuguagaaaccaggacgaacucaucggacgcgcgcggauuagccagggcgccggguggucccugaaagagaccgcuugccugggaaagucuuaugcccaaauguggacacucauguacuuccacagacgcgaucugcggcuugcugccaacgcuaucuguagcgccgugccuucccauuggguuccgaccagcagaacaaccuggucuauucacgcgaaacacgaauggaugacgacagaggacaugcuggccguguggaaucgcgucuggauccaggagaaccccuggauggaagacaagaccccuguggaguccugggaagagguucccuaucucggcaaacgggaagaucaguggugcgggagccugauuggacuuaccucuagagcuacaugggccaagaauauccagaccgccauuaaccaagugcgcucccugaucggcaaugaggaguacacagacuauaugccuagcaugaagcgguuuagacgggaagaggaagaggcugggguccucugguga

SEQ ID NO: 20009 - RNA, 9876 nt, Artificial Sequence
  derived and/or modified CDS sequence (opt5) from DENV-2__EU482608__SS-prME
accgccggcgugaucauuaugcugauccccacagcuauggccuuccaccucacgaccagaaauggggaaccucauaugauugucggacggcaggaaaagggcaagagccugcuuuuuaagacagaggacgggguuaauaugugcacccugauggcgaucgaucucggagaacugugugaggacacaauuaccuacaagugcccgcuucugagacaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcauugggaaggcucuccaccagguguucggcgccaucuacggagcggcuuuuuccggcguuucuuggacaaugaaaauccugauugggguggucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcaucuguggaauuagaagcgugacccgccuugagaaucugauguggaaacagaucacaccggagcucaaccacauucuguccgaaaaugaggucaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgauccugcucgucgccgugagcuuuguuacacugauuaccggaaauauguccuuccgggaccuuggcagagugauggucauggugggcgcuacaaugaccgaugacaucgggaugggaguuacguaucuggcccuccuggccgcuuuuaaggugcgcccuacauucgccgcgggccugcuucugagaaaacucaccucuaaggagcugaugauggcuacaauugggaucacccuccugagccaguccaccauucccgaaacaauccuugagcugacggaugcccucgcccugggaaugaugguccugaaaaucgugcggaacauggaaaaguaccaacuugcuguuaccauuauggccaucucuugcgugccuaaugcggucauucugcgcaacgcuuggaaggugagcuguacaauccucgccgccguguccgucagcccccugcuccugaccucuucccagcagaaagcugacuggauuccucuugcccugacaaucaagggccucaaucccaccgcuaucuuucugacgacacugagcagaaccucuaaaaagcgguccuggccgcuuaacgaggccauuauggcgguugggauggugagcauccuggccucuucccuccugaaaaaugacauuccuaugaccggaccccucguggcuggcggccugcuuacagucugcuaugugcugaccgggcgcagcgccgaucuggaacucgagagagcugccgacguuaagugggaggaucaggccgaaaucuccggaagcucuccuauucugagcaucacaauuuccgaggacggcucuaugagcaucaaaaacgaagaggaggaacaaacgcuuaccauccugauucggacagggcuccuggugaucuccggagucuuccccgugucuauuccgaucaccgcugcggccugguaccucugggagguuaagaagcagcgcgcuggcgugcugugggaugucccuucucccccucccguggggaaagccgaacuugaggacggagccuauagaauuaagcagcggggcauccugggcuacucccagaucggggcuggagucuauaaagaaggcacauuucacaccauguggcaugugacgcgcggggccguucugaugcacagaggaaagcggauugagcccuccugggcggaugugaaaaaggaccucaucagcuacggcgggggauggaagcuggagggcgaauggaaagagggcgaagagguccaagugcuugcucuggaaccugggaagaauccgagagccguucagaccaaacccggaauuuucaagacaaacaccggcacaaucggggccgugucccucgauuuuagcccuggaaccucuggcucccccauugucgaccgcaaagggaagguggugggacuguacggcaauggcguugucacacggagcggggcuuaugugucugccaucgcgcagacggagaaguccaucgaggauaacccugaaauugaggacgauaucuuccgcaagaagcgccucaccauuauggaccugcaucccggagcuggcaaaacaaagcgguaccuuccugccaucgugagagaagccauuaaacgcgggcugcggacccugauccucgcuccgaccagagucguggccgcugagauggaagaggcccugcgcggacuucccauucgguaucagaccccugcgaucaaggccgagcacacgggcagagaaaucguugaccugaugugucaugcuaccuucacaaugcggcuccugagccccgugcgcgucccuaacuacaaucucauuaucauggaugaggcccacuuuaccgaccccgcuuccauugccgccagaggguauaucucuacacggguggaaaugggcgaggcugcgggaauuuucaugaccgccacgccgccuggcagccgcgaucccuuuccccaauccaacgcuccuaucauggacgaggaaagagagauccccgaacggagcuggaacucugggcacgaguggguuacagauuucaagggaaaaaccgugugguuugucccuuccauuaaggccggcaacgacaucgccgcuugccugcgcaagaaugggaagaaagugauucagcuuagccgcaagaccuucgauucugaauacguuaagacacgggccaacgacugggauuuuguggucaccacagacaucagcgagaugggagcgaauuucaaagcugagagagugauugauccgcgccgguguaugaagcccgugauccugaccgacggcgaagagagagucauccuggccgggccuaugcccguuacgcauuccucugccgcucagcgccggggcagaauuggacgcaacccuaaaaaugaaaacgaccaauauaucuacaugggcgagccccucgaaaaugaugaggacugcgcccacuggaaggaggcgaaaaugcugcuugauaacauuaauacaccggaagggaucauuccuagcauguuugagcccgaaagagagaagguggacgccaucgauggagaauaccggcugcgcggcgaggcuagaaaaaccuucguggaccucaugcggcgcggggaucugccugucuggcuggccuauaagguggcugccgagggaauuaacuacgcugacagaaagugguguuuugauggcaucaaaaauaaccagauccucgaagagaacguugaaguggagauuuggacaaaggagggggaacggaagaaacuuaaacccagauggcuggacgcccgcaucuauuccgauccucuggcgcucaaagaguucaaggaguucgccgcuggccggaaaucucugacccuuaaucugauuacggagaugggaagacuccccaccuuuaugacacagaaggcccgcaacgcucuggacaaucuggccguccuccauaccgccgaagcuggcgggcgggcguacaaccacgcccuuagcgagcugccggagacacuggaaacccuccugcuucugacacuccuggcuaccgugacgggaggcaucuuccuguuucucauguccgggaaaggaauuggcaagaugacacuuggcaugugcugcaucaucaccgccagcguucugcugugguaugcccagauucaaccucacuggaucgcugccucuauuauccucgaguucuuucugauugugcuucugauccccgaacccgagaaacagagaaccccucaggauaaucagcucacauacgucgugaucgcgauucugaccgucguggccgcuacaauggccaacgaaaugggguuccuggagaagacgaagaaagaccucggacuuggcuccaucaccacacaagagagcgaauccaauauucuggacaucgaucugcggccggcuucugccuggacccucuaugcgguugccacaaccuuugugacgcccaugcugcgccauagcauugagaacuccucugugaaugucagccuuaccgcuaucgccaaccaggcuacaguucugauggggcucggaaagggcuggccucuguccaaaauggacauuggggugccccugcucgccaucggauguuacagccaggugaauccuaucacccuuacagcugcccugcugcuccuggucgcgcacuacgccauuaucggccccggccuucaggcuaaggccaccagagaagcucaaaaacgggccgccgcggggauuaugaagaacccuacgguggauggaaucacaguuauugaccuggagccgauccccuaugauccuaaguucgaaaaacagcucggccaggugaugcugcugauccucugcgucacccaggugcuuaugaugcgcacaaccugggcucugugugaggcccugacccucgcuacagggcccauuucuacgcugugggagggaaauccuggcagauuuuggaacaccacaaucgccgucuccauggccaauauuuuccgggggagcuaccuugcuggagccggccugcucuuuucuaucaugaagaacaccacaaauacccgcagaggcacggggaacauuggagaaacacugggcgagaaauggaagucccggcugaacgcgcucgggaaaagcgaguuccaaaucuauaagaaaucuggaauccaggagguggaccgcacccuugccaaggagggcauuaagagaggggaaaccgaucaucacgcuguuagccggggauccgccaaacugagaugguuuguggagcgcaauauggucacacccgaaggcaaggugguugaccugggcugcgggcggggaggcuggucuuacuauugugggggacucaaaaacgugagagaggucaagggccugaccaaagggggaccgggccaugaagaaccuauccccaugagcacauacggcuggaaucuugugcgccugcaguccgggguggauguuuucuucacgcccccugagaagugcgacacccuccugugugauauuggagaaagcucccccaacccuacaaucgaggcuggccggacccugagaguccucaaucuuguggaaaacuggcugaauaacaauacacaauuuugcauuaaggugcugaacccguauaugcccucugucaucgagaaaauggaaacccuccagcgcaaguacgggggagcccugguucggaauccucuuagcagaaacuccacgcacgagauguacugggugucuaaugcgaccggcaacaucgugagcuccgucaauaugauuucucgcaugcugaucaaccgguucacaaugaaacacaagaaagccaccuaugagcccgacguggaucucgggagcggaacaagaaacauuggcaucgaauccgagauuccuaaucuggacaucauuggcaagcgcaucgaaaagaucaaacaggagcaugaaaccagcuggcacuacgaccaggaucaucccuauaagacaugggcuuaccacgggucuuaugagaccaaacaaacgggauccgccagcucuaugguuaacggcgugguccggcugcucacaaagccgugggacgugguuccuauggugacccagauggcuaugaccgauacaacgcccuuugggcagcagagagucuucaaagagaagguggacacccgcacacaagaaccuaaggagggaaccaaaagacuuaugcggauuacagccgaauggcuguggaaggagcugggcaaaaagaaaacacccagaauguguacaagagaggaauuuacccggaaggugagauccaaugcugcccucggggcgaucuucacggaugagaacaaauggaaaagcgcccgggaagcugucgaggacggacgcuuuugggaacugguugauaaggagagaaaucuucaccuggagggcaaaugcgaaaccuguguguacaacaugaugggcaagcgggagaaaaagcucggggaguucggaaaagccaagggcucucgcgcuauuugguauauguggcugggggccagauuucuggaguucgaagcccucggauuucugaaugaggaccauugguucucccggggcaacagccuuuccgggguggagggcgaaggacugcaccgccucggcuacauccugagagaugucgggaagaaagagggaggcgcgauguacgcugacgauacagccgggugggacacccggauuacacuugaagaccugaagaaugaggaaauggugaccaaccauaugaaaggagagcacaagaaacucgccgaggcuaucuuuaagcugacguaucagaucaagguugugcgcguccagagaccuacaccccggggcaccgugauggauauuaucagccgcagagaccagcgggggucuggccaaguuggaacauacggccugaauaccuucacgaacauggaagcccagcucauucgccagauggagggggaaggaaucuucaaaagcauucaacaucugaccgcuacagaggagaucgccgugcagaauuggcuugcgagagucggccgggaaagacugucccgcauggccaucucuggggaugacugcgugguuaagccgauugaugaccgguuugcuagcgcccucaccgcucugaacgauaugggaaaagugagaaaggacauccagcagugggagccuucccgcggcuggaaugauuggacacaaguccccuucugcucucaccacuuucaugaacuugugaugaaagacgggcggguccuggugguucccuguagaaaccaggaugagcucauuggccgcgcccggaucagccagggagcgggcuggucccugaaggaaaccgccugccuggggaagucuuaugcucagauguggacacucauguacuuccacagacgcgaccugcggcuugccgcuaacgccauuuguagcgcugugccuucccauugggucccgaccagcagaacgacauggucuauccacgccaaacacgaguggaugaccaccgaggauaugcuggcgguguggaaucgcguguggauucaagaaaaccccuggauggaggacaagacaccuguugaauccugggaggaagugcccuaucucggaaaacgggaggaccaguggugcggcagccugaucgggcuuaccucuagagccacaugggcuaagaauauccagacggccauuaaccagguccggucccugaucggaaaugaggaauacaccgauuauaugccuagcaugaaaagauuucgccgggaggaagaggaagccggcgugcucugguga

SEQ ID NO: 20010 - RNA, 9876 nt, Artificial Sequence
  derived and/or modified CDS sequence (opt5) from DENV-2__EU687220__SS-prME
accgcgggagugaucauuaugcugauccccacggcuauggccuuccaccucacgacccggaauggggaaccucauaugauuguuggacggcaggaaaagggcaagagccugcuuuuuaagaccgaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcacagacgggaaaagcgcuccguggcucucgugccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagaaggcccugauuuucauccuucugacagcgguggccccuagcaugacgaugagaugcauuggcaucuccaaccgggauuuugucgaaggggugucuggaggcagcuggguugacaucgugcucgagcacggguccugugucaccacaauggcuaagaauaaacccacccuggauuucgaacuuauuaagacagaggccaaacagccugcuacccugcgcaaguauugcaucgaagccaaacucacgaacacaaccaccgagagcagauguccgacacaaggagagcccucucugaaugaagaacaggacaagcgguuuauuugcaagcauuccaugguggaucgcggcuggggcaacggguguggacuguucggcaaagggggaaucgugaccugcgcgauguuuacaugcaagaaaaauauggaaggcaaggucguucucccugagaaccuggaauacacgauugugaucacaccccacagcggggaggagcaugccgugggaaaugacacaggcaaacacggcaaggaaaucaaaauuaccccucagucuuccaucacagaggcugaacuuaccggguauggaacggucaccauggaguguagccccagaacaggccuggauuucaacgaaauggugcuccugcagauggaggagaaggccuggcuuguucaccggcaaugguuucuggaccucccgcugccuuggcugcccggggcugauacccagggaucuaauuggauucagaaggaaacacucgugaccuucaaaaacccucaugccaagaaacaggacgucgugguucugggcucccaagagggggccaugcacacggcucuuacaggcgcgaccgaaauccagaugagcuccggaaaucugcucuuuacaggccaucugaagugccgccuuagaauggacaaacugcagcucaaggggaugucuuacagcauguguaccggaaaguucaaaauugugaaggagaucgccgagacccaacacggcacaaucgucauucgggugcaguaugaaggggauggaucccccugcaaaauccccuucgagauuauggaccuggaaaagagacauguccugggccgccucaucacggugaacccuauuguuaccgagaaagauagcccgaucaacauugaagcugagcccccuuuuggggacucuuacaucaucauuggcguggagcccggacagcugaaacuuaauugguucaagaaaggcuccagcaucgggcagauguuugaaacaaccaugcggggagccaagagaauggccauucugggcgauacagcuugggacuucgggucucucggaggcgucuuuaccagcaucgggaaagcccugcaccaaguguucggcgcgauuuacggagcugccuuuuccggcguuucuuggacgaugaagauccugaucggggugauuaucacauggauuggaaugaacagccgcuccaccagccuuucugucucccucgugcuggugggcguugucacccuguaucucggggccauggugcaggcugauagcggauguguggucucuuggaaaaauaaggagcugaagugcggcuccgggaucuucauuacagacaacgugcacaccuggacagaacaguacaaauuucagccugagagccccuccaaacuugccucugcuauccaaaaagcccaugaagagggcaucuguggcauucggagcguuacgagacuggagaaucucauguggaagcagaucaccccggaacugaaccacauucuguccgagaaugaagugaaacuuacaaucaugaccggcgauauuaaggggaucaugcaggcgggaaaacgcucucuccggccucagcccacagagcugaaguauagcuggaagaccuggggcaaagccaagaugcuguccacggaaagccauaaccaaaccuuccucaucgacgggccugagacagcugagugccccaauaccaacagagccuggaacucucuggaagucgaggauuacggauuuggcguguucuccacaaacauuuggcuuaaacugcgcgaaaagcaggacgucuuuugugacagcaaacucaugucugcugccaucaaggauaaucgggcggugcacgccgacaugggcuauuggauugaguccgcucugaacgauaccuggaagauggagaaagccagcuucaucgaagucaagucuugccacuggccuaaaagccauacacugugguccaauggggugcuugagagcgaaaugauuauccccaagaacuucgcuggaccgguuucucagcacaacuacagaccuggcuaucauacccagacggccgggcccuggcaccucggaaaacuggagauggacuuugauuucugugaaggcacaaccguggucgugaccgaggacugcgggaaucgcggacccucccugcggacaaccacggccagcggcaagcucauuacagaguggugcuguagauccugcacccugccuccgcuucgguaccgcggcgaagauggguguugguacggaauggagaucagaccccugaaggaaaaagaggaaaaccucgucaauucucuggucacagcuggccaugggcaaaucgacaacuuuagccugggaguucuuggcauggcccucuuccuggaggagaugcugcggaccagaguggggacaaagcacgccauucuccugguggcugucuccuuugugacccuuaucacgggaaauaugucuuuccgcgaucugggccggguuauggugauggucggcgccaccaugacagacgauauugggaugggagugaccuaucucgcccugcuggcugccuuuaaaguuagaccuacauucgcggcuggccuucugcuccgcaagcugaccagcaaagaacucaugauggccacgaucgggauugcccugcuuucccagucuacaauccccgagaccauccuggaacucacagacgcucuggcccugggaaugauggugcuuaagauugucagaaacauggagaaguaccagcuggcggugaccaucauggcuauuagcugcguuccuaaugccgugauccuccugaacgccuggaaagucuccuguaccauucucgcugccgugagcgugucuccccugcuucugacauccagccaacagaaggcugauuggaucccucucgcccugacgaucaaaggccugaaucccaccgcgauuuuucuuacaacccugucucggacauccaagaaacgcagcuggccgcucaacgaagccgucauggcuguugggauggugucuauccuggccuccagccuccugaagaaugacauuccuaugaccggaccccuuguggcuggcggccugcugacggucugcuaugugcucacagggagauccgccgaccuggagcuugagcgggccgcugauguuaaaugggaagaccacgcggagaucagcggaucuagcccuauucuguccaucaccauuucugaagauggcagcauguccaucaagaacgaggaggaagaacagacccucacaauccugauucgcaccgggcuccuggugaucucuggagucuuccccgugagcauuccgaucacagccgcugccugguaccuuugggaaguuaagaaacagagagccggcgugcugugggacgucccuucucccccucccguggggaaggcugagcuggaagauggagccuaucggauuaaacaacgcggcauccucggcuacagccagaucggggcgggagucuauaaggagggcacguuucauaccauguggcacgugacaagaggggcuguucugaugcaucggggaaaacgcauugagcccagcugggccgacgugaagaaggaucuuaucuccuacggcgggggauggaaacuggaaggcgaguggaaggaaggcgaggaaguccaggugcucgcccuggagccugggaaaaauccgagagcuguucagaccaagcccggacucuucaaaacaaacaccggcacgauuggggccgugagccuggacuuuucuccuggaaccuccggcagccccaucgucgaucggaaggggaagguggugggacuuuacggcaauggcguugucacaagaucuggggcguauguguccgcuauugcccaaaccgagaaaagcaucgaagacaacccugagaucgaagaugacauuuuccgcaagaaacggcugacaaucauggaucugcaccccggagccggcaagaccaaaagauaccucccugcuauugugcgcgaggccaucaagcgggggcugagaacacuuauucuggcuccgacgcgcgucguggccgcggaaauggaggaggcccuccggggacugcccaucagauaucagaccccugcuauucgcgccgaacauacaggccgggagaucguugaccucaugugucacgcuaccuucaccaugagacugcuuucccccgugcgggucccuaacuacaaucugaucauuauggacgaagcccacuuuacagaucccgccucuaucgcugcgcgcggguauauuagcacgagaguggagaugggcgaggccgcuggaaucuucaugaccgccacaccgccuggcucccgggaccccuuuccccagagcaacgccccuauuauggaugaagaacgcgaaauccccgagagaucuuggaacuccgggcaugaauggguuaccgacuucaagggaaaaacagugugguuugucccuagcaucaaggcuggcaacgauauugccgcgugccugcggaaaaaugggaagaaagugauccagcucucuagaaagaccuucgacagcgaguacguuaagacgcgcgcuaacgauugggacuuuguggucacaaccgauauuuccgagaugggagccaauuuccgggccgaaagagugaucgacccgcgccgguguaugaaacccgugauucugaccgauggcgaggaaagagucauccuugcugggccuaugcccguuacacacucuagcgccgcgcaacgccggggcagaaucggacgcaacccuaagaaugagaacgaccaguauauuuacaugggcgaaccccuggagaaugacgaggauugcgcccauuggaaagaagcuaagaugcuccuggacaacaucaauaccccggaggggauuaucccuuccauguuugaacccgagagagaaaaaguggaugccauugacggagaguaccggcugcgcggcgaggcuagaaagacauucguggaucucaugcggcgcggggaccuuccugucuggcuggccuauagaguggcugccgaaggaaucaacuacgcggaucggagaugguguuuugacggcauuaaaaauaaccagauccuggaggaaaacguugagguggagaucuggaccaaggaaggggagcgcaagaaacucaagccccgguggcuggaugccagaauuuauucugacccucuugcucugaaagaguucaaggaguucgccgcuggccgcaaaagccucacgcugaaucugaucacagaaaugggacggcuccccaccuuuaugacacaaaaggccagagaugcccuugacaaccuggcuguccugcacaccgcggaggccggcgggcgggcuuacaaucacgcccucuccgagcugccggaaacgcuugagacccugcuccugcugacacuccuugccaccgugacaggaggcauuuuccuguuucugaugagcgggaagggaaucggcaaaaugacccucggcaugugcugcauuaucacagcuucuauccugcuuugguaugcccagauucagccucauuggaucgcggccuccauuauccuggaguucuuucucauuguucugcugauccccgagcccgaaaagcagcgcaccccucaagauaaccagcucacguacguggucaucgcuauucuuacaguggucgccgcuaccauggccaaugagaugggguuccuggagaaaaccaagaaagaccugggacucggcagcaucacaacccaggaauccgagucuaacauucuggacaucgaucuuagaccggcgagcgccuggacacuguaugcuguggccacgaccuuuguuacacccaugcuccggcacuccauugaaaauucuagcgugaacgugucccugaccgcuaucgccaaucaggcuacaguccugauggggcucggaaagggcuggccucuuagcaagauggacauugggguuccccugcuggccaucggauguuacucucaagugaacccuaucacccucacggcggcccugcuucugcucguggcucauuacgccauuaucggccccggccugcaggcuaaagccacccgcgaggcccagaagagagcggcugccgggauuaugaaaaauccuacagucgauggaaucaccgugauugaccuggaaccgauccccuaugauccuaaguucgagaaacagcucggccaaguuaugcuucugauccugugcgugacacagguccucaugaugcggaccacgugggcucugugugaggcccuuacacuggccaccgggcccauuuccacacucugggaaggaaacccuggccgcuuuuggaauaccaccaucgcugugagcauggccaacauuuucagagggucuuaccuggcgggagccggccugcucuuuuccaucaugaagaauacaacgaacacccggcgcggcacagggaauauuggagagacccuuggcgaaaaguggaaaagcagacugaacgcucuggggaagucugaguuccagaucuauaaaaagagcggaauccaggaggucgaccggacacucgccaaagaaggcauuaagagaggggagaccgaucaccaugcugugucccgcggaucugccaaacugcggugguuuguugaaagaaacauggugacgcccgagggcaaggucguggaccuuggcugcgggcgcggaggcuggagcuacuauugugggggacugaagaauguucgggaagugaaaggccucacaaaagggggaccgggccacgaggagccuauccccauguccaccuacggcuggaaccuggucagacugcaaagcgggguggauguguucuucacacccccugaaaaaugcgacacacuccuuugugauauuggagaguccucucccaauccuaccaucgaagcgggccgcacacugcggguucugaaccucgucgagaauuggcugaacaauaacacgcaguuuugcauuaaggugcuuaauccguauaugcccagcgugaucgagaagauggagacccugcagagaaaguacgggggagcccucguccgcaacccucuguccagaaauucuacacacgagauguacuggguuagcaacgcuaccggcaauaucguguccucugugaacaugauuagcagaaugcugaucaaucgcuucacaaugaagcauaaaaaggccaccuaugaacccgacgucgaucucggguccggaacgcggaacauuggcaucgagagcgaaauuccuaaccuugacaucauuggcaaaagaaucgagaagaucaaacaagaacacgagaccucuuggcauuacgaccaggaucaccccuauaagacaugggcuuaccacggguccuaugagaccaagcagacaggaagcgccucuuccauggugaauggcguugugcgccugcugaccaaaccgugggacgucgugccuaugguuacacagauggcuaugaccgauacgacacccuuugggcaacagagaguguucaaggaaaaagucgacacccggacccaggagccuaaggaaggaaccaagaagcucaugcgcauuacggccgaguggcuguggaaggagcuuggcaaaaagaaaacccccagaauguguacacgggaagaguuuaccagaaaggugcggagcaacgcggcccugggggcuaucuucacagaugaaaauaaauggaagucugcccgcgaggcuguggaagacuccagauuuugggagcucgucgaucgggagcgcaaccugcaucuggaaggaaaaugcgagaccuguguuuacaauaugaugggcaagagagaaaagaaacucggcgaguucgggaaggccaaaggaagccgggccauuugguauauguggcugggcgcgcgcuuucuugaguucgaggcucugggguuucucaacgaggaccacugguucuccagaggaaauagccugucuggcguggaaggggagggccuucaucggcugggauacauccuccgcgaugugagcaagaaagaaggcggggccauguacgccgacgauacagcuggaugggacaccagaauuacgcuggaggaccugaagaacgaagagauggucaccaaucacaugaagggcgagcauaaaaagcucgccgaagcuaucuuuaaacugacauaucagaacaaggugguucgggugcaacgcccuacccccagagggacagucauggauaucauuucccggcgcgaccagagaggaucuggccagguggggaccuacggccuuaauacguucacaaacauggaggcccagcugauccggcaaauggaaggagagggcauuuucaaaagcauccagcaccucaccguuacagaggaaauugcggugcagaauuggcuggucagaguggggcgcgagcggcuuuccagaauggccaucucuggagaugacugcguugugaagccgcuggaugaccgcuuugcuagcgcccucaccgcucugaacgauaugggcaagguccggaaagacauccaacagugggaaccuuccagaggguggaaugauuggacacaggugcccuucugcucucaccauuuucacgagcuggucaugaaggacggacgcgugcucguugugcccugucggaaccaggaugaacugauuggcagagcccgcaucagccaaggggcgggcuggucccuuaaagagaccgccugccugggaaagagcuaugcucagauguggacacucauguacuuccaucggagagaccugcgccuugccgcuaacgccauuuguucugcugucccuucccacugggugccgaccagccggacaaccuggucuauccacgccaaacaugaguggaugacaaccgaagauaugcuggcgguguggaauagaguuuggauucaggagaaccccuggauggaagacaagacgccuguggaguccugggaagagguccccuaucucggcaagcgggaggaccaguggugcgggagccugaucggacugacauccagagccaccugggcuaaaaauauucaaaccgccaucaaccaggugcgcucucucaucggcaaugaagaguacacagauuauaugccuagcaugaagcgguuuagacgcgaagaggaagaggccgggguucugugguga

SEQ ID NO: 20011 - RNA, 9876 nt, Artificial Sequence
  derived and/or modified CDS sequence (opt5) from DENV-2__EU726775__SS-prME
accgccggagugaucgucaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaagaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugacuucugugagggcacaaccgugguggucacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccugguuaauucccucgugaccgccggccaugggcagauugauaacuuuucucugggagugcugggcauggcucuuuuccucgaagagaugcugagaacgcgcgucgggaccaaacacgcgauccugcucguggccguuagcuuugugacacugaucaccggaaauauguccuuccgggaccuuggcagagucauggugaugguuggcgcuacaaugaccgaugacauugggaugggagugacguaucuggcccuccuggccgcuuuuaagguccgcccuacauucgccgcgggccugcuucugagaaaacucaccucuaaggagcugaugauggcuacaaucgggauugcccuccugagccaguccaccauccccgaaaccauucuugagcugacagaugcccucgcucugggaaugauggugcugaaaaucguucggaacauggaaaaguaccaacuugccgugacgaucauggcgauuucuugcgucccuaaugcugugauccugcagaacgccuggaaggugagcuguaccauucucgccgcugucuccguuagcccccugcuccugacaucuucccagcagaaagccgacuggaucccucuugcucugaccauuaagggccucaaucccacagccaucuuucugaccacgcugagccgcacaucuaaaaagagauccuggccgcuuaacgaggcgaucauggccguggggauggugagcauucuggcuucuucccuccugaaaaaugacaucccuaugaccggaccccucgucgccggcggccugcuuaccgugugcuauguucugacagggcggagcgcugaucuggaacucgagcgcgccgccgacgugaagugggaggaucaagcugaaauuuccggaagcucuccuauccugagcauuaccaucuccgaggacggcucuaugagcauuaaaaacgaagaggaggaacagacacuuacgauccugaucagaaccgggcuccuggucauuuccggaguguuccccguuucuaucccgauuacagcggccgcuugguaccucugggaggugaagaagcagcgggccggcguccugugggaugugccuucucccccucccgucgggaaagccgaacuugaggacggagcuuaucgcaucaagcagagaggcauucugggcuacucccaaaucggggccggaguguauaaagaaggcaccuuucacacaauguggcauguuaccagaggggcggugcugaugcaccgcggaaagagaaucgagcccuccugggcugaugucaaaaaggaccucauuagcuacggcgggggauggaagcuggagggcgaauggaaagagggcgaagaggugcagguucuugcccuggaaccugggaagaauccgcgggccgugcagacgaaacccggaaucuucagaaccaacacaggcaccauuggggcuaucucccucgauuuuagcccuggaacaucuggcucccccauugucgaccgcaaggggaaaguggugggacuguacggcaauggcguugucacccggagcggggccuaugugucugcgaucgcucagacagagaaguccaucgaggauaacccugaaauugaggacgauaucuucagaaagaaacgccucacgauuauggaccugcaucccggagccggcaagaccaaacgguaccuuccugccaucgugagagaagcuauuaagcgcgggcugcggacacugauccucgccccgaccagagucguggcugccgagauggaagaggcgcugcgcggacuucccauucgguaucaaaccccugccaucaaagcugagcacacaggcagagaaaucguugaccugaugugucaugccacguucaccaugcggcuccugagccccgugcgcgucccuaacuacaaucucauuaucauggaugaggcucacuuuacagaccccgccuccauugccgcuagaggguauaucucuacccggguggaaaugggcgaggcggccggaauuuucaugacagcuaccccgccuggcagccgcgaucccuuuccccaguccaacgccccuaucauggacgaggaaagagagauccccgaacggagcuggaacucugggcacgaguggguuacggauuucaagggaaagacagugugguuugucccuuccauuaaagccggcaacgacaucgcugccugccugagaaagaaugggaaaaaggugauucagcuuagccgcaaaaccuucgauucugaauacguuaagacccgggcgaacgacugggauuuuguggucacaaccgacaucagcgagaugggagcuaauuucaaggccgagagagugauugauccgcgccgguguaugaaacccgugauccugacagacggcgaagagagagucauccuggccgggccuaugcccguuacccauuccucugcugcccaacgccggggcagaauuggacgcaacccuaagaaugaaaacgaccaguauaucuacaugggcgagccccucgaaaaugaugaggacugcgcgcacuggaaagaggccaagaugcugcuugauaacauuaauacgccggaagggaucauuccuagcauguuugagcccgaaagagagaaaguggacgcuaucgauggagaauaccggcugcgcggcgaggccagaaagacauucguggaccucaugcggcgcggggaucugccugucuggcuggcuuauaaaguggccgcugagggaauuaacuacgccgacagaaagugguguuuugauggcaucaagaauaaccagauccucgaagagaacguugaaguggagauuuggaccaaagagggggaacggaagaaacuuaagcccagauggcuggacgcgcgcaucuauuccgauccucuggcccucaaagaguucaaggaguucgcugccggccggaagucucugacacuuaaucugauuaccgagaugggaagacuccccacguuuaugacccagaaagcucgcaacgcccuggacaaucuggccguccuccauacagcugaagcgggcgggcgggccuacaaccacgcucuuagcgagcugccggagacccuggaaacacuccugcuucugacccuccuggccacagugaccggaggcaucuuccuguuucucauguccgggaagggaauuggcaaaaugacgcuuggcaugugcugcaucaucacagccagcauucugcugugguaugcucaaauccagccucacuggauugccgcgucuaucauucucgaguucuuucugaucguucuucugauccccgaacccgagaagcagagaaccccucaggauaaucaacucaccuacguggucauugccauccugacaguggucgcugccaccauggcuaacgaaaugggguuccuggagaaaacaaagaaggaccucggacuuggcuccauuacgacccaggagagcgaauccaauauccuggacauugaucugcggccggccucugcguggacacucuaugccguggcuaccacauuuguuacccccaugcugcgccauagcaucgagaacuccucugugaaugugagccuuacggccauugcuaaccaggccaccguccugauggggcucggaaaaggcuggccucuguccaagauggacaucgggguuccccugcucgcuaucggauguuacagccaggugaauccuauuacacuuaccgccgcgcugcugcuccugguggcccacuacgcuaucauuggccccggccuucaagccaaagcuacaagagaagcccagaagcgggccgcggcugggaucaugaaaaacccuaccgucgauggaauuacggugaucgaccuggagccgauccccuaugauccuaaguucgaaaagcagcucggccagguuaugcugcugauucucugcgugacacaaguccuuaugaugcgcaccacaugggcccugugugaggcucugacccucgccaccgggcccaucucuacacugugggagggaaauccuggcagauuuuggaacacgaccauugccguguccauggcuaauaucuuccgggggagcuaccuugccggagcgggccugcucuuuucuauuaugaaaaacacaaccaauacacgcagaggcaccgggaacaucggagaaacgcugggcgagaaguggaaaucccggcugaacgcccucggaaagagcgaguuccagaucuauaaaaagucuggcauucaggaggucgaccgcacacuugcuaaagagggcaucaagagaggggaaaccgaucaucacgccgugagccggggauccgcuaagcugagaugguuuguugagcgcaauauggugacccccgaaggcaaagucguggaccugggcugcgggcggggaggcuggucuuacuauugugggggacucaagaacguuagagaggugaaaggccugacaaaagggggaccgggccaugaagaaccuauucccaugagcaccuacggcuggaaucuuguccgccugcaauccgggguggauguguucuucacacccccugagaaaugcgacacgcuccugugugauaucggagaaagcucccccaacccuaccauugaggccggccggacacugagaguucucaaucuugucgaaaacuggcugaauaacaauacccaguuuugcaucaaggugcugaacccguauaugcccucugugaucgagaagauggaaacacuccagcgcaaauacgggggagcgcugguccggaauccucuuagcagaaacuccacccacgagauguacuggguuucuaaugccacgggcaacauugugagcuccgugaauaugaucucucgcaugcugauuaaccgguucaccaugaagcacaaaaaggcuacauaugagcccgacgucgaucucgggagcggaaccagaaacaucggcauugaauccgagaucccuaaucuggacauuaucggcaaacgcaucgaaaagauuaagcaggagcaugaaacaagcuggcacuacgaccaagaucaucccuauaaaaccugggccuaccacgggucuuaugagacaaagcagaccggauccgcuagcucuauggugaacggcguugugcggcugcucacgaaaccgugggacgucgugccuaugguuacacagauggccaugaccgauaccacacccuuugggcagcaaagaguguucaaggagaaagucgacacgcgcacccaggaaccuaaggagggaacaaagaaacuuaugaagaucaccgcugaauggcuguggaaagagcugggcaagaaaaagacacccagaauguguacccgggaggaauuuacacgcaaagugagauccaaugccgcgcucggggccauuuucaccgaugagaacaaguggaaaagcgcucgggaagccguggaggacggaagauuuugggaacuggucgaucgggagcgcaaucuucaccuggagggcaaaugcgaaacguguguuuacaacaugaugggcaagagagagaaaaagcucggggaguucggaaaagcuaagggcucucgggccaucugguauauguggcugggggcccgcuuucuggaguucgaagcgcucggauuucugaaugaggaccauugguucuccagaggcaacagccuuuccgggguggagggcgaaggacugcaccggcucggcuacauucugcgcgauguggggaagaaagagggaggcgcuauguacgccgacgauaccgccgggugggacacaagaaucacccuugaagaccugaagaaugaggaaauggucacaaaccauaugaaaggagagcacaagaaacucgcugaggccaucuuuaagcugaccuaucagaauaaggugguucgggugcagcgcccuacgcccagaggcacagucauggauauuaucagccggcgcgaccaaagagggucuggccaggugggaaccuacggccugaacacauucaccaauauggaagcucagcucauucggcaaauggagggggaaggaaucuuccgcagcauucagcaucugacggccaccgaggagaucgcgguucagaacuggcuugccagagugggccgggaaagacugucccgcauggcuaucucuggggaugacugcgucgugaaaccgauugaugaccgguuugccagcgcucucacagcccugaaugauaugggaaagguuagaaaagacauccagcaaugggagccuucccgcggcuggaacgauuggacccaggugcccuucugcucucaccacuuucaugaacuugucaugaaggacgggcgggugcuggucgugcccuguagaaaccaggaugagcucauuggccgcgcgcggaucagccagggagccggcuggucccugaaagaaacagcuugccuggggaagucuuaugcccaaauguggacccucauguacuuccacagacgcgaccugcggcuugcugccaaugcuauuuguagcgccguuccuucccauugggugccgacaagcagaaccacguggucuauccacgcgaagcacgaguggaugacaaccgaggauaugcuggccgucuggaaccgcguguggauucaggaaaaucccuggauggaggacaaaaccccuguggaauccugggaggaaguucccuaucucggaaagcgggaggaccaguggugcggcagccugaucgggcuuacaucuagagcuaccugggccaaaaacauccagacagccauuaaucaagugcggucccugaucggaaacgaggaauacacggauuauaugccuagcaugaagagauuucgccgggaggaagaggaagcuggcguccucugguga

SEQ ID NO: 20012 - RNA, 9876 nt, Artificial Sequence
  derived and/or modified CDS sequence (opt5) from DENV-2__FJ639732__SS-prME
accgccggcgugaucgucaugcugauucccacagcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugauugaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucgggguggugaucaccuggauuggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugagguuaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcuguuaaagacaauagagccgugcacgcggauaugggcuauuggaucgaaucugcccucaacgacacguggaagauggagaaggcuuccuucaucgaggucaaaagcugccacuggccuaagucucauacacuguggagcaauggggugcuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccgucguugugacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgucaccgccggccaugggcagauugauaacuuuucucugggagugcugggcauggcucuuuuccucgaagagaugcugagaacgcgcguugggaccaaacacgcgauccugcucguggccgucagcuuugugacacugauuaccggaaauauguccuuccgggaccuuggcagaguuauggugauggucggcgcuacaaugaccgaugacaucgggaugggagugacguaucuggcccuccuggccgcuuuuaagguucgcccuacauucgccgcgggccugcuucugagaaaacucaccucuaaggagcugaugauggcuacaaucgggauuacccuccugagccaguccaccauccccgaaacaauucuugagcugacggaugcccucgcccugggaaugauggugcugaaaaucguccggaacauggaaaaguaccaacuugcugugaccauuauggccaucucuugcgugccuaaugcggucauccugcgcaacgcuuggaagguuagcuguacaauucucgccgccguguccgugagcccccugcuccugaccucuucccagcagaaagcugacuggaucccucuugcccugacaauuaagggccucaaucccaccgcuaucuuucugacgacacugagcagaaccucuaaaaagcgguccuggccgcuuaacgaggccauuauggcggucgggauggugagcauccuggccucuucccuccugaaaaaugacaucccuaugaccggaccccucguugcuggcggccugcuuacagugugcuauguccugaccgggcgcagcgccgaucuggaacucgagagagcugccgacgugaagugggaggaucaggccgaaauuuccggaagcucuccuauccugagcauuacaaucuccgaggacggcucuaugagcauuaaaaacgaagaggaggaacaaacgcuuaccauccugauucggacagggcuccugguuaucuccggaguguuccccgucucuaucccgauuaccgcugcggccugguaccucugggaggugaagaagcagcgcgcuggcguccugugggaugugccuucucccccucccguugggaaagccgaacuugaggacggagccuauagaaucaagcagcggggcauucugggcuacucccagaucggggcuggaguguauaaagaaggcacauuucacaccauguggcaugucacgcgcggggccgugcugaugcacagaggaaagcggauugagcccuccugggcggauguuaaaaaggaccucaucagcuacggcgggggauggaagcuggagggcgaauggaaagagggcgaagaggugcaaguccuugcucuggaaccugggaagaauccgagagccgugcagaccaaacccggaaucuucaagacaaacaccggcacaauuggggccgugucccucgauuuuagcccuggaaccucuggcucccccaucguugaccgcaaagggaaggucgugggacuguacggcaauggcguggucacacggagcggggcuuaugugucugccauugcgcagacggagaaguccaucgaggauaacccugaaauugaggacgauaucuuccgcaagaagcgccucaccaucauggaccugcaucccggagcuggcaaaacaaagcgguaccuuccugccauuguuagagaagccaucaaacgcgggcugcggacccugauucucgcuccgaccagaguggucgccgcugagauggaagaggcccugcgcggacuucccauccgguaucagaccccugcgauuaaggccgagcacacgggcagagaaaucguggaccugaugugucaugcuaccuucacaaugcggcuccugagccccguucgcgugccuaacuacaaucucauuaucauggaugaggcccacuuuaccgaccccgcuuccaucgccgccagaggguauauuucuacacgggucgaaaugggcgaggcugcgggaaucuucaugaccgccacgccgccuggcagccgcgaucccuuuccccaauccaacgcuccuauuauggacgaggaaagagagauccccgaacggagcuggaacucugggcacgagugggugacagauuucaagggaaaaaccguuugguuugugccuuccauuaaggccggcaacgacaucgccgcuugccugcgcaagaaugggaagaaagucauccagcuuagccgcaagaccuucgauucugaauacgugaagacacgggccaacgacugggauuuuguggucaccacagacauuagcgagaugggagcgaauuucaaagcugagagaguuaucgauccgcgccgguguaugaagcccgugauucugaccgacggcgaagagagagugauccuggccgggccuaugcccgucacgcauuccucugccgcucagcgccggggcagaauuggacgcaacccuaaaaaugaaaacgaccaauauaucuacaugggcgagccccucgaaaaugaugaggacugcgcccacuggaaggaggcgaaaaugcugcuugauaacaucaauacaccggaagggauuaucccuagcauguuugagcccgaaagagagaagguggacgccauugauggagaauaccggcugcgcggcgaggcuagaaaaaccuucguugaccucaugcggcgcggggaucugccuguguggcuggccuauaaggucgcugccgagggaaucaacuacgcugacagaaagugguguuuugauggcauuaaaaauaaccagauccucgaagagaacguggaaguugagauuuggacaaaggagggggaacggaagaaacuuaaacccagauggcuggacgcccgcaucuauuccgauccucuggcgcucaaagaguucaaggaguucgccgcuggccggaaaucucugacccuuaaucugaucacggagaugggaagacuccccaccuuuaugacacagaaggcccgcaacgcucuggacaaucuggccgugcuccauaccgccgaagcuggcgggcgggcguacaaccacgcccuuagcgagcugccggagacacuggaaacccuccugcuucugacacuccuggcuaccgucacgggaggcauuuuccuguuucucauguccgggaaaggaaucggcaagaugacacuuggcaugugcugcauuaucaccgccagcgugcugcugugguaugcccagauucaaccucacuggaucgcugccucuaucauucucgaguucuuucugaucguccuucugauucccgaacccgagaaacagagaaccccucaggauaaucagcucacauacgugguuaucgcgauucugaccgugguggccgcuacaauggccaacgaaaugggguuccuggagaagacgaagaaagaccucggacuuggcuccaucaccacacaagagagcgaauccaauauccuggacauugaucugcggccggcuucugccuggacccucuaugcggucgccacaaccuuuguuacgcccaugcugcgccauagcaucgagaacuccucugugaaugugagccuuaccgcuauugccaaccaggcuacaguccugauggggcucggaaagggcuggccucuguccaaaauggacaucggggugccccugcucgccauuggauguuacagccagguuaauccuaucacccuuacagcugcccugcugcuccugguggcgcacuacgccauuaucggccccggccuucaggcuaaggccaccagagaagcucaaaaacgggccgccgcggggaucaugaagaacccuacggucgauggaauuacagugaucgaccuggagccgauucccuaugauccuaaguucgaaaaacagcucggccaggucaugcugcugauccucugcgugacccagguucuuaugaugcgcacaaccugggcucugugugaggcccugacccucgcuacagggcccauuucuacgcugugggagggaaauccuggcagauuuuggaacaccacaaucgccguguccauggccaauaucuuccgggggagcuaccuugcuggagccggccugcucuuuucuauuaugaagaacaccacaaauacccgcagaggcacggggaacaucggagaaacacugggcgagaaauggaagucccggcugaacgcgcucgggaaaagcgaguuccaaauuuauaagaaaucuggaauccaggaggucgaccgcacccuugccaaggagggcauuaagagaggggaaaccgaucaucacgcugugagccggggauccgccaaacugagaugguuuguugagcgcaauauggugacacccgaaggcaaggucguggaccugggcugcgggcggggaggcuggucuuacuauugugggggacucaaaaacgugagagagguuaagggccugaccaaagggggaccgggccaugaagaaccuauccccaugagcacauacggcuggaaucuuguccgccugcaguccgggguggauguguucuucacgcccccugagaagugcgacacccuccugugugauaucggagaaagcucccccaacccuacaauugaggcuggccggacccugagaguccucaaucuuguugaaaacuggcugaauaacaauacacaauuuugcaucaaggugcugaacccguauaugcccucugugauugagaaaauggaaacccuccagcgcaaguacgggggagcccugguccggaauccucuuagcagaaacuccacgcacgagauguacugggugucuaaugcgaccggcaacaucguuagcuccgugaauaugauuucucgcaugcugaucaaccgguucacaaugaaacacaagaaagccaccuaugagcccgacgucgaucucgggagcggaacaagaaacaucggcauugaauccgagaucccuaaucuggacauuaucggcaagcgcauugaaaagaucaaacaggagcaugaaaccagcuggcacuacgaccaggaucaucccuauaagacaugggcuuaccacgggucuuaugagaccaaacaaacgggauccgccagcucuauggugaacggcguugugcggcugcucacaaagccgugggacgucgugccuauggugacccagauggcuaugaccgauacaacgcccuuugggcagcagagagucuucaaagagaagguugacacccgcacacaagaaccuaaggagggaaccaagaaacuuaugagaauuacagccgaauggcuguggaaagagcugggcaaaaagaaaacaccccggauguguacacgcgaggaauuuaccagaaaagugcgguccaaugcugcccucggggcgaucuucacggaugagaacaaguggaaaagcgccagagaagcuguggaggacggacgguuuugggaacuggucgaucgcgagagaaaucuucaccuggagggcaaaugcgaaaccuguguguacaacaugaugggcaagcgggagaaaaagcucggggaguucggaaaagccaagggcucucgcgcuaucugguauauguggcugggggccagauuucuggaguucgaagcccucggauuucugaaugaggaccauugguucucccggggcaacagccuuuccgggguugagggcgaaggacugcaccgccucggcuacauucugagagauguggggaagaaagagggaggcgcgauguacgcugacgauacagccgggugggacacccggaucacacuugaagaccugaagaaugaggaaauggucaccaaccauaugaaaggagagcacaagaaacucgccgaggcuauuuuuaagcugacguaucagaauaaggugguucgcgugcagagaccuacaccccggggcaccgucauggauaucauuagccgcagagaccagcgggggucuggccaagugggaacauacggccugaacaccuucacgaauauggaagcccagcucauccgccagauggagggggaaggaaucuucaaaagcauucaacaucugaccgcuacagaggagaucgccguucagaacuggcuugcgagagugggccgggaaagacugucccgcauggccauuucuggggaugacugcgucgugaagccgaucgaugaccgguuugcuagcgcccucaccgcucugaaugauaugggaaaagucagaaaggacauucagcagugggagccuucccgcggcuggaacgauuggacacaagugcccuucugcucucaccacuuucaugaacuuguuaugaaagacgggcgggugcuggucgugcccuguagaaaccaggaugagcucaucggccgcgcccggaucagccagggagcgggcuggucccugaaggaaaccgccugccuggggaagucuuaugcucagauguggacacucauguacuuccacagacgcgaccugcggcuugccgcuaaugccauuuguagcgcugugccuucccauuggguuccgaccagcagaacgacauggucuauccacgccaaacacgaguggaugaccaccgaggauaugcuggcgguguggaaccgcgucuggauucaagaaaaucccuggauggaggacaagacaccuguggaauccugggaggaaguucccuaucucggaaaacgggaggaccaguggugcggcagccugaucgggcuuaccucuagagccacaugggcuaagaacauucagacggccaucaaucaggugcggucccugauuggaaacgaggaauacaccgauuauaugccuagcaugaaaagauuucgccgggaggaagaggaagccggcguccucugguga

SEQ ID NO: 20013 - RNA, 9876 nt, Artificial Sequence
  derived and/or modified CDS sequence (opt5) from DENV-2__FJ639733__SS-prME
acagccggcgugaucauuaugcugauccccacagcuauggccuuccaccucacgaccagaaauggggaaccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaucgaaaaggacagcccggugaacauugaggccgaacccccuuuuggggauucuuacaucaucauuggcgucgagcccggacagcucaaacugaauugguucaagaagggcuccagcaucgggcaaauguuugaggcuaccaugagaggagccaaacgcauggccauucuuggcgacacagcuugggauuucgggucucugggaggcgccuuuaccagcaucgggaaggcgcuccaccagguguucggcgcuauuuacggagccgccuuuuccggcguuucuuggacgaugaaaauccugaucgggguggucauuacauggaucggaaugaacagccgguccaccagccugucugugucccuugugcucguuggcgucgugacccuguaucugggggcuauggugcaggccgacagcggaugugucgugucuuggaagaauaaagaacucaagugcggcuccgggauuuucaucacagauaacguucacaccuggacagagcaguacaaguuucaaccugaaagccccuccaaacuggcuucugccauucagaaggcgcaugaggaaggcaucuguggaaucagaagcgugacgcgccuugagaaucugauguggaaacagauuaccccggagcucaaccacauccuguccgaaaaugaggucaagcugacaauuaugaccggcgacacaaaagggaucaugcaggccggaaagcggucucuuagaccucaacccaccgaacucaaauauagcuggaagacguggggcaaggcuaaaaugcuguccaccgagagccauaaccagacauuccugauugaugggccugaaaccgccgagugccccaauacaaaccgcgcuuggaacucucucgagguggaagacuacggauuuggcguuuucaccacaaacaucuggcugaaacuucgggagaaacaggacguguuuugugauuccaagcugaugagcgccgcgaucaaagacaauagagccguccacgcugauaugggcuauuggauugaaucugcccucaacgacaccuggaagauggagaaggcuuccuucaucgaggugaaaagcugccacuggccuaagucucauacgcuguggagcaaugggguucuggaauccgagaugauuauccccaaaaacuucgccggaccggugagccagcacaacuaccgcccuggcuaucauacacaaaccgccgggcccuggcaccuuggaaagcucgaaauggauuuugacuucugugagggcaccacagucguggugaccgaagauugcgggaaucggggacccucucugagaacgacaaccgcuuccggcaaacugauuacagaguggugcugucggagcugcacccucccuccgcugcgcuacagaggcgaggacggguguugguacggaauggaaauccggccccuuaaggagaaggaagagaaccuggucaauucccucguuacagcgggccaugggcagauugauaacuuuucucugggagugcugggcauggcccuuuuccucgaagagaugcugagaacccgcguggggacgaaacacgcuauccugcucgucgccgugagcuuuguuacccugaucacaggaaauauguccuuccgggaccuuggcagagugauggucauggugggcgccaccaugacagaugacauugggaugggaguuaccuaucuggcucuccuggccgcguuuaaggugcgcccuacguucgcugccggccugcuucugagaaaacucacaucuaaggagcugaugauggccaccaucgggauuacacuccugagccaguccaccauccccgaaaccauucuugagcugacagaugcucucgcccugggaaugaugguccugaaaaucgugcggaagauggaaaaguaccaacuugcgguuacgaucauggcuauuucuugcgugccuaacgccgucauccugcgcaaugccuggaaagugagcuguaccauucucgcugccguguccgucagcccccugcuccugacaucuucccagcagaaggcugacuggaucccucuugcccugaccauuaaaggccucaaccccacagcgaucuuucugaccacgcugagcagaacaucuaagaaacgguccuggccgcuuaaugaggccaucauggcuguugggauggugagcauucuggccucuucccuccugaagaacgacaucccuaugaccggaccccucguggcuggcggccugcuuaccgucugcuaugugcugacagggcgcagcgccgaucuggaacucgagagagccgcugacguuaaaugggaggaucaggcggaaauuuccggaagcucuccuauccugagcauuaccaucuccgaggacggcucuaugagcauuaagaaugaagaggaggaacaaacacuuacgauccugauccggaccgggcuccuggugauuuccggagucuuccccgugucuaucccgauuacagccgcugccugguaccucugggagguuaagaaacagcgcgccggcgugcugugggaugucccuucucccccucccguggggaaggcugaacuugaggacggagccuauagaaucaaacagcggggcauucugggcuacucccagaucggggcgggagucuauaaggaaggcaccuuucacacaauguggcaugugacccgcggggcuguucugaugcacagaggaaaacggaucgagcccuccugggccgaugugaagaaggaccucauuagcuacggcgggggauggaaacuggagggcgaauggaaggagggcgaagagguccaagugcuugcccuggaaccugggaaaaacccgagagcuguucagacgaagcccggaaucuucaaaaccaauacaggcaccauuggggccgugucccucgauuuuagcccuggaacaucuggcucccccaucgucgaccgcaaggggaagguggugggacuguacggcaacggcguugucacccggagcggggcguaugugucugcuauugcccagacagagaaauccaucgaggauaauccugaaaucgaggacgauauuuucagaaagaaacgccucacgaucauggaccugcaucccggagccggcaagaccaaacgguaccuuccugcuauugugagagaagccaucaagcgcgggcugcggacacugauucucgcuccgaccagagucguggccgcggagauggaagaggcccugcgcggacuucccauccgguaucagaccccugcuauuaaggccgagcacacaggcagagaaaucguugaccugaugugucaugcuacguucaccaugcggcuccugagccccgugcgcgucccuaacuacaaccucaucauuauggaugaggcccacuuuacagaccccgccuccaucgcugcgagaggguauauuucuacccggguggaaaugggcgaggccgcuggaaucuucaugacagccaccccgccuggcagccgcgaucccuuuccccaauccaaugccccuauuauggacgaggaaagagagauccccgaacggagcuggaacucugggcacgaguggguuacggauuucaaaggaaagacagugugguuugucccuuccaucaaagcuggcaaugacauugccgcgugccugagaaagaacgggaaaaaggugauccagcuuagccgcaagaccuucgauucugaauacguuaaaacccgggcuaaugacugggauuuuguggucacaaccgacauuagcgagaugggagccaacuucaaggccgagagagugaucgauccgcgccgguguaugaaacccgugauucugacagacggcgaagagagagucauccuggcugggccuaugcccguuacccauuccucugccgcgcagcgccggggcagaaucggacgcaauccuaagaacgaaaaugaccaauauauuuacaugggcgagccccucgaaaacgaugaggacugcgcccacuggaaagaggcuaagaugcugcuugauaauaucaacacgccggaagggauuaucccuagcauguuugagcccgaaagagagaaaguggacgccauugauggagaauaccggcugcgcggcgaggcuagaaagacauucguggaccucaugcggcgcggggaucugccugucuggcuggccuauaagguggcugccgagggaaucaauuacgcggacagaaaaugguguuuugauggcauuaagaacaaucagauccucgaagagaacguugaaguggagaucuggaccaaagagggggaacggaagaaacuuaagcccagauggcuggacgcccgcauuuauuccgauccucuggcucucaaggaguucaaagaguucgccgcuggccggaagucucugacacuuaaccugaucaccgagaugggaagacuccccacguuuaugacccagaaagcccgcaaugcccuggacaaccuggcuguccuccauacagcggaagccggcgggcgggcuuacaaucacgcccuuagcgagcugccggagacccuggaaacacuccugcuucugacccuccuggccacagugaccggaggcauuuuccuguuucucauguccgggaagggaaucggcaaaaugacgcuuggcaugugcugcauuaucacagcuagcguucugcugugguaugcccagauccaaccucacuggauugcggccucuaucauucucgaguucuuucugaucgugcuucugauucccgaacccgagaagcagagaaccccucaggauaaccagcucaccuacgucgugaucgcuauccugacagucguggccgcuaccauggccaaugaaaugggguuccuggagaagaccaagaaggaccucggacuuggcuccauuacgacccaagagagcgaauccaacauccuggacauugaucugcggccggcgucugccuggacacucuaugcuguugccaccacauuugugacccccaugcugcgccauagcaucgaaaauagcucugugaacgucagccuuacggcuauugccaaucaggcuaccguucugauggggcucggaaaaggcuggccucuguccaagauggacaucggggugccccugcucgccauuggauguuacagccaggugaacccuaucacacuuaccgcggcccugcugcuccuggucgcucacuacgccaucauuggccccggccuucaggcuaaagccacaagagaagcccaaaagcgggcggcugccgggaucaugaagaauccuaccguggauggaauuacgguuaucgaccuggagccgauucccuaugauccuaaauucgaaaagcagcucggccaggugaugcugcugauccucugcgucacacaggugcuuaugaugcgcaccacaugggcucugugugaggcccugacccucgccaccgggcccaucucuacacugugggagggaaacccuggcagauuuuggaauacgaccauugcugucuccauggccaacaucuuccgggggagcuaccuugcgggagccggccugcucuuuucuauuaugaaaaauacaaccaacacacgcagaggcaccgggaauaucggagaaacgcugggcgagaaguggaaaucccggcugaacgcucucggaaagagcgaguuccaaauuuauaaaaagucuggaauccaggagguggaccgcacacuugccaaggagggcaucaaaagaggggaaaccgaucaucacgcuguuagccggggauccgccaagcugagaugguuuguggagcgcaacauggucacccccgaaggcaaagugguugaccugggcugcgggcggggaggcuggucuuacuauugugggggacucaagaaugugagagaggucaaaggccugacaaaagggggaccgggccaugaagaaccuauucccaugagcaccuacggcuggaaccuugugcgccugcaguccgggguggauguuuucuucacacccccugagaagugcgacacgcuccugugugauaucggagaaagcucccccaauccuaccauugaggcgggccggacacugagaguccucaaccuuguggaaaauuggcugaacaauaacacccaauuuugcaucaaagugcugaauccguauaugcccucugucauugagaagauggaaacacuccagcgcaaauacgggggagcccugguucggaacccucuuagcagaaauuccacccacgagauguacugggugucuaacgcuacgggcaauaucgugagcuccgucaacaugaucucucgcaugcugauuaaucgguucaccaugaagcacaaaaaggccacauaugagcccgacguggaucucgggagcggaaccagaaacaucggcauugaauccgagaucccuaaccuggacauuaucggcaagcgcauugagaagaucaagcaggagcaugaaacaagcuggcacuacgaccaggaucaucccuauaaaaccugggcuuaccacgggucuuaugagacaaagcaaaccggauccgccagcucuaugguuaauggcgugguccggcugcucacgaaaccgugggacgugguuccuauggugacacagauggcuaugaccgauaccacacccuuugggcagcagagagucuucaaggagaagguggacacgcgcacccaagaaccuaaagagggaacaaagaaacuuaugagaaucaccgccgaauggcuguggaaggagcugggcaaaaagaaaacaccccggauguguacccgcgaggaauuuacaagaaaggugcgguccaacgcggcccucggggcuauuuucaccgaugagaauaaguggaaaagcgccagagaagcugucgaggacggacgguuuugggaacugguugauaaggagcgcaaccuucaccuggagggcaaaugcgaaacguguguguacaauaugaugggcaagagagagaaaaagcucggggaguucggaaaggccaaaggcucucgggccaucugguauauguggcugggggcgcgcuuucuggaguucgaagcucucggauuucugaacgaggaccauugguucuccagaggcaauagccuuuccgggguggagggcgaaggacugcaccggcucggcuacauucugcgcgaugucgggaagaaagagggaggcgccauguacgccgacgauaccgcugggugggacacaagaaucacccuugaagaccugaagaacgaggaaauggugacaaaucauaugaaaggagagcacaagaagcucgccgaggcuauuuuuaaacugaccuaucagaacaagguugugcggguccagcgcccuacgcccagaggcacagugauggauaucaucagccggcgcgaccagagagggucuggccaaguuggaaccuacggccugaauacauucaccaacauggaagcccagcucauucggcagauggagggggaaggaaucuucaaaagcauucaacaucugacggcgaccgaggagaucgccgugcagaauuggcuugcucgcgucggcagagaacggcuguccagaauggccauuucuggggaugacugcgugguuaagccgaucgaugaccgcuuugcuagcgcccucacagcgcugaacgauaugggaaaagugcggaaggacauccagcagugggagccuuccagaggcuggaaugauuggacccaaguccccuucugcucucaccacuuucaugaacuugugaugaaggacgggcgcguccuggugguucccugucggaaccaggaugagcucauuggcagagcccgcaucagccagggagcuggcuggucccugaaagaaacagccugccuggggaagucuuaugcucagauguggacccucauguacuuccaccggagagaccugcgccuugccgcuaacgccauuuguagcgcggugccuucccauugggucccgacaagccggaccacguggucuauccacgccaaacacgaguggaugacaaccgaggauaugcuggcuguguggaauagaguguggauucaagaaaaccccuggauggaggacaagaccccuguugaauccugggaggaagugcccuaucucggaaaacgcgaggaccaguggugcggcagccugaucgggcuuacaucucgggccaccugggccaagaauauucagacagcuaucaaccaggucagaucccugaucggaaaugaggaauacacggauuauaugccuagcaugaagcgguuuagacgcgaggaagaggaagccggcgugcucugguga

SEQ ID NO: 20014 - RNA, 9876 nt, Artificial Sequence
  derived and/or modified CDS sequence (opt5) from DENV-2__FJ639734__SS-prME
acagccggagugaucgucaugcugauucccacagcuaucgccuuccaccucacgaccagaaauggggagccucauaugauuguuggacggcaggaaaagggcaaaagccugcuuuuuaagacagaggacggggugaauaugugcacccugauggcgaucgaucucggagaacugugugaggacacaauuaccuacaaaugcccgcuucugagacaaaaugaacccgaggauaucgacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauucugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacaucguccucgagcacggguccugugugacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgucacaugcgccauguuuacgugcaaaaagaauauggaaggcaaaguugugcagccugagaaccucgaauacaccauugugaucacaccccacagcggggaggagcaugcggucggaaaugacaccggcaagcacggcaaagaaaucaagauuacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgaucgugauuagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucaucggcguggagcccggacagcucaaacugaauugguucaagaagggcuccagcauugggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucgggguggugaucaccuggauuggaaugaacagccgguccacaagccugucuguuucccuuguccucgugggcguggucacccuguaucugggggccauggugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacacgaaagggauuaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaacucucucgagguggaagacuacggauuuggcgucuucaccacgaacauuuggcugaaacuucgggagaaacaggacguguuuugugauuccaagcugaugagcgccgcuaucaaagacaauagagccguucacgcggauaugggcuauuggaucgaaucugcccucaacgacacauggaagauggagaaggcuuccuucauugaggugaaaagcugccacuggccuaagucucauacccuguggagcaaugggguccuggaauccgagaugaucauucccaaaaacuucgccggaccggugagccagcacaacuaccgcccuggcuaucauacccaaacagcugggcccuggcaccuuggaaagcucgaaauggauuuugaccugugugagggcaccacgguggucguuacagaagauugcgggaaucggggacccucucugagaaccacaaccgccuccggcaaacucaucacagaguggugcugucggagcugcacccugccuccgcuucgcuacagaggcgaggacggguguugguacggaauggaaauucggccccugaaggagaaggaagagaaccucgugaauagccuggugacggccggccaugggcagaucgauaacuucucucugggaguccuuggcauggcucucuuucuggaagagaugcugagaacccgcguggggacaaaacacgcgauucuccugguugccgugagcuucgucacccuuaucacaggaaauauguccuuucgggaccugggcagagugaugguuauggugggcgcuaccaugacggaugacaucgggaugggagucacauaucucgcccugcuggccgcuuucaaggugcgcccuaccuuugccgcgggccuucugcucagaaaacugacaucuaaggagcucaugauggcuaccauugggaucgcccugcuuagccaguccaccauucccgaaacaauccuggagcucacggaugcccuggcucugggaaugaugguucuuaaaauugugcggaacauggaaaaguaccaacuggccgucaccaucauggcgaucucuugcgugccuaaugcugugauucuccgcaacgccuggaaggucagcuguacaauccuggccgcuguuuccgugagcccccuccugcuuaccucuucccagcagaaagccgacuggauuccucuggcucucacaaucaagggccugaaucccaccgccauuuuccugacgacacuuagcagaaccucuaaaaagcgguccuggccgcugaacgaggcgaucauggccguggggauggucagcauccucgcuucuucccugcucaaaaaugacauuccuaugaccggaccccugguggccggcggccuucugacaguuugcuaugugcugaccgggcgcagcgcugaucucgaacuggagagagccgccgaggucaagugggaagaccaggcugagaucuccggaagcucuccuauucuuagcaucacaauuuccgaagauggcucuaugagcaucaaaaacgaggaggaggaacaaacgcugaccauucucauccggacagggcugcucgugaucuccggaguuuuucccgugucuauuccgaucaccgcggccgcuugguaccugugggaagucaagaagcagcgcgccggcgugcuuugggacgucccuucucccccucccguggggaaagccgagcuggaagauggagcuuauagaauuaagcagcggggcauccugggcuacucccagauuggggccggaguuuauaaagagggcacauuccacaccauguggcaugugacgcgcggggcgguccucaugcacagaggaaagcggaucgagcccuccugggcugacgugaaaaaggaucugaucagcuacggcgggggauggaaacuugaaggcgaguggaaagaaggcgaggaaguucaagugcuggcccucgagccugggaagaauccgagagccguccagaccaaacccggaauuuuuaagacaaacaccggcacaaucggggcugugucccuggacuucagcccuggaaccucuggcucccccauuguggaucgcaaagggaagguugucggacucuacggcaauggcguggugacacggagcggggccuaugucucugcgaucgcucagacggagaaguccauugaagacaacccugagaucgaagaugacaucuuucgcaagaagcgccugaccauuauggaucuucaucccggagccggcaaaacaaagcgguaccugccugccaucgugagagaggcuauuaaacgcgggcugcggacccucauccuggccccgaccagaguuguggcugccgaaauggaggaggcgcuucgcggacugcccauucgguaucagaccccugccaucaaggcugaacacacgggcagagagauugucgaccucaugugucaugccaccuucacaaugcggcugcucagccccgugcgcguuccuaacuacaaucugaucaucauggacgaagcucacuucaccgaucccgccuccauugccgcuagaggguauaucucuacacggguggagaugggcgaggcggccggaauuuuuaugaccgcuacgccgccuggcagccgcgaccccuucccccaauccaacgccccuaucauggaugaagagagagaaauucccgagcggagcuggaacucugggcacgaaugggucacagacuuuaagggaaaaaccgugugguucguuccuuccaucaaggccggcaacgauaucgcugccugccuucgcaagaaugggaagaaagugauucagcugagccgcaagaccuuugacucugaguacgucaagacacgggcgaacgauugggacuucguggugaccacagauaucagcgagaugggagcuaauuuuaaagccgaaagagucauugacccgcgccgguguaugaagcccguuauccugaccgauggcgaggaaagagugauucucgccgggccuaugcccgugacgcauuccucugcugcccagcgccggggcagaaucggacgcaacccuaaaaaugagaacgaccaauauaucuacaugggcgaaccccuggagaaugacgaggauugcgcgcacuggaaggaagccaaaaugcuucuggacaacauuaauacaccggaggggaucauuccuagcauguucgaacccgagagagaaaaggucgaugcuaucgacggagaguaccggcuccgcggcgaggccagaaaaaccuuuguggaucugaugcggcgcggggaccugccuguuuggcucgcuuauaagguggccgcugaaggaauuaacuacgccgauagaaagugguguuucgacggcaucaaaaauaaccagauucuugaggaaaacgucgagguggagaucuggacaaaggaaggggagcggaaaaagcugaaacccagauggcuggaugcgcgcaucuauuccgacccucucgcccugaaggaauuuaaggaguucgcugccggccggaaaucucuuacccugaaucucauuacggaaaugggaagacugcccaccuucaugacacagaaggcucgcaacgcccuggauaaucucgccguucuucauaccgcugaggcgggcgggcgggccuacaaccacgcucugagcgagcugccggaaacacucgagacccugcuucugcucacacugcuggccaccgugacgggaggcaucuuucucuuccuuauguccgggaaaggaauuggcaagaugacacugggcaugugcugcaucauuaccgccagcguccugcucugguaugcucagauccaaccucacuggaucgccgcgucuauuauccuggaauuuuuccuuauugugcugcucauccccgagcccgaaaaacagagaaccccucaggacaaucagcugacauacgucgugauugccauccugaccguuguggcugccacaauggcuaacgagaugggguuucucgagaagacgaagaaagaucuuggacugggcuccaucaccacacaagaaagcgaguccaauauucuggacaucgaccuccggccggccucugcguggacccuguaugccguggcuacaaccuucgucacgcccaugcuucgccauagcauugaaaacuccucuguuaaugugagccugaccgccaucgcuaaccaggccacagugcucauggggcugggaaagggcuggccucuguccaaaauggauauuggggucccccuccuugcuaucggauguuacagccaggugaauccuauuacccugacagccgcgcugcuccugcuuguugcccacuacgcuaucaucggccccggccugcaggccaaggcuaccagagaggcccaaaaacgggccgcggcugggauuaugaagaacccuacgguggacggaaucacagucauugaucucgaaccgauccccuaugacccuaaguuugagaaacagcugggccaggugaugcugcucauucuuugcgucacccaggugcugaugaugcgcacaaccugggcccugugugaggcucucacccuggccacagggcccaucucuacgcuuugggaaggaaauccuggcagauucuggaacaccacaaucgccguuuccauggcuaauauuuuucgggggagcuaccuggccggagcgggccuccuguucucuaucaugaagaacaccacaaauacccgcagaggcacggggaacauuggagagacacugggcgaaaaauggaagucccggcucaacgcccuugggaaaagcgaguuucaaaucuauaagaaaucuggcauucaggagguggaucgcacccuggcuaaggaaggcaucaagagaggggagaccgaccaucacgccgucagccggggauccgcuaaacugagaugguucguggaacgcaauaugguuacacccgagggcaagguggucgaucucggcugcgggcggggaggcuggucuuacuauugugggggacugaaaaacgugagagaagugaagggccuuaccaaagggggaccgggccaugaggagccuauccccaugagcacauacggcuggaaucugguucgccuccaguccggggucgacguguuuuucacgcccccugaaaagugcgauacccugcugugugacauuggagagagcucccccaacccuacaaucgaagccggccggacccucagagugcuuaaucuggucgagaacuggcugaauaacaauacacaauucugcauuaagguucucaacccguauaugcccucugugaucgagaagauggagacccugcagcgcaaguacgggggagcgcuugugcggaauccucugagcagaaacuccacgcacgagauguacugggucucuaaugccaccggcaacauugugagcuccguuaauaugaucucucgcaugcucaucaaccgguuuacaaugaaacacaagaaagcuaccuaugaacccgauguggaccuggggagcggaacaagaaacauuggcaucgaguccgaaauuccuaaucuggauaucauuggcaagcgcaucgagaagauuaaacaggaacaugagaccagcuggcacuacgaccaggaccaucccuauaagacaugggccuaccacgggucuuaugagaccaaacaaacgggauccgcuagcucuauggucaacggcgugguucggcuccuuacaaagccgugggauguggucccuauggugacccagauggccaugaccgacacaacgcccuucgggcagcagagaguguuuaaagaaaaggucgauacccgcacacaagagccuaaggaaggaaccaaaaagcugaugaaaaucacagcugaguggcuguggaaggagcucggcaaaaagaaaacccccagaauguguacacgggaagaguucacccgcaagguuagauccaaugccgcgcugggggccaucuuuacggacgaaaacaaguggaaaagcgcucgggaggccguggaagauggaagauucugggagcuuguggaccgggagcgcaaucugcaccucgaaggcaagugcgagaccugugucuacaacaugaugggcaaaagagaaaagaaacugggggaguuuggaaaggcuaagggcucucgggccauuugguauauguggcugggggcccgcuuccucgaauuugaggcgcugggauuccuuaaugaggaucauugguuuuccagaggcaacagccuguccgggguggaaggcgagggacuccaccggcugggcuacauccuucgcgacguuagcaaaaaggaagggggagcuauguacgccgaugacacagccggcugggauaccagaauuacacuggaggaccucaaaaaugaagagauggugaccaaccauaugaagggggagcacaaaaagcuggcugaagccaucuucaagcugacguaucagaauaaagucgugcggguucagcgcccuacacccagaggaaccgugauggacauuaucucucggcgcgaucagagaggcagcgggcaagucggcacauacggacucaacaccuuuacgaauauggaggcucagcugauccggcagauggaaggcgaggggauuuucaaguccauccaacaucuuaccgccacagaggaaauugcggugcagaacuggcuggcccgcguuggaagagagcggcucucuagaauggcuaucagcggcgacgauugcguggucaaaccgauugacgaucgcuucgccuccgcucugaccgcccuuaaugacauggggaaggugcggaaagauauccagcagugggaaccuucuagaggauggaacgacuggacacaaguccccuuuugcagccaccacuuccaugagcuggugaugaaggauggccgcgcgcucguugugcccugucggaaccaggacgaacugaucgggagagcccgcaccucccagggcgcuggauggucucugaaggagacagccugccucggcaaaagcuaugcucagauguggacccugauguacuuucaccggagagaucuucgccuggccgcuaaugccauuuguuccgcggucccuagccauugggugccgacgucucggacaaccugguccauccacgccaagcacgaguggaugaccacagaagacaugcucgcuguguggaacagaguuuggauucaagagaaucccuggauggaagauaaaaccccuguggagagcugggaagagguccccuaucuggggaagcgcgaggaccaguggugcggaucucuuaucggccugacaucccgggccacgugggccaaaaacauucagaccgcuaucaaucaggugagaagccucauugggaacgaagaguacacagacuauaugccuuccaugaagcgguucagacgcgaagaggaagaggccggaguucugugguga

SEQ ID NO: 20015 - RNA, 9876 nt, Artificial Sequence
  derived and/or modified CDS sequence (opt5) from DENV-2__JN819408__SS-prME
acagccggagugaucgucaugcugauucccacagcuauggccuuccaccucacgacacggaauggggaaccucauaugaucguuggacggcaggaaaagggaaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacacgaaagggauuaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaacucucucgagguugaagacuacggauuuggcguguucaccacgaacauuuggcugaaacuucgggagaaacaggacaucuuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgccgugagcuuuguuacccugaucacaggaaauauguccuuccgggaccuuggcagagugauggucauggugggcgcuaccaugacggaugacauugggaugggaguuacauaucuggcccuccuggccgcuuuuaaggugcgcccuaccuucgccgcgggccugcuucugagaaaacucacaucuaaggagcugaugauggcuaccaucgggauugcccuccugagccaguccaccauccccgaaacaauucuugagcugacggaugcccucgcucugggaaugauggcccugaaaaucguccggaacauggaaaaguaccaacuugcggugaccaucauggcuauuucuugcguuccuaaugccgugauccugcagaacgccuggaaggucagcuguacaauucucgcugccguguccgugagcccccugcuccugaccucuucccagcagaaagcugacuggaucccucuugcccugacaauuaagggccucaaucccaccgcgaucuuucugacgacacugagccgcaccucuaaaaagagauccuggccgcuuaacgaggccaucauggcugucgggaugguuagcauucuggccucuucccuccugaaaaaugacaucccuaugaccggaccccucguggcuggcggccugcuuacagugugcuauguccugaccgggcggagcgccgaucuggaacucgagcgcgccgcugacgugaagugggaggaucaagcggaaauuuccggaagcucuccuauccugagcauuacaaucuccgaggacggcucuaugagcauuaaaaacgaagaggaggaacagacgcuuaccauccugaucagaacagggcuccugguuauuuccggaguguuccccgucucuaucccgauuaccgccgcugccugguaccucugggaggugaagaagcagcgggccggcguucugugggaugugccuucucccccucccgucgggaaagcugaacuugaggacggagccuaucgcaucaagcagagaggcauucugggcuacucccaaaucggggcgggaguguauaaagaaggcacauuucacaccauguggcaugucacgagaggggcugugcugaugcaccgcggaaagagaaucgagcccuccugggccgauguuaaaaaggaccucauuagcuacggcgggggauggaagcuggagggcgaauggaaagagggcgaagaggugcagguccuugcccuggaaccugggaagaauccgcgggcugugcagaccaaacccggaaucuucagaacaaacaccggcacaauuggggccguuucccucgauuuuagcccuggaaccucuggcucccccaucguggaccgcaaggggaaagucgugggacuguacggcaauggcgugguuacacggagcggggcguaugucucugcuauugcccagacggagaaguccaucgaggauaacccugaaaucgaggacgauauuuucagaaagaaacgccucaccaucauggaccugcaucccggagccggcaagacaaaacgguaccuuccugcuauugugagagaagccaucaagcgcgggcugcggacccugauucucgcuccgaccagaguggucgccgcggagauggaagaggcccugcgcggacuucccauccgguaucaaaccccugcuauuaaagccgagcacacgggcagagaaaucguggaccugaugugucaugcuaccuucacaaugcggcuccugagccccguucgcgugccuaacuacaaucucaucauuauggaugaggcccacuuuaccgaccccgccuccaucgcugcgagaggguauauuucuacacgggucgaaaugggcgaggccgcuggaaucuucaugaccgccacgccgccuggcagccgcgaucccuuuccccaguccaacgccccuauuauggacgaggaaagagagauccccgaacggagcuggaacucugggcacgagugggugacagauuucaagggaaagaccguuugguuugugccuuccaucaaagcuggcaacgacauugccgcgugccugagaaagaaugggaaaaaggucauccagcuuagccgcaaaaccuucgauucugaauacgugaagacacgggcuaacgacugggauuuuguugugaccacagacauuagcgagaugggagccaauuucaaggccgagagagucaucgauccgcgccgguguaugaaacccgugauucugaccgacggcgaagagagagugauccuggcugggccuaugcccgucacgcauuccucugccgcgcaacgccggggcagaaucggacgcaacccuaagaaugaaaacgaccaguauauuuacaugggcgagccccucgaaaaugaugaggacugcgcccacuggaaagaggcuaagaugcugcuugauaacaucaauacaccggaagggauuaucccuagcauguuugagcccgaaagagagaaaguugacgccauugauggagaauaccggcugcgcggcgaggcuagaaagaccuucguggaccucaugcggcgcggggaucugccuguguggcuggccuauaaagucgcugccgagggaaucaacuacgcggacagaaagugguguuuugauggcauuaagaauaaccagauccucgaagagaacguggaaguugagaucuggacaaaagagggggaacggaagaaacuuaagcccagauggcuggacgcccgcauuuauuccgauccucuggcucucaaagaguucaaggaguucgccgcuggccggaagucucugacccuuaaucugaucacggagaugggaagacuccccaccuuuaugacacagaaagcccgcaacgcccuggacaaucuggcugugcuccauaccgcggaagccggcgggcgggcuuacaaccacgcccuuagcgagcugccggagacacuggaaacccuccugcuucugacacuccuggccaccgucacgggaggcauuuuccuguuucucauguccgggaagggaaucggcaaaaugacacuuggcaugugcugcauuaucaccgcuagcauccugcugugguaugcccaaauucagccucacuggaucgcggccucuauuauccucgaguucuuucugauugugcuucugauccccgaacccgagaagcagagaaccccucaggauaaucaacucacauacguugugaucgcuauucugaccgucguggccgcuacaauggccaacgaaaugggguuccuggagaaaacgaagaaggaccucggacuuggcuccaucauuacccaggagagcgaaaauaacauccuggacauugaucugcggccggcguccgccuggacacucuaugcugucgccaccacauuugugacccccaugcugcgccauucuaucgagaauagcuccguuaacgugucucuuacggcuauugccaaucaggcuaccgugcugauggggcucggaaaaggcuggccucugagcaagauggacaucggggucccccugcucgccaucggauguuacucccagguuaacccuauuacacuuaccgcggcccugcugcuccugguggcucacuacgccaucauuggccccggccuucaagcuaaagccacaagagaagcccagaagcgggcggcugccgggaucaugaaaaauccuaccguggauggaauuacggucaucgaccuggagccgauccccuaugauccuaaguucgaaaagcagcucggccaggugaugcugcugauucucugcguuacacaagugcuuaugaugcgcaccacaugggcucugugugaggcccugacccucgccaccgggcccaucagcacacugugggagggaaacccuggcagauuuuggaauacgaccauugcugucucuauggccaacaucuuccggggguccuaccuugcgggagccggccugcucuuuagcauuaugaaaaauacaaccaacacacgcagaggcaccgggaacaucggagaaacgcugggcgagaaguggaaaucucggcugaaugcucucgggaaguccgaguuccagaucuauaaaaagagcggcauucaggagguggaccgcacacuugccaaagagggcaucaagagaggggaaaccgaucaucacgcugucucucggggaagcgccaagcugagaugguuuguggagcgcaacaugguuacccccgaaggcaaaguggucgaccugggcugcgggcggggaggcugguccuacuauugugggggacucaagaaugugagagagguuaaaggccugacaaaagggggaccgggccaugaagaaccuauucccaugucuaccuacggcuggaaccuugugcgccugcaaagcggggucgauguguucuucacacccccugagaaaugcgacacgcuccugugugauaucggagaauccagccccaauccuaccauugaggcgggccggacacugagagugcucaaccuuguugaaaauuggcugaacaauaacacccaguuuugcaucaagguccugaauccguauaugcccuccgugaucgagaagauggaaacacuccagcgcaaauacgggggagcccuggugcggaacccucuuucuagaaauagcacccacgagauguacugggucuccaacgcuacgggcaauauuguuucuagcgugaacaugaucucccgcaugcugauuaaccgguucaccaugaagcacaaaaaggccacauaugagcccgacguggaucucgggucuggaaccagaaauaucggcauugaaggcgagaucccuaaccuggacauuaucgggaaacgcaucgaaaagauuaagcaggagcaugaaacaagcuggcacuacgaccaagaucaucccuauaaaaccugggcuuaccacggauccuaugagacaaagcagaccggcagcgccucuuccauggucaauggggugguucggcugcucacgaaaccgugggacguggucccuauggugacacagauggcuaugaccgauaccacacccuuuggacagcaaagaguuuucaaggagaaaguggacacgcgcacccaggaaccuaaggagggcacaaagaaacuuaugaagaucaccgccgaauggcuguggaaagagcuggggaagaaaaagacacccagaauguguacccgggaggaauuuaccaagaagguccgcagcaacgcggcccucggagcuauuuucaccgaugagaauaaguggaaaucugccagagaagcuguggaggacggccgguuuugggaacugguggauagagagcggaaccuucaccuggagggcaagugcgaaacgugugucuacaauaugauggggaaacgcgagaagaaacucggagaguucggcaaggccaagggguccagagccaucugguauauguggcugggagcgcgguuucuggaguucgaagcucucggcuuucugaacgaggaccauugguucagccgcggaaauucucuuuccggcguugagggagaaggccugcacagacucggguacauucugcgggaugugggcaagaaggagggcggggccauguacgccgacgauaccgcuggaugggacacacgcaucacccuugaagaccugaaaaacgaggaaauggugacaaaucauaugaagggcgagcacaaaaagcucgccgaggcuaucuuuaagcugaccuaucagaacaaagucgugagaguucagcggccuacgccccgcgggacagugauggauauuaucagcagacgggaccaacgcggcuccggacaggucggcaccuacgggcugaauacauucaccaacauggaagcccagcucauuagacaaauggagggagaaggcaucuucaagagcauucagcaucugacggcgaccgaggagaucgccgugcagaauuggcuugcucggguugggcgcgaaagacugucucggauggccaucagcggagaugacugcguggucaaaccgauugaugacagauuugcuuccgcccucacagcgcugaacgauaugggcaaggugcgcaaagacauccagcaaugggagccuucucggggguggaacgauuggacccagguucccuucugcagccaccacuuucaugaacuugugaugaaggacggcagaguccuggugguccccugucgcaaucaggaugagcucauuggacgggccagaaucucccagggcgcuggguggucucugaaggaaacagccugccugggaaaaagcuaugcucaaauguggacccucauguacuuccaccgccgggaccugagacuugccgcuaacgccauuuguuccgcggugccuucucauuggguuccgacaagccgcaccacgugguccauccacgccaagcacgaguggaugacaaccgaggauaugcuggcuguguggaaucgggucuggauucaggaaaaccccuggauggaggacaaaaccccuguggaaagcugggaggaagugcccuaucucggcaagagagaggaccaguggugcgggucucugaucggacuuacaucccgcgccaccugggccaaaaauauccagacagcuauuaaccaaguucggagccugaucggcaaugaggaauacacggauuauaugccuucuaugaagagauuucggagagaggaagaggaagccggggugcucugguga

SEQ ID NO: 20016 - RNA, 9876 nt, Artificial Sequence
  derived and/or modified CDS sequence (opt5) from DENV-2__FJ639783__SS-prME
acagccggcgugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcguguccaaccgcgauuuuguugaaggggugucuggaggcagcugggucgacauugugcucgagcacggguccugugugacaaccauggccaagaauaagcccacacuggauuucgaacuuaucaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccauggucgauagaggcuggggcaacggguguggacuguucggcaaagggggaaucguuacaugcgccauguuuacgugcaaaaagaauauggaaggcaaaguggugcagccugagaaccucgaauacaccauugucaucacaccccacagcggggaggagcaugcggugggaaaugacaccggcaagcacggcaaagaaauuaagaucacaccucagucuuccaucaccgaggccgaacugacgggguauggaaccguuacaauggaguguagcccccggaccggccuugauuucaacgaaauggugcugcuccaaauggaggacaaggcuuggcugguccaccgccagugguuucuugaucugccgcucccuuggcugcccggggccgacacacagggaucuaauuggauucagaaggagacccuggugacguucaagaacccucaugcuaaaaagcaagacguugugguccucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgauugucaucagagugcaguaugagggggacggaucccccugcaagauccccuucgaaauuaccgaucucgagaaacgccauguucugggccggcugaucacagugaacccuauugucaccgaaaaggacagcccggugaacaucgaggccgaacccccuuuuggggauucuuacauuaucauuggcguugagcccggacagcucaaacugaauugguucaagaagggcuccagcaucgggcaaauguuugagacaaccaugagaggagcuaaacgcauggccauccuuggcgacacggccugggauuucgggucucugggaggcguguuuacaagcauugggaaggcucuccaccaggucuucggcgccaucuacggagcggcuuuuuccggcgugucuuggaccaugaaaauucugaucggggugauuaucaccuggaucggaaugaacagccgguccacaagccugucuguuucccuuguccucgugggcguggucacccuguaucugggggccauggugcaggccgacagcggauguguugugucuuggaagaauaaagaacucaagugcggcuccgggauuuucaucacagauaacguccacacguggaccgagcaguacaaguuucaaccugaaagccccuccaaacuggcuucugccauucagaaggcucaugaggaaggcaucuguggaauuagaagcgugacacgccuugagaaucugauguggaaacagaucaccccggagcucaaccacauccuguccgaaaaugagguuaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcuaucaaagacaauagagccguucacgcggauaugggcuauuggaucgaaucugcccucaacgacacguggaagauggagaaggcuuccuucauugaggugaaaagcugccacuggccuaagucucauacacuguggagcaaugggguccuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgugaccgccggccaugggcagaucgauaacuuuucucugggaguccugggcauggcucuuuuccucgaagagaugcugagaacgcgcguggggaccaaacacgcgauucugcucguugccgugagcuuugucacacugaucaccggaaauauguccuuccgggaccuuggcagagugaugguuauggugggcgcuacaaugaccgaugacaucgggaugggagucacguaucuggcccuccuggccgcuuuuaaggugcgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugaugguucugaaaauugugcggaacauggaaaaguaccaacuugccgucacggugauggcgaucucuugcgugccuaaugcugucauccugcagaacgccuggaagguuagcuguaccauucucgccgcuguguccgugagcccccugcuccugacaucuucccagcagaaagccgacuggaucccucuugcucugaccauuaagggccucaaucccacagccaucuuucugaccacgcugagccgcacaucuaaaaagagauccuggccgcuuaacgaggcgauuauggccgucgggauggugagcauccuggcuucuucccuccugaaaaaugacaucccuaugaccggaccccucguugccggcggccugcuuaccgugugcuauguccugacagggcggagcgcugaucuggaacucgagcgcgccgccgacgugaagugggaggaucaagcugaaauuuccggaagcucuccuauccugagcauuaccaucuccgaggacggcucuaugagcauuaaaaacgaagaggaggaacagacacuuacgauccugauuagaaccgggcuccugguuaucuccggaguguuccccgucucuaucccgauuacagcggccgcuugguaccucugggaggugaagaagcagcgggccggcguccugugggaugugccuucucccccucccguugggaaagccgaacuugaggacggagcuuaucgcaucaagcagagaggcauucugggcuacucccaaaucggggccggaguguauaaagaaggcaccuuucacacaauguggcaugucaccagaggggcggugcugaugcaccgcggaaagagaauugagcccuccugggcugauguuaaaaaggaccucaucagcuacggcgggggauggaagcuggagggcgaauggaaagagggcgaagaggugcagguccuugcccuggaaccugggaagaauccgcgggccgugcagacgaaacccggaaucuucaagaccaacacaggcaccauuggggcugugucccucgauuuuagcccuggaacaucuggcucccccaucguugacagaaaagggaaggucgugggacuguacggcaauggcguggucacccgcagcggggccuaugugucugcgauugcucagacagagaaguccaucgaggauaacccugaaauugaggacgauaucuuccggaaaaagagacucacgaucauggaccugcaucccggagccggcaaaaccaagcgcuaccuuccugccauuguucgggaagcuaucaaaagagggcugcgcacacugauucucgccccgacccggguggucgcugccgagauggaagaggcgcugagaggacuucccauccgcuaucaaaccccugccauuaaggcugagcacacaggccgggaaaucguggaccugaugugucaugccacguucaccaugagacuccugagccccguucgggugccuaacuacaaucucauuaucauggaugaggcucacuuuacagaccccgccuccaucgccgcucgcggguauauuucuaccagagucgaaaugggcgaggcggccggaaucuucaugacagcuaccccgccuggcagccgggaucccuuuccccaguccaacgccccuauuauggacgaggaacgcgagauccccgaaagaagcuggaacucugggcacgagugggugacggauuucaagggaaaaacaguuugguuugugccuuccauuaaggccggcaacgacaucgcugccugccugcggaaaaaugggaagaaagucauccagcuuagcagaaagaccuucgauucugaauacgugaagacccgcgcgaacgacugggauuuuguggucacaaccgacauuagcgagaugggagcuaauuucaaagccgagcggguuaucgauccgagacgcuguaugaagcccgugauucugacagacggcgaagaacgggugauccuggccgggccuaugcccgucacccauuccucugcugcccaaagacgcggccggauuggaagaaacccuaaaaaugaaaacgaccaguauaucuacaugggcgagccccucgaaaaugaugaggacugcgcgcacuggaaggaggccaaaaugcugcuugauaacaucaauacgccggaagggauuaucccuagcauguuugagcccgaacgcgagaagguggacgcuauugauggagaauacagacugcggggcgaggcccgcaaaacauucguugaccucaugagaagaggggaucugccuguguggcuggcuuauaaggucgccgcugagggaaucaacuacgccgaccgcaagugguguuuugauggcauuaaaaauaaccagauccucgaagagaacguggaaguugagauuuggaccaaggagggggaacgcaagaaacuuaaaccccgguggcuggacgcgagaaucuauuccgauccucuggcccucaaggaguucaaggaguucgcugccggccgcaaaucucugacacuuaaucugaucaccgagaugggacggcuccccacguuuaugacccagaaggcuagaaacgcccuggacaaucuggccgugcuccauacagcugaagcgggcgggcgcgccuacaaccacgcucuuagcgagcugccggagacccuggaaacacuccugcuucugacccuccuggccacagucaccggaggcauuuuccuguuucucauguccgggaaaggaaucggcaagaugacgcuuggcaugugcugcauuaucacagccagcgugcugcugugguaugcucaaauucagccucacuggaucgccgcgucuaucauucucgaguucuuucugaucguccuucugauucccgaacccgagaaacagcggaccccucaggauaaucaacucaccuacgugguuaucgccauucugacagugguggcugccaccauggcuaacgaaaugggguuccuggagaagacaaagaaagaccucggacuuggcuccaucacgacccaggagagcgaauccaauauccuggacauugaucugagaccggccucugcguggacacucuaugccgucgcuaccacauuuguuacccccaugcugcggcauagcaucgagaacuccucugugaaugugagccuuacggccauugcuaaccaggccaccguccugauggggcucggaaagggcuggccucuguccaaaauggacaucggggugccccugcucgcuauuggauguuacagccagguuaauccuaucacacuuaccgccgcgcugcugcuccugguggcccacuacgcuauuaucggccccggccuucaagccaaggcuacacgcgaagcccagaaaagagccgcggcugggaucaugaagaacccuaccgucgauggaauuacggugaucgaccuggagccgauucccuaugauccuaaguucgaaaaacagcucggccaggucaugcugcugauccucugcgugacacaaguucuuaugaugcggaccacaugggcccugugugaggcucugacccucgccaccgggcccauuucuacacugugggagggaaauccuggccgcuuuuggaacacgaccaucgccguguccauggcuaauaucuucagagggagcuaccuugccggagcgggccugcucuuuucuauuaugaagaacacaaccaauacacggcgcggcaccgggaacaucggagaaacgcugggcgagaaauggaaguccagacugaacgcccucgggaaaagcgaguuccagauuuauaagaaaucuggaauccaggaggucgaccggacacuugcuaaggagggcauuaagcgcggggaaaccgaucaucacgccgugagcagaggauccgcuaaacugcggugguuuguugagagaaauauggugacccccgaaggcaaggucguggaccugggcugcgggcgcggaggcuggucuuacuauugugggggacucaaaaacgugcgggagguuaagggccugacaaaagggggaccgggccaugaagaaccuauccccaugagcaccuacggcuggaaucuugucagacugcaauccgggguggauguguucuucacacccccugagaagugcgacacgcuccugugugauaucggagaaagcucccccaacccuaccauugaggccggccgcacacugcggguccucaaucuuguugaaaacuggcugaauaacaauacccaguuuugcaucaaggugcugaacccguauaugcccucugugauugagaaaauggaaacacuccagagaaaguacgggggagcgcugguccgcaauccucuuagccggaacuccacccacgagauguacugggugucuaaugccacgggcaacaucguuagcuccgugaauaugauuucuagaaugcugaucaaccgcuucaccaugaaacacaagaaagcuacauaugagcccgacgucgaucucgggagcggaacccggaacaucggcauugaauccgagaucccuaaucuggacauuaucggcaagagaauugaaaagaucaaacaggagcaugaaacaagcuggcacuacgaccaagaucaucccuauaagaccugggccuaccacgggucuuaugagacaaaacagaccggauccgcuagcucuauggugaacggcguugugcgccugcucacgaagccgugggacgucgugccuauggugacacagauggccaugaccgauaccacacccuuugggcagcaacgggucuucaaagagaagguugacacgagaacccaggaaccuaaggagggaaccaagaaacuuaugaaaauuaccgcugaauggcuguggaaggagcugggcaaaaagaaaacaccccgcauguguaccagagaggaauuuacacggaaggugcgcuccaaugccgcgcucggggccaucuucaccgaugagaacaaguggaaaagcgcuagagaagccguggaggacggacgguuuugggaacuggucgauagagagcggaaucuucaccuggagggcaagugcgaaacguguguguacaacaugaugggcaaacgcgagaagaaacucggggaguucggaaaggcuaagggcucuagagccaucugguauauguggcugggggcccgguuucuggaguucgaagcgcucggauuucugaaugaggaccauugguucucccgcggcaacagccuuuccgggguugagggcgaaggacugcacagacucggcuacauucugcgggauguggggaaaaaggagggaggcgcuauguacgccgacgauaccgccgggugggacacacgcaucacccuugaagaccugaaaaaugaggaaauggucacaaaccauaugaagggagagcacaaaaagcucgcugaggccauuuuuaagcugaccuaucagaauaaagugguuagagugcagcggccuacgccccgcggcacagucauggauaucauuagcagacgggaccaacgcgggucuggccaggugggaaccuacggccugaacacauucaccaauauggaagcucagcucaucagacaaauggagggggaaggaaucuucaagagcauucagcaucugacggccaccgaggagaucgcgguucagaacuggcuugcccgggugggccgcgaaagacugucccggauggcuauuucuggggaugacugcgucgugaaaccgaucgaugacagauuugccagcgcucucacagcccugaaugauaugggaaagguccgcaaagacauucagcaaugggagccuucccggggcuggaacgauuggacccaggugcccuucugcucucaccacuuucaugaacuuguuaugaaggacgggagagugcuggucgugcccugucgcaaccaggaugagcucaucggccgggcgagaaucagccagggagccggcuggucccugaaggaaacagcuugccuggggaaaucuuaugcccaaauguggacccucauguacuuccaccgccgggaccugagacuugcugccaaugcuauuuguagcgccgugccuucccauuggguuccgacaagccgcaccacguggucuauccacgcgaagcacgaguggaugacaaccgaggauaugcuggccguguggaaccgggucuggauucaggaaaaucccuggauggaggacaaaaccccuguggaauccugggaggaaguucccuaucucggaaagagagaggaccaguggugcggcagccugaucgggcuuacaucucgcgcuaccugggccaaaaacauucagacagccaucaaucaagugcggucccugauuggaaacgaggaauacacggauuauaugccuagcaugaagagauuucggagagaggaagaggaagcuggcguccucugguga

SEQ ID NO: 20017 - RNA, 9876 nt, Artificial Sequence
  derived and/or modified CDS sequence (opt5) from DENV-2__FJ639788__SS-prME
accgccggcgugaucgucaugcugauucccaccgcuauggccuuccaccucacgacccggaauggggagccucauaugaucguuggacggcaggaaaagggcaagagccugcuuuuuaagaccgaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccgcuggggagcaccggcgggaaaagcgcagcgucgcccucgugccucauguuggaaugggccuggagacacggaccgaaacguggauguccucugagggcgccuggaagcacgugcagcggaucgagacauggauccugcgccaucccggguucaccauuauggcugccauccucgcuuacacaauuggaaccacccacuuucagagagcccugaucuucauucuucugacagcggucgccccuagcaugacgaugcggugcaucggcguguccaaccgcgauuuuguugaaggggugucuggaggcagcugggucgacauugugcucgagcacggguccugugugaccacaauggcuaagaauaagcccacccuggauuucgaacuuaucaagacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccauggucgauagaggcuggggcaacggguguggacuguucggcaaagggggaaucguuaccugcgcgauguuuacaugcaaaaagaauauggaaggcaaaguggugcagccugagaaccucgaauacacgauugucaucacaccccacagcggggaggagcaugccgugggaaaugacacaggcaagcacggcaaagaaauuaagaucaccccucagucuuccaucacagaggcugaacugaccggguauggaacgguuaccauggaguguagcccccggacaggccuugauuucaacgaaauggugcugcuccaaauggaggacaaagccuggcugguccaccgccagugguuucuugaucugccgcucccuuggcugcccggggcugacacccagggaucuaauuggauucagaaggagacacuggugaccuucaagaacccucaugccaaaaagcaagacguugugguccucggcucccaggaaggggccaugcacacggcucugacaggcgcgaccgagauccagaugagcuccggaaaucuucuguuuacaggccaucucaaaugcagacugcggauggauaaacuucaacugaaagggaugucuuacagcauguguaccggaaaguucaagauugugaaagaaaucgccgagacccagcacggcacaauugucaucagagugcaguaugagggggacggaucccccugcaagauccccuucgaaauuacggaucucgagaaacgccauguucugggccggcugaucaccgugaacccuauugucacagaaaaggacagcccggugaacaucgaggcugaacccccuuuuggggauucuuacauuaucauuggcguugagcccggacagcucaaacugaauugguucaagaagggcuccagcaucgggcaaauguuugagaccacaaugagaggagccaaacgcauggccauccuuggcgacaccgcuugggauuucgggucucugggaggcguguuuacgagcauugggaaggcccuccaccaggucuucggcgcgaucuacggagcugccuuuuccggcgugucuuggacaaugaaaauucugaucggggugauuaucaccuggaucggaaugaacagccgguccaccagccugucuguuucccuuguccucgugggcguggucacacuguaucugggggccauggugcaggcugacagcggauguguugugucuuggaagaauaaagaacucaagugcggcuccgggauuuucaucaccgauaacguccacacauggacggagcaguacaaguuucaaccugaaagccccuccaaacuggccucugcuauucagaaggcccaugaggaaggcaucuguggaauuagaagcgugacccgccuugagaaucugauguggaaacagaucacaccggagcucaaccacauccuguccgaaaaugagguuaagcugaccauuaugacaggcgacaucaaagggauuaugcaggcgggaaagcggucucuuagaccucaacccaccgaacucaaauauagcuggaagacguggggcaaggccaaaaugcuguccaccgagagccauaaccagacauuccugaucgaugggccugaaaccgcugagugccccaauacaaaccgcgccuggaacucucucgagguggaagacuacggauuuggcgucuucaccacaaacauuuggcugaaacuucgggagaaacaggacguguuuugugauuccaagcugaugagcgcugccaucaaagacaauagagcgguucacgccgauaugggcuauuggaucgaaucugcucucaacgacaccuggaagauggagaaggccuccuucauugaggugaaaagcugccacuggccuaagucucauacgcuguggagcaaugggguccuggaauccgagaugaucauucccaaaaacuucgcuggaccggugagccagcacaacuaccgcccuggcuaucauacacaaaccgccgggcccuggcaccuuggaaagcucgaaauggauuuugacuucugugagggcaccacaguggucguuaccgaagauugcgggaaucggggacccucucugagaacgacaaccgccuccggcaaacugaucacagaguggugcugucggagcugcacccucccuccgcugcgcuacagaggcgaggacggguguugguacggaauggaaauucggccccuuaaggagaaggaagagaaccuggugaauagccucgugacagcuggccaugggcagaucgauaacuuuucucugggaguccugggcauggcgcuuuuccucgaagagaugcugagaacccgcguggggacgaaacacgccauucugcucguugcugugagcuuugucacccugaucacaggaaauauguccuuccgggaccuuggcagagugaugguuauggugggcgccaccaugacagaugacaucgggaugggagucaccuaucuggcccuccuggcugccuuuaaggugcgcccuacguucgcggcuggccugcuucugagaaaacucacaucuaaggagcugaugauggccaccauugggaucgcccuccugagccaguccacaauucccgaaaccauccuugagcugaccgaugcucucgcccugggaaugaugguucugaaaauugugcggaacauggaaaaguaccaacuugcggucacagugauggcuaucucuugcgugccuaaugccgucauccugcagaacgccuggaagguuagcuguacgauucucgcugccguguccgugagcccccugcuccugaccucuucccagcagaaagcugacuggaucccucuugcccugacaauuaagggccucaaucccaccgcgaucuuucugacaacccugagccgcacgucuaaaaagagauccuggccgcuuaacgaggccauuauggcugucgggauggugagcauccuggccucuucccuccugaaaaaugacaucccuaugacaggaccccucguugcuggcggccugcuuaccgugugcuauguccugaccgggcggagcgccgaucuggaacucgagcgcgccgcugacgugaagugggaggaucaagcggaaauuuccggaagcucuccuauccugagcauuacaaucuccgaggacggcucuaugagcauuaaaaacgaagaggaggaacagacccuuacaauccugauuagaacggggcuccugguuaucuccggaguguuccccgucucuaucccgauuaccgccgcugccugguaccucugggaggugaagaagcagcgggccggcguccugugggaugugccuucucccccucccguugggaaagcugaacuugaggacggagccuaucgcaucaagcagagaggcauucugggcuacucccaaaucggggcgggaguguauaaagaaggcacauuucacaccauguggcaugucacaagaggggcugugcugaugcaccgcggaaagagaauugagcccuccugggccgauguuaaaaaggaccucaucagcuacggcgggggauggaagcuggagggcgaauggaaagagggcgaagaggugcagguccuugcccuggaaccugggaagaauccgcgggcugugcagaccaaacccggaaucuucaagacgaacaccggcacaauuggggccgugucccucgauuuuagcccuggaaccucuggcucccccaucguugacagaaaagggaaggucgugggacuguacggcaauggcguggucacacgcagcggggcguaugugucugcuauugcccagaccgagaaguccaucgaggauaacccugaaauugaggacgauaucuuccggaaaaagagacucacaaucauggaccugcaucccggagccggcaaaacgaagcgcuaccuuccugcuauuguucgggaagccaucaaaagagggcugcgcacccugauucucgcuccgacacggguggucgccgcggagauggaagaggcccugagaggacuucccauccgcuaucaaaccccugcuauuaaggccgagcacaccggccgggaaaucguggaccugaugugucaugcuacauucacgaugagacuccugagccccguucgggugccuaacuacaaucucauuaucauggaugaggcccacuuuaccgaccccgccuccaucgcugcgcgcggguauauuucuacaagagucgaaaugggcgaggccgcuggaaucuucaugaccgccacaccgccuggcagccgggaucccuuuccccaguccaacgccccuauuauggacgaggaacgcgagauccccgaaagaagcuggaacucugggcacgagugggugaccgauuucaagggaaaaacgguuugguuugugccuuccauuaaggcuggcaacgacaucgccgcgugccugcggaaaaaugggaagaaagucauccagcuuagcagaaagacauucgauucugaauacgugaagacccgcgcuaacgacugggauuuuguggucaccacagacauuagcgagaugggagccaauuucaaagccgagcggguuaucgauccgagacgcuguaugaagcccgugauucugaccgacggcgaagaacgggugauccuggcugggccuaugcccgucacacauuccucugccgcgcaaagacgcggccggauuggaagaaacccuaaaaaugaaaacgaccaguauaucuacaugggcgagccccucgaaaaugaugaggacugcgcccacuggaaggaggcuaaaaugcugcuugauaacaucaauaccccggaagggauuaucccuagcauguuugagcccgaacgcgagaagguggacgccauugauggagaauacagacugcggggcgaggcucgcaaaacguucguugaccucaugagaagaggggaucugccuguguggcuggccuauaaggucgcugccgagggaaucaacuacgcggaccgcaagugguguuuugauggcauuaaaaauaaccagauccucgaagagaacguggaaguugagauuuggacaaaggagggggaacgcaagaaacuuaaaccccgguggcuggacgccagaaucuauuccgauccucuggcucucaaggaguucaaggaguucgccgcuggccgcaaaucucugacccuuaaucugaucacagagaugggacggcuccccaccuuuaugacgcagaaggccagaaacgcccuggacaaucuggcugugcuccauaccgcggaagccggcgggcgcgcuuacaaccacgcccuuagcgagcugccggagacacuggaaacccuccugcuucugacacuccuggccaccgucacaggaggcauuuuccuguuucucauguccgggaaaggaaucggcaagaugacccuuggcaugugcugcauuaucacggcuagcgugcugcugugguaugcccaaauucagccucacuggaucgcggccucuaucauucucgaguucuuucugaucguccuucugauucccgaacccgagaaacagcggacaccucaggauaaucaacucaccuacgugguuaucgcuauucugaccgugguggccgcuacaauggccaacgaaaugggguuccuggagaagaccaagaaagaccucggacuuggcuccaucacaacgcaggagagcgaauccaauauccuggacauugaucugagaccggcgucugccuggacccucuaugcugucgccacaaccuuuguuacacccaugcugcggcauagcaucgagaacuccucugugaaugugagccuuaccgcuauugccaaccaggcuacgguccugauggggcucggaaagggcuggccucuguccaaaauggacaucggggugccccugcucgccauuggauguuacagccagguuaauccuaucacccuuacagcggcccugcugcuccugguggcucacuacgccauuaucggccccggccuucaagcuaaggccacccgcgaagcccagaaaagagcggcugccgggaucaugaagaacccuacagucgauggaauuaccgugaucgaccuggagccgauucccuaugauccuaaguucgaaaaacagcucggccaggucaugcugcugauccucugcgugacgcaaguucuuaugaugcggacaaccugggcucugugugaggcccugacacucgccaccgggcccauuucuacccugugggagggaaauccuggccgcuuuuggaacacaacgaucgcuguguccauggccaauaucuucagagggagcuaccuugcgggagccggccugcucuuuucuauuaugaagaacaccacaaauacccggcgcggcacagggaacaucggagaaacccugggcgagaaauggaaguccagacugaacgcucucgggaaaagcgaguuccagauuuauaagaaaucuggaauccaggaggucgaccggacgcuugccaaggagggcauuaagcgcggggaaacagaucaucacgcugugagcagaggauccgccaaacugcggugguuuguugagagaaauauggugacccccgaaggcaaggucguggaccugggcugcgggcgcggaggcuggucuuacuauugugggggacucaaaaacgugcgggagguuaagggccugaccaaagggggaccgggccaugaagaaccuauccccaugagcacauacggcuggaaucuugucagacugcaauccgggguggauguguucuucacacccccugagaagugcgacacccuccugugugauaucggagaaagcucccccaacccuacgauugaggcgggccgcacccugcggguccucaaucuuguugaaaacuggcugaauuauaacacacaguuuugcaucaaggugcugaauccguacaugcccucugugauugagaaaauggaaacccuccagagaaaguacgggggagcccugguccgcaacccucuuagcagaaauuccacacacgagauguauugggugucuaacgcuaccggcaauaucguuagcuccgugaacaugauuucuagaaugcugaucaaucgcuucacgaugaaacacaagaaagccaccuacgagcccgacgucgaucucgggagcggaacacggaacaucggcauugaauccgagaucccuaaccuggacauuaucggcaagagaauugaaaagaucaaacaggagcaugaaaccagcuggcacuaugaccaagaucaucccuacaagacaugggcuuaucacgggucuuacgagaccaaacagacaggauccgccagcucuauggugaauggcguugugcgccugcucaccaagccgugggacgucgugccuauggugacgcagauggcuaugacagauaccacccccuuugggcagcaacgggucuucaaagagaagguugacacaagaacgcaggaaccuaaggagggaaccaagaaacuuaugaaaauuacagccgaauggcuguggaaagagcugggcaaaaagaaaacccccagaauguguacaagagaggaauuuacccggaaggugcgcuccaacgcggcccucggggcuaucuucacagaugagaauaaguggaaaagcgccagagaagcuguggaggacggacgguuuugggaacuggucgauagagagcggaaccuucaccuggagggcaagugcgaaaccuguguguauaauaugaugggcaaacgcgagaagaaacucggggaguucggaaaggccaagggcucuagagccaucugguacauguggcugggggcgcgguuucuggaguucgaagcucucggauuucugaacgaggaccauugguucucccgcggcaauagccuuuccgggguugagggcgaaggacugcacagacucggcuacauucugcgggauguggggaaaaaggagggaggcgccauguaugccgacgauacggcugggugggacacccgcaucacacuugaagaccugaaaaacgaggaaauggucaccaaucauaugaagggagagcacaaaaagcucgccgaggcuauuuuuaagcugacauaccagaacaaagugguuagagugcagcggccuacaccccgcggcacggucauggauaucauuagcagacgggaccaacgcgggucuggccaggugggaacauauggccugaauaccuucacaaacauggaagcccagcucaucagacaaauggagggggaaggaaucuucaagagcauucagcaucugaccgcgacggaggagaucgccguucagaauuggcuugcucgggugggccgcgaaagacugucccggauggccauuucuggggaugacugcgucgugaaaccgaucgaugacagauuugcuagcgcccucaccgcgcugaacgauaugggaaagguccgcaaagacauucagcaaugggagccuucccggggcuggaaugauuggacacaggugcccuucugcucucaccacuuucaugaacuuguuaugaaggacgggagagugcuggucgugcccugucgcaaccaggaugagcucaucggccgggccagaaucagccagggagcuggcuggucccugaaggaaaccgccugccuggggaaaucuuacgcucaaauguggacacucauguauuuccaccgccgggaccugagacuugccgcuaacgccauuuguagcgcggugccuucccauuggguuccgaccagccgcacaaccuggucuauccacgccaagcacgaguggaugacgacagaggauaugcuggcuguguggaaucgggucuggauucaggaaaaccccuggauggaggacaaaaccccuguggaauccugggaggaaguucccuaccucggaaagagagaggaccaguggugcggcagccugaucgggcuuaccucucgcgccacaugggccaaaaauauucagaccgcuaucaaccaagugcggucccugauuggaaaugaggaauauacagauuacaugccuagcaugaagagauuucggagagaggaagaggaagccggcguccucugguga

SEQ ID NO: 20018 - RNA, 9876 nt, Artificial Sequence
  derived and/or modified CDS sequence (opt5) from DENV-2__FJ639822__SS-prME
accgccggagugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaagacacaaucaccuacaaaugcccgcuucugagacaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcguguccaaccgcgauuuuguugaaggggugucuggaggcagcugggucgacauugugcucgagcacggguccugugugacaaccauggccaagaauaagcccacacuggauuucgaacuuaucaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccauggucgauagaggcuggggcaacggguguggacuguucggcaaagggggaaucguuacaugcgccauguuuacgugcaaaaagaauauggaaggcaaaguggugcagccugagaaccucgaauacaccauugucaucacaccccacagcggggaggagcaugcggugggaaaugacaccggcaagcacggcaaagaaauuaagaucacaccucagucuuccaucauugaggccgaacugaccggguauggaacgguuaccauggaguguagcccccggacaggccuugauuucaacgaaauggugcugcuccaaauggaggacaaggcuuggcugguccaccgccagugguuucuugaucugccgcucccuuggcugcccggggccgacacccagggaucuaauuggauccagaaggagacacuggugaccuucaagaacccucaugcuaaaaagcaagacguugugguccucggcucccaggaaggggccaugcacacggcccugacaggcgcuaccgagauucagaugagcuccggaaaucuucuguuuacaggccaucucaaaugcagacugcggauggauaaacuucaacugaaagggaugucuuacagcauguguaccggaaaguucaagaucgugaaagaaauugcggagacccagcacggcacaaucgucaucagagugcaguaugagggggacggaucccccugcaagauucccuucgaaaucacggaucucgagaaacgccauguucugggccggcugauuaccgugaacccuaucgucacagggaaggacagcccggugaacauugaagccgagcccccuuuuggcgauucuuacaucauuaucggaguugaacccggccagcucaaacugaauugguucaagaagggguccagcaucggacaaauguuugagaccacaaugagaggcgcuaaacgcauggccauucuuggggacaccgccugggauuucggaucucugggcgggguguuuacgagcaucggcaaggcucuccaccaggucuucggagccauuuacggcgcggcuuuuuccggggugucuuggacaaugaaaauccugauuggagugaucaucaccuggauuggcaugaacagccgguccaccagccugucuguuucccuuguccucguggggguggucacacuguaucugggagccauggugcaggccgacagcggcuguguugugucuuggaagaauaaagagcucaagugcggguccggcaucuucauuaccgauaacguccacacauggacggaacaguacaaguuucaaccugagagccccuccaaacuggcuucugccauccagaaggcucaugaagagggaauuuguggcaucagaagcgugacccgccuugaaaaucugauguggaaacagaucacaccggagcucaaccacauucuguccgagaaugaaguuaagcugaccaucaugacaggggacauuaaaggaaucaugcaggccggcaagcggucucuuagaccucaacccaccgagcucaaauauagcuggaagacgugggggaaggcgaaaaugcuguccaccgaaagccauaaccagacauuccugauugauggaccugagaccgccgaaugccccaauacaaaccgcgcuuggaacucucucgagguggaggacuacggcuuuggcgucuucaccacaaacaucuggcugaaacuucgggaaaaacaggacguguuuugugauuccaagcugaugagcgccgcuaucaaagacaauagagccguucacgcggauaugggguauuggauugagucugcccucaacgacaccuggaagauggaaaaggcuuccuucaucgaggugaaaagcugccacuggccuaagucucauacgcuguggagcaauggaguccuggaguccgaaaugauuauccccaaaaacuucgccggcccggugagccagcacaacuaccgcccuggguaucauacacaaaccgcuggacccuggcaccuuggcaagcucgagauggauuuugacuucugugaagggaccacaguggucguuaccgaggauugcggaaaucggggccccucucugagaacgacaaccgccuccggcaaacugauuacagaauggugcugucggagcugcacccucccuccgcugcgcuacagaggggaggacggauguugguacggcauggagauccggccccuuaaggaaaaggaggaaaaccuggugaauagccucgugacagccgggcauggacagauugauaacuuuucucugggcguccuggggauggcucuuuuccucgaggaaaugcugagaacccgcgugggaacgaaacacgcgauccugcucguugccgugagcuuugucacccugaucacaggcaauauguccuuccgggaccuuggcagagugaugguuauggugggggcuaccaugacagaugacauuggaaugggcgucaccuaucuggcccuccuggccgcuuuuaaggugcgcccuacguucgccgcggggcugcuucugagaaaacucacaucuaaggagcugaugauggcuaccaucggaauugcccuccugagccaguccacaauccccgagaccauucuugaacugaccgaugcccucgcucugggcaugaugguucugaaaaucgugcggaacauggagaaguaccaacuugccgucacagugauggcgaucucuugcgugccuaaugcugucauucugcagaacgccuggaagguuagcuguacgauccucgccgcuguguccgugagcccccugcuccugaccucuucccagcagaaagccgacuggauuccucuugcucugacaaucaaggggcucaaucccaccgccauuuuucugacaacccugagccgcacgucuaaaaagagauccuggccgcuuaacgaagcgaucauggccgucggaauggugagcauccuggcuucuucccuccugaaaaaugacauuccuaugacaggcccccucguugccggcgggcugcuuaccgugugcuauguccugaccggacggagcgcugaucuggagcucgaacgcgccgccgacgugaagugggaggaucaagcugagaucuccggcagcucuccuauucugagcaucacaauuuccgaagacgggucuaugagcaucaaaaacgaggaagaggagcagacccuuacaauucugaucagaacgggacuccugguuaucuccggcguguuccccgucucuauuccgaucaccgcggccgcuugguaccucugggaagugaagaagcagcgggccgggguccugugggaugugccuucucccccucccguuggaaaagccgagcuugaagacggcgcuuaucgcauuaagcagagaggcauccugggguacucccaaauuggagccggcguguauaaagaggggacauuucacaccauguggcaugucacacggggagcggugcugaugcaccgcggcaagagaaucgaacccuccugggcugauguuaaaaaggaccucaucagcuacgggggaggcuggaagcuggagggcgaguggaaagaaggggaggaagugcagguccuugcccuggagccuggaaagaauccgcgggccgugcagaccaaacccggcauuuucaagacgaacaccgggacaaucggagcugugucccucgauuuuagcccuggcaccucugggucccccauuguugacagaaaaggaaaggucgugggccuguacggcaaugggguggucacacgcagcggagccuaugugucugcgaucgcucagaccgaaaaguccauugaggauaacccugagaucgaagacgauaucuuccggaaaaagagacucacaauuauggaccugcaucccggcgccgggaaaacgaagcgcuaccuuccugccaucguucgggaggcuauuaaaagaggacugcgcacccugauccucgccccgacacggguggucgcugccgaaauggaggaagcgcugagaggccuucccauucgcuaucaaaccccugccaucaaggcugagcacaccgggcgggagauuguggaccugaugugucaugccacauucacgaugagacuccugagccccguucgggugccuaacuacaaucucaucaucauggaugaagcucacuuuaccgaccccgccuccauugccgcucgcggcuauaucucuacaagagucgagaugggagaagcggccggcauuuucaugaccgcuacaccgccugggagccgggaucccuuuccccaguccaacgccccuaucauggacgaggagcgcgaaauucccgagagaagcuggaacucuggacacgaaugggugaccgauuucaagggcaaaacgguuugguuugugccuuccaucaaggccgggaacgacaucgcugccugccugcggaaaaauggaaagaaagucauucagcuuagcagaaagacauucgauucugaguacgugaagacccgcgcgaacgacugggauuuuguggucaccacagacaucagcgaaaugggcgcuaauuucaaagccgagcggguuauugauccgagacgcuguaugaagcccgugauccugaccgacggggaggaacgggugauucuggccggcccuaugcccgucacacauuccucugcugcccaaagacgcggacggaucggcagaaacccuaaaaaugagaacgaccaguauaucuacaugggggaaccccucgagaaugaugaagacugcgcgcacuggaaggaggccaaaaugcugcuugauaacauuaauaccccggagggaaucauuccuagcauguuugaacccgagcgcgaaaagguggacgcuaucgauggcgaguacagacugagaggggaagcccgcaaaacguucguugaccucaugagacggggagaucugccuguguggcuggcuuauaaggucgccgcugagggcauuaacuacgccgaccgcaagugguguuuugaugggaucaaaaauaaccagauucucgaggaaaacguggagguugaaaucuggacaaaggagggcgagcgcaagaaacuuaaaccccgguggcuggacgcgagaaucuauuccgauccucuggcccucaaggaguucaaggaguucgcugccggacgcaaaucucuggcucuuaaucugauuaccgaaaugggccggcuccccacauuuaugacccagaaggccagaaacgcccuggacaaucuggcugugcuccauacggcggaggccgggggacgcgcuuacaaccacgcccuuagcgaacugccggagacccuggagacacuccugcuucugacccuccuggccacagucaccggcgggaucuuccuguuucucauguccggaaaaggcauuggcaagaugacacuugggaugugcugcaucauuaccgcuagcgugcugcugugguaugcccaaauccagccucacuggaucgcggccucuauuauccucgaguucuuucugauuguccuucugauccccgagcccgaaaaacagcggacgccucaggauaaucaacucacauacgugguuauugcuauccugaccgugguggccgcuaccauggccaacgagaugggauuccuggaaaagacaaagaaagaccucggccuuggguccaucaccacacaggagagcgaguccaauauucuggacaucgaucugagaccggcgucugccuggacgcucuaugcugucgccaccacauuuguuacccccaugcugcggcauagcauugaaaacuccucugugaaugugagccuuacagcuaucgccaaccaggcuaccguccugaugggacucggcaagggguggccucuguccaaaauggacauuggagugccccugcucgccaucggcuguuacagccagguuaauccuauuacgcuuaccgcggcccugcugcuccugguggcucacuacgccaucaucggccccgggcuucaagcuaaggccacacgcgaggcccagaaaagagcggcugccggaauuaugaagaacccuaccgucgauggcaucacagugauugaccuggaaccgauccccuaugauccuaaguucgagaaacagcucgggcaggucaugcugcugauucucugcgugacccaaguucuuaugaugcggacgacaugggcucugugugaagcccugacccucgccacaggacccaucucuacccugugggagggcaauccugggcgcuuuuggaacaccacaaucgcuguguccauggccaauauuuucagaggaagcuaccuugcgggcgccggccugcucuuuucuaucaugaagaacacgaccaauacacggcgcgggaccggaaacauuggcgagacacugggggaaaaauggaaguccagacugaacgcucucggaaaaagcgaguuccagaucuauaagaaaucuggcauucaggaagucgaccggacccuugccaaggaggggaucaagcgcggagagacggaucaucacgcugugagcagaggcuccgccaaacugcggugguuuguugaaagaaauauggugacacccgagggcaaggucguggaccuggggugcggacgcggcggguggucuuacuauuguggaggccucaaaaacgugcgggaaguuaaggggcugaccaaaggaggcccgggccaugaggaaccuauccccaugagcaccuacggguggaaucuugucagacugcaauccggaguggauguguucuucacacccccugagaagugcgacacccuccugugugauauuggcgagagcucccccaacccuacaaucgaagcggggcgcacgcugcggguccucaaucuuguugagaacuggcugaauaacaauacccaguuuugcauuaaggugcugaacccguauaugcccucugugaucgagaagauggagacacuccagagaaaguacggaggcgcccugguccgcaauccucuuagccggaacuccacccacgaaauguacugggugucuaaugcuacagggaacauuguuagcuccgugaauaugaucucuagaaugcugaucaaccgcuucaccaugaaacacaagaaagccacguaugagcccgacgucgaucucggaagcggcacccggaacauuggcaucgaguccgaaauuccuaaucuggacaucauugggaagagaaucgagaagauuaaacaggaacaugagacaagcuggcacuacgaccaagaucaucccuauaagaccugggcuuaccacggaucuuaugaaacaaaacagaccggcuccgccagcucuauggugaacgggguugugcgccugcucacaaagccgugggacgucgugccuauggugacccagauggcuaugacggauacaacccccuuuggacagcaacgggucuucaaagagaagguugacaccagaacacaggagccuaaggaaggcacgaagaaacuuaugaaaaucaccgccgaguggcuguggaaagaacuggggaaaaagaaaacaccccgcauguguaccagagaggaguuuacacggaaggugcgcuccaaugcggcccucggagcuaucuucaccgaugaaaacaaguggaaaagcgccagagaggcuguggaagacggccgguuuugggagcuggucgauagagaacggaaucuucaccuggagggcaagugcgagacauguguguacaacaugauggggaaacgcgaaaagaaacucggagaguucggcaaggccaaggggucuagagccauuugguauauguggcugggagcgcgguuucuggaguucgaggcucucggcuuucugaaugaagaccauugguucucccgcgggaacagccuuuccggcguugagggagagggccugcacagacucggguacauccugcgggaugugggcaagaaggaaggcggggccauguacgccgacgauaccgcuggaugggacacgcgcauuacccuugaggaccugaaaaaugaagagauggucacaaaccauaugaagggcgaacacaaaaagcucgccgaggcuaucuuuaagcugaccuaucagaauaaagugguuagagugcagcggccuacaccccgcgggaccgucauggauauuaucagcagaaaggaccaacggggcucuggacaggugggcacguacgggcugaacacauucaccaauauggaggcccagcucauccgccaaauggaaggagagggcauuuucaaaagcauccagcaucugacagcgaccgaagagauugccguucagaacuggcuuacgagaguggggcgggagcgccuguccagaauggcuaucucuggagaugacugcgucgugaagccgauugaugaccgguuugccagcgcucucaccgcccugaaugauaugggcaaagucagaaaggacauccagcaaugggaaccuucccgcggguggaacgauuggacacaggugcccuucugcucucaccacuuucaugagcuuguuaugaaggacggccgggugcuggucgugcccuguagaaaccaggaugaacucaucggacgcgcgcggauuagccagggcgccggguggucccugaaagagaccgcuugccugggaaagucuuaugcccaaauguggacacucauguacuuccacagacgcgaccugcggcuugcugccaaugcuaucuguagcgccgugccuucccauuggguuccgaccagcagaacaaccuggucuauucacgcgaaacacgaauggaugacgacagaggauaugcuggccguguggaaccgcgucuggauccaggagaaucccuggauggaagacaagaccccuguggaguccugggaagagguucccuaucucggcaaacgggaagaccaguggugcgggagccugauuggacuuaccucuagagcuacaugggccaagaacauccagaccgccauuaaucaagugcgcucccugaucggcaacgaggaguacacagauuauaugccuagcaugaagcgguuuagacgggaagaggaagaggcugggguccucugguga

SEQ ID NO: 20019 - RNA, 9876 nt, Artificial Sequence
  derived and/or modified CDS sequence (opt5) from DENV-2__FJ850112__SS-prME
accgccggcgugaucauuaugcugauccccacagcuauggccuuccaccucacgaccagaaauggggaaccucauaugauugucggacggcaggaaaagggcaagagccugcuuuuuaagacagaggacgggguuaauaugugcacccugauggcgaucgaucucggagaacugugugaggacacaauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaucgaaaaggacagcccggugaacauugaggccgaacccccuuuuggggauucuuacaucaucauuggcgucgagcccggacagcucaaacugaauugguucaagaagggcuccagcaucgggcaaauguuugagaccacaaugagaggagcuaaacgcauggccauucuuggcgacaccgccugggauuucgggucucugggaggcgcuuuuacgagcaucgggaaggcccuccaccagguguucggcgcgauuuacggagcugccuuuuccggcguuucuuggacaaugaaaauccugaucgggguggucauuaccuggaucggaaugaacagccgguccaccagccugucugugucccuugugcucguuggcgucgugacacuguaucugggggccauggugcaggcugacagcggaugugucgugucuuggaagaauaaagaacucaagugcggcuccgggauuuucaucaccgauaacguucacacauggacggagcaguacaaguuucaaccugaaagccccuccaaacuggccucugcuauucagaaggcccaugaggaaggcaucuguggaaucagaagcgugacccgccuugagaaucugauguggaaacagauuacaccggagcucaaccacauccuguccgaaaaugaggucaagcugaccauuaugacaggcgacaccaaagggaucaugcaggcgggaaagcggucucuuagaccucaacccacggaacucaaauauagcuggaagaccuggggcaaggccaaaaugcuguccacagagagccauaaccagaccuuccugauugaugggccugaaacagcugagugccccaauaccaaccgcgccuggaacucucucgagguggaagacuacggauuuggcguuuucacaaccaacaucuggcugaaacuucgggagaaacaggacguguuuugugauuccaagcugaugagcgcugccaucaaagacaauagagcgguccacgccgauaugggcuauuggauugaaucugcucucaacgacacguggaagauggagaaggccuccuucaucgaggugaaaagcugccacuggccuaagucucauacacuguggagcaaugggguucuggaauccgagaugauuauccccaaaaacuucgcuggaccggugagccagcacaacuaccgcccuggcuaucauacccaaaccgccgggcccuggcaccuuggaaagcucgaaauggauuuugacuucugugagggcacaaccgucguggugacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggucaauucccucguuaccgcuggccaugggcagauugauaacuuuucucugggagugcugggcauggcgcuuuuccucgaagagaugcugagaacgcgcguggggaccaaacacgccauccugcucgucgcugugagcuuuguuacacugaucaccggaaauauguccuuccgggaccuuggcagagugauggucauggugggcgccacaaugaccgaugacauugggaugggaguuacguaucuggcccuccuggcugccuuuaaggugcgcccuacauucgcggcuggccugcuucugagaaaacucaccucuaaggagcugaugauggccacaaucgggauuacccuccugagccaguccaccauccccgaaacaauucuugagcugacggaugcccucgcucugggaaugaugguccugaaaaucgugcggaagauggaaaaguaccaacuugccguuaccaucauggcgauuucuugcgugccuaacgcugucauccugcgcaaugccuggaaagugagcuguacaauucucgccgcuguguccgucagcccccugcuccugaccucuucccagcagaaggccgacuggaucccucuugcucugacaauuaaaggccucaaccccaccgccaucuuucugacgacacugagcagaaccucuaagaaacgguccuggccgcuuaaugaggcgaucauggccguugggauggugagcauucuggcuucuucccuccugaagaacgacaucccuaugaccggaccccucguggccggcggccugcuuacagucugcuaugugcugaccgggcgcagcgcugaucuggaacucgagagagccgccgacguuaaaugggaggaucaggcugaaauuuccggaagcucuccuauccugagcauuacaaucuccgaggacggcucuaugagcauuaagaaugaagaggaggaacaaacgcuuaccauccugauccggacagggcuccuggugauuuccggagucuuccccgugucuaucccgauuaccgcggccgcuugguaccucugggagguuaagaaacagcgcgccggcgugcugugggaugucccuucucccccucccguggggaaggccgaacuugaggacggagcuuauagaaucaaacagcggggcauucugggcuacucccagaucggggccggagucuauaaggaaggcacauuucacaccauguggcaugugacgcgcggggcgguucugaugcacagaggaaaacggaucgagcccuccugggcugaugugaagaaggaccucauuagcuacggcgggggauggaaacuggagggcgaauggaaggagggcgaagagguccaagugcuugcccuggaaccugggaaaaacccgagagccguucagaccaagcccggaaucuucaaaacaaauaccggcacaauuggggcugugucccucgauuuuagcccuggaaccucuggcucccccaucgucgaccgcaaggggaagguggugggacuguacggcaacggcguugucacacggagcggggccuaugugucugcgauugcucagacggagaaauccaucgaggauaauccugaaaucgaggacgauauuuucagaaagaaacgccucaccaucauggaccugcaucccggagccggcaagacaaaacgguaccuuccugccauugugagagaagcuaucaagcgcgggcugcggacccugauucucgccccgaccagagucguggcugccgagauggaagaggcgcugcgcggacuucccauccgguaucagaccccugccauuaaggcugagcacacgggcagagaaaucguugaccugaugugucaugccaccuucacaaugcggcuccugagccccgugcgcgucccuaacuacaaccucaucauuauggaugaggcucacuuuaccgaccccgccuccaucgccgcuagaggguauauuucuacacggguggaaaugggcgaggcggccggaaucuucaugaccgcuacgccgccuggcagccgcgaucccuuuccccaauccaaugccccuauuauggacgaggaaagagagauccccgaacggagcuggaacucugggcacgaguggguuacagauuucaaaggaaagaccgugugguuugucccuuccaucaaagccggcaaugacauugcugccugccugagaaagaacgggaaaaaggugauccagcuuagccgcaagaccuucgauucugaauacguuaaaacacgggcgaaugacugggauuuuguggucaccacagacauuagcgagaugggagcuaacuucaaggccgagagagugaucgauccgcgccgguguaugaaacccgugauucugaccgacggcgaagagagagucauccuggccgggccuaugcccguuacgcauuccucugcugcccagcgccggggcagaaucggacgcaauccuaagaacgaaaaugaccaauauauuuacaugggcgagccccucgaaaacgaugaggacugcgcgcacuggaaagaggccaagaugcugcuugauaauaucaacacaccggaagggauuaucccuagcauguuugagcccgaaagagagaaaguggacgcuauugauggagaauaccggcugcgcggcgaggccagaaagaccuucguggaccucaugcggcgcggggaucugccugucuggcuggcuuauaagguggccgcugagggaaucaauuacgccgacagaaaaugguguuuugauggcauuaagaacaaucagauccucgaagagaacguugaaguggagaucuggacaaaagagggggaacggaagaaacuuaagcccagauggcuggacgcgcgcauuuauuccgauccucuggcccucaaggaguucaaagaguucgcugccggccggaagucucugacccuuaaccugaucacggagaugggaagacuccccaccuuuaugacacagaaagcucgcaaugcccuggacaaccuggccguccuccauaccgcugaagcgggcgggcgggccuacaaucacgcucuuagcgagcugccggagacacuggaaacccuccugcuucugacacuccuggccaccgugacgggaggcauuuuccuguuucucauguccgggaagggaaucggcaaaaugacacuuggcaugugcugcauuaucaccgccagcguucugcugugguaugcucagauccaaccucacuggauugccgcgucuaucauucucgaguucuuucugaucgugcuucugauucccgaacccgagaagcagagaaccccucaggauaaccagcucacauacgucgugaucgccauccugaccgucguggcugccacaauggcuaaugaaaugggguuccuggagaagacgaaaaaggaccucggacuuggcuccauuaccacacaagagagcgaauccaacauccuggacauugaucugcggccggccucugcguggacccucuaugccguugcuacaaccuuugugacgcccaugcugcgccauagcaucgaaaauagcucugugaacgucagccuuaccgccauugcuaaucaggccacaguucugauggggcucggaaaaggcuggccucuguccaagauggacaucggggugccccugcucgcuauuggauguuacagccaggugaacccuaucacccuuacagccgcgcugcugcuccuggucgcccacuacgcuaucauuggccccggccuucaggccaaagcuaccagagaagcccaaaagcgggccgcggcugggaucaugaagaauccuacgguggauggaauuacaguuaucgaccuggagccgauucccuaugauccuaaauucgaaaagcagcucggccaggugaugcugcugauccucugcgucacccaggugcuuaugaugcgcacaaccugggcccugugugaggcucugacccucgccacagggcccaucucuacgcugugggagggaaacccuggcagauuuuggaauaccacaauugccgucuccauggcuaacaucuuccgggggagcuaccuugccggagcgggccugcucuuuucuauuaugaaaaauaccacaaacacccgcagaggcacggggaauaucggagaaacacugggcgagaaguggaaaucccggcugaacgcccucggaaagagcgaguuccaaauuuauaaaaagucuggaauccaggagguggaccgcacccuugcuaaggagggcaucaaaagaggggaaaccgaucaucacgccguuagccggggauccgcuaagcugagaugguuuguggagcgcaacauggucacacccgaaggcaaagugguugaccugggcugcgggcggggaggcuggucuuacuauugugggggacucaagaaugugagagaggucaaaggccugaccaaagggggaccgggccaugaagaaccuauucccaugagcacauacggcuggaaccuugugcgccugcaguccgggguggauguuuucuucacgcccccugagaagugcgacacccuccugugugauaucggagaaagcucccccaauccuacaauugaggccggccggacccugagaguccucaaccuuguggaaaauuggcugaacaauaacacacaauuuugcaucaaagugcugaauccguauaugcccucugucauugagaagauggaaacccuccagcgcaaauacgggggagcgcugguucggaacccucuuagcagaaauuccacgcacgagauguacugggugucuaacgccaccggcaauaucgugagcuccgucaacaugaucucucgcaugcugauuaaucgguucacaaugaagcacaaaaaggcuaccuaugagcccgacguggaucucgggagcggaacaagaaacaucggcauugaauccgagaucccuaaccuggacauuaucggcaagcgcauugagaagaucaagcaggagcaugaaaccagcuggcacuacgaccaggaucaucccuauaaaacaugggccuaccacgggucuuaugagaccaagcaaacgggauccgcuagcucuaugguuaauggcgugguccggcugcucacaaaaccgugggacgugguuccuauggugacccagauggccaugaccgauacaacgcccuuugggcagcagagagucuucaaggagaagguggacacccgcacacaagaaccuaaagagggaaccaagaaacuuaugagaaucacagcugaauggcuguggaaggagcugggcaaaaagaaaacaccccggauguguacacgcgaggaauuuaccagaaaggugcgguccaacgccgcgcucggggccauuuucacggaugagaauaaguggaaaagcgcuagagaagccgucgaggacggacgguuuugggaacugguugauaaggagcgcaaccuucaccuggagggcaaaugcgaaaccuguguguacaauaugaugggcaagagagagaaaaagcucggggaguucggaaaggcuaaaggcucucgggccaucugguauauguggcugggggcccgcuuucuggaguucgaagcgcucggauuucugaacgaggaccauugguucuccagaggcaauagccuuuccgggguggagggcgaaggacugcaccggcucggcuacauucugcgcgaugucgggaagaaagagggaggcgcuauguacgccgacgauacagccgggugggacaccagaaucacacuugaagaccugaagaacgaggaaauggugaccaaucauaugaaaggagagcacaagaagcucgcugaggccauuuuuaaacugacguaucagaacaagguugugcggguccagcgcccuacacccagaggcaccgugauggauaucaucagccggcgcgaccagagagggucuggccaaguuggaacauacggccugaauaccuucacgaacauggaagcucagcucauucggcagauggagggggaaggaaucuucaaaagcauucaacaucugaccgccacagaggagaucgcggugcagaauuggcuugcccgcgucggcagagaacggcuguccagaauggcuauuucuggggaugacugcgugguuaagccgaucgaugaccgcuuugccagcgcucucaccgcccugaacgauaugggaaaagugcggaaggacauccagcagugggagccuuccagaggcuggaaugauuggacacaaguccccuucugcucucaccacuuucaugaacuugugaugaaggacgggcgcguccuggugguucccugucggaaccaggaugagcucauuggcagagcgcgcaucagccagggagccggcuggucccugaaagaaaccgcuugccuggggaagucuuaugcccagauguggacacucauguacuuccaccggagagaccugcgccuugcugccaacgcuauuuguagcgccgugccuucccauugggucccgaccagccggacgacauggucuauccacgcgaaacacgaguggaugaccaccgaggauaugcuggccguguggaauagaguguggauucaagaaaaccccuggauggaggacaagacaccuguugaauccugggaggaagugcccuaucucggaaaacgcgaggaccaguggugcggcagccugaucgggcuuaccucucgggcuacaugggccaagaauauucagacggccaucaaccaggucagaucccugaucggaaaugaggaauacaccgauuauaugccuagcaugaagcgguuuagacgcgaggaagaggaagcuggcgugcucugguga

SEQ ID NO: 20020 - RNA, 9876 nt, Artificial Sequence
  derived and/or modified CDS sequence (opt5) from DENV-2__FJ850105__SS-prME
accgccggcgugaucauuaugcugauccccacagcuauggccuuccaccucacgaccagaaauggggaaccucauaugauuguuggacggcaggaaaagggcaagagccugcuuuuuaagacagaggacgggguuaauaugugcacccugauggcgaucgaucucggagaacugugugaggacacaauuaccuacaagugcccgcuucugagacaaaaugaacccgaggauaucgacuguuggugcaauuccacaucuaccugggugacguauggcaccuguacaaccacaggggagcacagacgggaaaagagaagcguggcucucgucccucaugugggaaugggccuggagaccagaacggaaacauggauguccucugagggcgccuggaagcacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcgcugagcccggacagcucaaacugaauugguucaagaagggcuccagcauugggcaaauguuugagaccacaaugagaggagccaaacgcauggccauccuuggcgacaccgcuugggauuucgggucucugggaggcguguuuacgagcauugggaaggcccuccaccaggucuucggcgcgaucuacggagcugccuuuuccggcgugucuuggacaaugaaaauccugauugggguugugaucaccuggauuggaaugaacagccgguccaccagccugucugucucccuugugcucgugggcguugucacacuguaucugggggccauggugcaggcugacagcggauguguggucucuuggaagaauaaagaacucaagugcggcuccgggaucuucauuaccgauaacgugcacacauggacggagcaguacaaguuucaaccugaaagccccuccaaacuggccucugcuauccagaaggcccaugaggaaggcaucuguggaauuagaagcguuacccgccuugagaaucugauguggaaacagaucacaccggagcucaaccacauucuguccgaaaaugaggugaagcugaccaucaugacaggcgacaccaaagggauuaugcaggcgggaaagcggucucuuagaccucaacccacggaacucaaauauagcuggaagaccuggggcaaggccaaaaugcuguccacagagagccauaaccagaccuuccugaucgaugggccugaaacagcugagugccccaauaccaaccgcgccuggaacucucucgaggucgaagacuacggauuuggcguguucacaaccaacaucuggcugaaacuucgggagaaacaggacgucuuuugugauuccaagcugaugagcgcugccauuaaagacaauagagcggugcacgccgauaugggcuauuggaucgaaucugcucucaacgacacguggaagauggagaaggccuccuucauugaggucaaaagcugccacuggccuaagucucauacacuguggagcaauggggugcuggaauccgagaugaucauucccaaaaacuucgcuggaccgguuagccagcacaacuaccgcccuggcuaucauacccaaaccgccgggcccuggcaccuuggaaagcucgaaauggauuuugacuucugugagggcacaaccguggucgugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgucaccgcuggccaugggcagaucgauaacuuuucucugggaguucugggcauggcgcuuuuccucgaagagaugcugagaacgcgcguggggaccaaacacgccauccugcucguggcugucagcuuugugacacugauuaccggaaauauguccuuccgggaccuuggcagaguuauggugauggucggcgccacaaugaccgaugacaucgggaugggagugacguaucuggcccuccuggcugccuuuaagguucgcccuacauucgcggcuggccugcuucugagaaaacucaccucuaaggagcugaugauggccacaauugggaucacccuccugagccaguccaccauucccgaaacaauccuugagcugacggaugcccucgcucugggaaugauggugcugaaaaucguccggaacauggaaaaguaccaacuugccgugaccauuauggcgaucucuugcguuccuaaugcugugauucugcgcaacgccuggaaggucagcuguacaauccucgccgcuguguccgugagcccccugcuccugaccucuucccagcagaaagccgacuggauuccucuugcucugacaaucaagggccucaaucccaccgccaucuuucugacgacacugagcagaaccucuaaaaagcgguccuggccgcuuaacgaggcgauuauggccgucgggaugguuagcauccuggcuucuucccuccugaaaaaugacauuccuaugaccggaccccucguggccggcggccugcuuacagugugcuauguccugaccgggcgcagcgcugaucuggaacucgagagagccgccgacgugaagugggaggaucaggcugaaaucuccggaagcucuccuauucugagcaucacaauuuccgaggacggcucuaugagcaucaaaaacgaagaggaggaacaaacgcuuaccauccugauucggacagggcuccugguuaucuccggaguguuccccgucucuauuccgaucaccgcggccgcuugguaccucugggaggugaagaagcagcgcgccggcguucugugggaugugccuucucccccucccgucgggaaagccgaacuugaggacggagcuuauagaauuaagcagcggggcauccugggcuacucccagaucggggccggaguguauaaagaaggcacauuucacaccauguggcaugucacgcgcggggcggugcugaugcacagaggaaagcggauugagcccuccugggcugauguuaaaaaggaccucaucagcuacggcgggggauggaagcuggagggcgaauggaaagagggcgaagaggugcaaguccuugcccuggaaccugggaagaauccgagagccgugcagaccaaacccggaauuuucaagacaaacaccggcacaaucggggcuguuucccucgauuuuagcccuggaaccucuggcucccccauuguggaccgcaaagggaaggucgugggacuguacggcaauggcgugguuacacggagcggggccuaugucucugcgaucgcucagacggagaaguccaucgaggauaacccugaaauugaggacgauaucuuccgcaagaagcgccucaccauuauggaccugcaucccggagccggcaaaacaaagcgguaccuuccugccaucgugagagaagcuauuaaacgcgggcugcggacccugauccucgccccgaccagaguggucgcugccgagauggaagaggcgcugcgcggacuucccauucgguaucagaccccugccaucaaggcugagcacacgggcagagaaaucguggaccugaugugucaugccaccuucacaaugcggcuccugagccccguucgcgugccuaacuacaaucucauuaucauggaugaggcucacuuuaccgaccccgccuccauugccgcuagaggguauaucucuacacgggucgaaaugggcgaggcggccggaauuuucaugaccgcuacgccgccuggcagccgcgaucccuuuccccaauccaacgccccuaucauggacgaggaaagagagauccccgaacggagcuggaacucugggcacgagugggugacagauuucaagggaaaaaccguuugguuugugccuuccauuaaggccggcaacgacaucgcugccugccugcgcaagaaugggaagaaagucauucagcuuagccgcaagaccuucgauucugaauacgugaagacacgggcgaacgacugggauuuuguugugaccacagacaucagcgagaugggagcuaauuucaaagccgagagagucauugauccgcgccgguguaugaagcccgugauccugaccgacggcgaagagagagugauccuggccgggccuaugcccgucacgcauuccucugcugcccagcgccggggcagaauuggacgcaacccuaaaaaugaaaacgaccaauauaucuacaugggcgagccccucgaaaaugaugaggacugcgcgcacuggaaggaggccaaaaugcugcuugauaacauuaauacaccggaagggaucauuccuagcauguuugagcccgaaagagagaagguugacgcuaucgauggagaauaccggcugcgcggcgaggccagaaaaaccuucguggaccucaugcggcgcggggaucugccuguguggcuggcuuauaaggucgccgcugagggaauuaacuacgccgacagaaagugguguuuugauggcaucaaaaauaaccagauccucgaagagaacguggaaguugagauuuggacaaaggagggggaacggaagaaacuuaaacccagauggcuggacgcgcgcaucuauuccgauccucuggcccucaaagaguucaaggaguucgcugccggccggaaaucucugacccuuaaucugauuacggagaugggaagacuccccaccuuuaugacacagaaggcucgcaacgcccuggacaaucuggccgugcuccauaccgcugaagcgggcgggcgggccuacaaccacgcucuuagcgagcugccggagacacuggaaacccuccugcuucugacacuccuggccaccgucacgggaggcaucuuccuguuucucauguccgggaaaggaauuggcaagaugacacuuggcaugugcugcaucaucaccgccagcgugcugcugugguaugcucagauucaaccucacuggaucgccgcgucuauuauccucgaguucuuucugauuguucuucugauccccgaacccgagaaacagagaaccccucaggauaaucagcucacauacguggucaucgccauucugaccguggucgcugccacaauggcuaacgaaaugggguuccuggagaagacgaagaaagaccucggacuuggcuccaucaccacacaagagagcgaauccaauauucuggacaucgaucugcggccggccucugcguggacccucuaugccguggcuacaaccuuuguuacgcccaugcugcgccauagcauugagaacuccucugugaaugugagccuuaccgccaucgcuaaccaggccacaguccugauggggcucggaaagggcuggccucuguccaaaauggacauugggguuccccugcucgcuaucggauguuacagccaggugaauccuaucacccuuacagccgcgcugcugcuccugguggcccacuacgcuauuaucggccccggccuucaggccaaggcuaccagagaagcccaaaaacgggccgcggcugggauuaugaagaacccuacggucgauggaaucacagugauugaccuggagccgauccccuaugauccuaaguucgaaaaacagcucggccagguuaugcugcugauccucugcgugacccagguccuuaugaugcgcacaaccugggcccugugugaggcucugacccucgccacagggcccauuucuacgcugugggagggaaauccuggcagauuuuggaacaccacaaucgccguguccauggcuaauauuuuccgggggagcuaccuugccggagcgggccugcucuuuucuaucaugaagaacaccacaaauacccgcagaggcacggggaacauuggagaaacacugggcgagaaauggaagucccggcugaacgcccucgggaaaagcgaguuccaaaucuauaagaaaucuggaauccaggaggucgaccgcacccuugcuaaggagggcauuaagagaggggaaaccgaucaucacgccgugagccggggauccgcuaaacugagaugguuuguugagcgcaauauggugacacccgaaggcaaggucguggaccugggcugcgggcggggaggcuggucuuacuauugugggggacucaaaaacguuagagaggugaagggccugaccaaagggggaccgggccaugaagaaccuauccccaugagcacauacggcuggaaucuuguccgccugcaguccgggguggauguguucuucacgcccccugagaagugcgacacccuccugugugauauuggagaaagcucccccaacccuacaaucgaggccggccggacccugagaguucucaaucuugucgaaaacuggcugaauaacaauacacaauuuugcauuaaggugcugaacccguauaugcccucugugaucgagaaaauggaaacccuccagcgcaaguacgggggagcgcugguccggaauccucuuagcagaaacuccacgcacgagauguacuggguuucuaaugccaccggcaacaucgugagcuccgugaauaugauuucucgcaugcugaucaaccgguucacaaugaaacacaagaaagcuaccuaugagcccgacgucgaucucgggagcggaacaagaaacauuggcaucgaauccgagauuccuaaucuggacaucauuggcaagcgcaucgaaaagaucaaacaggagcaugaaaccagcuggcacuacgaccaggaucaucccuauaagacaugggccuaccacgggucuuaugagaccaaacaaacgggauccgcuagcucuauggugaacggcguugugcggcugcucacaaagccgugggacgucgugccuaugguuacccagauggccaugaccgauacaacgcccuuugggcagcagagaguguucaaagagaaggucgacacccgcacacaagaaccuaaggagggaaccaagaaacuuaugagaauuacagcugaauggcuguggaaagagcugggcaaaaagaaaacaccccggauguguacacgcgaggaauuuaccagaaaagugcgguccaaugccgcgcucggggccaucuucacggaugagaacaaguggaaaagcgcuagagaagccguggaggacggacgguuuugggaacuggucgauaaagagcgcaaucuucaccuggagggcaagugcgaaaccuguguuuacaacaugaugggcaaaagagagaagaaacucggggaguucggaaaggcuaagggcucucgggccauuugguauauguggcugggggcccgcuuucuggaguucgaagcgcucggauuucugaaugaggaccauugguucuccagaggcaacagccuuuccgggguggagggcgaaggacugcaccggcucggcuacauccugcgcgauguggggaaaaaggagggaggcgcuauguacgccgacgauacagccgggugggacaccagaauuacacuugaagaccugaaaaaugaggaaauggucaccaaccauaugaagggagagcacaaaaagcucgcugaggccaucuuuaagcugacguaucagaauaaagugguucgggugcagcgcccuacacccagaggcaccgucauggauaucauuagccggcgcgaccagagagggucuggccaagugggaacauacggccugaacaccuucacgaauauggaagcucagcucauccggcagauggagggggaaggaauuuucaagagcauccaacaucugaccgccacagaggagauugcgguucagaacuggcuugcccgcgugggcagagaacggcuguccagaauggcuaucucuggggaugacugcgucgugaaaccgaucgaugaccgcuuugccagcgcucucaccgcccugaaugauaugggaaagguucggaaagacauucagcagugggagccuuccagaggcuggaacgauuggacacaagugcccuucugcucucaccacuuucaugaacuugucaugaaggacgggcgcgugcuggucgugcccugucggaaccaggaugagcucaucggcagagcgcgcauuagccagggagccggcuggucccugaaggaaaccgcuugccuggggaaaucuuaugcccagauguggacacucauguacuuccaccggagagaccugcgccuugcugccaaugcuaucuguagcgccguuccuucccauugggugccgaccagccggacgacauggucuauucacgcgaagcacgaguggaugaccaccgaggauaugcuggccgucuggaacagaguguggauccaagaaaaucccuggauggaggacaaaacaccuguggaauccugggaggaaguucccuaucucggaaagcgcgaggaccaguggugcggcagccugauugggcuuaccucucgggcuacaugggccaaaaacauccagacggccaucaaucaggugagaucccugauuggaaacgaggaauacaccgauuauaugccuagcaugaagcgguuuagacgcgaggaagaggaagcuggcguccucugguga

SEQ ID NO: 20021 - RNA, 9876 nt, Artificial Sequence
  derived and/or modified CDS sequence (opt5) from DENV-2__FJ850106__SS-prME
acagccggcgugaucauuaugcugauccccacagcuauggccuuccaccucacgaccagaaauggggaaccucauaugauugucggacggcaggaaaagggcaagagccugcuuuuuaagacagaggacgggguuaauaugugcacccugauggcgaucgaucucggagaacugugugaggacacaauuaccuacaagugcccgcuucugagacaaaaugaacccgaggauaucgacuguuggugcaauagcacaucuaccugggugacguauggcaccuguacaaccacaggggagcacagacgggaaaagagaagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcauugggaaggcucuccaccagguguucggcgccaucuacggagcggcuuuuuccggcguuucuuggacaaugaaaauccugauugggguggucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcaucuguggaauuagaagcgugacccgccuugagaaucugauguggaaacagaucacaccggagcucaaccacauucuguccgaaaaugaggucaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgacacugcucgucgccgcuagcuuugugacccugaucacaggaaauauguccuuccgggaccuuggcagaguuauggugauggucggcgccaccaugacggaugacauugggaugggagugacauaucuggcccuccuggcugccuuuaagguucgcccuaccuucgcggcuggccugcuucugagaaaacucacaucuaaggagcugaugauggccaccaucgggauuacccuccugagccaguccacaauccccgaaacgauucuugagcugaccgaugcccucgcucugggaaugauggugcugaaaaucguccggaacauggaaaaguaccaacuugccgugacaaucauggcgauuucuugcguuccuaaugcugugauccugcgcaacgccuggaaggucagcuguaccauucucgccgcuguguccgugagcccccugcuccugacaucuucccagcagaaagccgacuggaucccucuugcucugaccauuaagggccucaaucccacggccaucuuucugacaacccugagcagaaccucuaaaaagcgguccuggccgcuuaacgaggcgaucauggccgucgggaugguuagcauucuggcuucuucccuccugaaaaaugacaucccuaugacaggaccccucguggccggcggccugcuuaccgugugcuauguccugacagggcgcagcgcugaucuggaacucgagagagccgccgacgugaagugggaggaucaggcugaaauuuccggaagcucuccuauccugagcauuacgaucuccgaggacggcucuaugagcauuaaaaacgaagaggaggaacaaacccuuacaauccugauccggaccgggcuccugguuauuuccggaguguuccccgucucuaucccgauuacagcggccgcuugguaccucugggaggugaagaagcagcgcgccggcguucugugggaugugccuucucccccucccgucgggaaagccgaacuugaggacggagcuuauagaaucaagcagcggggcauucugggcuacucccagaucggggccggaguguauaaagaaggcaccuuucacacgauguggcaugucacccgcggggcggugcugaugcacagaggaaagcggaucgagcccuccugggcugauguuaaaaaggaccucauuagcuacggcgggggauggaagcuggagggcgaauggaaagagggcgaagaggugcaaguccuugcccuggaaccugggaagaauccgagagccgugcagacaaaacccggaaucuucaagaccaacacaggcaccauuggggcuguuucccucgauuuuagcccuggaacaucuggcucccccaucguggaccgcaaagggaaggucgugggacuguacggcaauggcgugguuacgcggagcggggccuaugucucugcgauugcucagaccgagaaguccaucgaggauaacccugaaaucgaggacgauauuuuccgcaagaagcgccucacaaucauggaccugcaucccggagccggcaaaaccaagcgguaccuuccugccauugugagagaagcuaucaaacgcgggcugcggacccugauucucgccccgacaagaguggucgcugccgagauggaagaggcgcugcgcggacuucccauccgguaucagacgccugccauuaaggcugagcacaccggcagagaaaucguggaccugaugugucaugccacauucaccaugcggcuccugagccccguucgcgugccuaacuacaaucucaucauuauggaugaggcucacuuuacagaccccgccuccaucgccgcuagaggguauauuucuacccgggucgaaaugggcgaggcggccggaaucuucaugacggcuacaccgccuggcagccgcgaucccuuuccccaauccaacgccccuauuauggacgaggaaagagagauccccgaacggagcuggaacucugggcacgagugggugaccgauuucaagggaaaaaccguuugguuugugccuuccaucaaggccggcaacgacauugcugccugccugcgcaagaaugggaagaaagucauccagcuuagccgcaagacauucgauucugaauacgugaagacccgggcgaacgacugggauuuuguugugacaaccgacauuagcgagaugggagcuaauuucaaagccgagagagucaucgauccgcgccgguguaugaagcccgugauucugacggacggcgaagagagagugauccuggccgggccuaugcccgucacacauuccucugcugcccagcgccggggcagaaucggacgcaacccuaaaaaugaaaacgaccaauauauuuacaugggcgagccccucgaaaaugaugaggacugcgcgcacuggaaggaggccaaaaugcugcuugauaacaucaauaccccggaagggauuaucccuagcauguuugagcccgaaagagagaagguugacgcuauugauggagaauaccggcugcgcggcgaggccagaaaaacauucguggaccucaugcggcgcggggaucugccuguguggcuggcuuauaaggucgccgcugagggaaucaacuacgccgacagaaagugguguuuugauggcauuaaaaauaaccagauccucgaagagaacguggaaguugagaucuggaccaaggagggggaacggaagaaacuuaaacccagauggcuggacgcgcgcauuuauuccgauccucuggcccucaaagaguucaaggaguucgcugccggccggaaaucucugacgcuuaaucugaucaccgagaugggaagacuccccacauuuaugacccagaaggcucgcaacgcccuggacaaucuggccgugcuccauacagcugaagcgggcgggcgggccuacaaccacgcucuuagcgagcugccggagacccuggaaacacuccugcuucugacccuccuggccacggucacaggaggcauuuuccuguuucucauguccgggaaaggaaucggcaagaugacccuuggcaugugcugcauuaucaccgccagcgugcugcugugguaugcucagauccaaccucacuggauugccgcgucuaucauucucgaguucuuucugaucguucuucugauucccgaacccgagaaacagagaacaccucaggauaaucagcucaccuacguggucaucgccauccugacaguggucgcugccacgauggcuaacgaaaugggguuccuggagaagaccaagaaagaccucggacuuggcuccauuacaacccaagagagcgaauccaauauccuggacauugaucugcggccggccucugcguggacacucuaugccguggcuaccacguuuguuacccccaugcugcgccauagcaucgagaacuccucugugaaugugagccuuacagccauugcuaaccaggccaccguccugauggggcucggaaagggcuggccucuguccaaaauggacaucgggguuccccugcucgcuauuggauguuacagccaggugaauccuaucacacuuaccgccgcgcugcugcuccugguggcccacuacgcuaucauuggccccggccuucaggccaaggcuacgagagaagcccaaaaacgggccgcggcugggaucaugaagaacccuacagucgauggaauuaccgugaucgaccuggagccgauucccuaugauccuaaguucgaaaaacagcucggccagguuaugcugcugauccucugcgugacacagguccuuaugaugcgcaccaccugggcccugugugaggcucugacacucgccacggggcccaucucuacccugugggagggaaauccuggcagauuuuggaacacaaccauugccguguccauggcuaauaucuuccgggggagcuaccuugccggagcgggccugcucuuuucuauuaugaagaacacaaccaauacgcgcagaggcacagggaacaucggagaaacccugggcgagaaauggaagucccggcugaacgcccucgggaaaagcgaguuccaaauuuauaagaaaucuggaauccaggaggucgaccgcacccuugcuaaggagggcaucaagagaggggaaacagaucaucacgccgugagccggggauccgcuaaacugagaugguuuguugagcgcaauauggugacccccgaaggcaaggucguggaccugggcugcgggcggggaggcuggucuuacuauugugggggacucaaaaacguuagagaggugaagggccugacaaaagggggaccgggccaugaagaaccuauucccaugagcacguacggcuggaaucuuguccgccugcaguccgggguggauguguucuucacacccccugagaagugcgacacccuccugugugauaucggagaaagcucccccaacccuaccauugaggccggccggacacugagaguucucaaucuugucgaaaacuggcugaauaacaauacccaauuuugcaucaaggugcugaacccguauaugcccucugugauugagaaaauggaaacgcuccagcgcaaguacgggggagcgcugguccggaauccucuuagcagaaacuccacccacgagauguacuggguuucuaaugccacaggcaacaucgugagcuccgugaauaugaucucucgcaugcugauuaaccgguucaccaugaaacacaagaaagcuacauaugagcccgacgucgaucucgggagcggaaccagaaacaucggcauugaauccgagaucccuaaucuggacauuaucggcaagcgcauugaaaagaucaaacaggagcaugaaacaagcuggcacuacgaccaggaucaucccuauaagaccugggccuaccacgggucuuaugagacgaaacaaacaggauccgcuagcucuauggugaacggcguugugcggcugcucaccaagccgugggacgucgugccuaugguuacccagauggccaugacagauacgacccccuuugggcagcagagaguguucaaagagaaggucgacacacgcacccaagaaccuaaggagggaaccaagaaacuuaugagaaucaccgcugaauggcuguggaaagagcugggcaagaaaaagacaccccggauguguacccgcgaggaauuuacgagaaaagugcgguccaaugccgcgcucggggccauuuucaccgaugagaacaaguggaaaagcgcuagagaagccguggaggacggacgguuuugggaacuggucgauaaagagcgcaaucuucaccuggagggcaagugcgaaacauguguuuacaacaugaugggcaaaagagagaagaaacucggggaguucggaaaggcuaagggcucucgggccaucugguauauguggcugggggcccgcuuucuggaguucgaagcgcucggauuucugaaugaggaccauugguucuccagaggcaacagccuuuccgggguggagggcgaaggacugcaccggcucggcuacauucugcgcgauguggggaaaaaggagggaggcgcuauguacgccgacgauaccgccgggugggacacaagaaucacccuugaagaccugaaaaaugaggaaauggucacgaaccauaugaagggagagcacaaaaagcucgcugaggccauuuuuaagcugacauaucagaauaaagugguucgggugcagcgcccuacccccagaggcacagucauggauaucaucagccggcgcgaccagagagggucuggccaagugggaaccuacggccugaacacguucaccaauauggaagcucagcucauucggcagauggagggggaaggaaucuucaagagcauucaacaucugacagccaccgaggagaucgcgguucagaacuggcuugcccgcgugggcagagaacggcuguccagaauggcuauuucuggggaugacugcgucgugaaaccgaucgaugaccgcuuugccagcgcucucacagcccugaaugauaugggaaagguucggaaagacauccagcagugggagccuuccagaggcuggaacgauuggacccaagugcccuucugcucucaccacuuucaugaacuugucaugaaggacgggcgcgugcuggucgugcccugucggaaccaggaugagcucauuggcagagcgcgcaucagccagggagccggcuggucccugaaggaaacagcuugccuggggaaaucuuaugcccagauguggacccucauguacuuccaccggagagaccugcgccuugcugccaaugcuauuuguagcgccguuccuucccauugggugccgacgagccggacaaccuggucuauccacgcgaagcacgaguggaugaccacagaggauaugcuggccgucuggaacagaguguggauucaagaaaaucccuggauggaggacaaaaccccuguggaauccugggaggaaguucccuaucucggaaagcgcgaggaccaguggugcggcagccugaucgggcuuacaucucgggcuacgugggccaaaaacauucagaccgccaucaaucaggugagaucccugaucggaaacgaggaauacacagauuauaugccuagcaugaagcgguuuagacgcgaggaagaggaagcuggcguccucugguga

SEQ ID NO: 20022 - RNA, 9876 nt, Artificial Sequence
  derived and/or modified CDS sequence (opt5) from DENV-2__FJ850107__SS-prME
accgccggcgugaucauuaugcugauccccacagcuauggccuuccaccucacgaccagaaauggggagccucauaugauugucggacggcaggaaaagggcaagagccugcuuuuuaagacagaggacgggguuaauaugugcacccugauggcgaucgaucucggagaacugugugaggacacaauuaccuacaagugcccgcuucugagacaaaacgaacccgaggauaucgacuguuggugcaauuccacaucuaccugggugacguauggcaccuguacaaccacaggggagcacagacgggaaaagagaagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcauugggaaggcucuccaccagguguucggcgccaucuacggagcggcuuuuuccggcguuucuuggacaaugaaaauccugauugggguggucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcaucuguggaauuagaagcgugacccgccuugagaaucugauguggaaacagaucacaccggagcucaaccacauucuguccgaaaaugaggucaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgauccugcucgucgccgugagcuuuguuacacugauuaccggaaauauguccuuccgggaccuuggcagagugauggucauggugggcgcuacaaugaccgaugacaucgggaugggaguuacguaucuggcccuccuggccgcuuuuaaggugcgcccuacauucgccgcgggccugcuucugagaaaacucaccucuaaggagcugaugauggcuacaauugggaucacccuccugagccaguccaccauucccgaaacaauccuugagcugacggaugcccucgcccugggaaugaugguccugaaaaucgugcggaacauggaaaaguaccaacuugcuguuaccauuauggccaucucuugcgugccuaaugcggucauucugcgcaacgcuuggaaggugagcuguacaauccucgccgccguguccgucuuuccccugcuccugaccagcucucagcagaaagcugacuggauuccucuugcccugacaaucaagggccucaaucccaccgcuaucuuccugacgacacuguccagaaccagcaaaaagcggucuuggccgcuuaacgaggccauuauggcgguugggaugguguccauccuggccagcucucuccugaaaaaugacauuccuaugaccggaccccucguggcuggcggccugcuuacagucugcuaugugcugaccgggcgcuccgccgaucuggaacucgagagagcugccgacguuaagugggaggaucaggccgaaaucagcggauccagcccuauucugucuaucacaauuagcgaggacggcuccaugucuaucaaaaacgaagaggaggaacaaacgcuuaccauccugauucggacagggcuccuggugaucagcggagucuuucccguguccauuccgaucaccgcugcggccugguaccucugggagguuaagaagcagcgcgcuggcgugcugugggaugucccuucucccccucccguggggaaagccgaacuugaggacggagccuauagaauuaagcagcggggcauccugggcuacagccagaucggggcuggagucuauaaagaaggcacauuccacaccauguggcaugugacgcgcggggccguucugaugcacagaggaaagcggauugagcccuccugggcggaugugaaaaaggaccucaucucuuacggcgggggauggaagcuggagggcgaauggaaagagggcgaagagguccaagugcuugcucuggaaccugggaagaauccgagagccguucagaccaaacccggaauuuuuaagacaaacaccggcacaaucggggccgugagccucgauuucuccccuggaaccagcggcucucccauugucgaccgcaaagggaagguggugggacuguacggcaauggcguugucacacgguccggggcuuaugugagcgccaucgcgcagacggagaagucuaucgaggauaacccugaaauugaggacgauaucuuccgcaagaagcgccucaccauuauggaccugcaucccggagcuggcaaaacaaagcgguaccuuccugccaucgugagagaagccauuaaacgcgggcugcggacccugauccucgcuccgaccagagucguggccgcugagauggaagaggcccugcgcggacuucccauucgguaucagaccccugcgaucaaggccgagcacacgggcagagaaaucguugaccugaugugucaugcuaccuuuacaaugcggcuccugucccccgugcgcgucccuaacuacaaucucauuaucauggaugaggcccacuucaccgaccccgcuagcauugccgccagaggguauaucuccacacggguggaaaugggcgaggcugcgggaauuuuuaugaccgccacgccgccuggcucucgcgaucccuucccccaaagcaacgcuccuaucauggacgaggaaagagagauccccgaacgguccuggaauagcgggcacgaguggguuacagauuuuaagggaaaaaccgugugguucgucccuucuauuaaggccggcaacgacaucgccgcuugccugcgcaagaaugggaagaaagugauucagcuuucccgcaagaccuuugauagcgaauacguuaagacacgggccaacgacugggauuucguggucaccacagacaucucugagaugggagcgaauuuuaaagcugagagagugauugauccgcgccgguguaugaagcccgugauccugaccgacggcgaagagagagucauccuggccgggccuaugcccguuacgcauagcuccgccgcucagcgccggggcagaauuggacgcaacccuaaaaaugaaaacgaccaauauaucuacaugggcgagccccucgaaaaugaugaggacugcgcccacuggaaggaggcgaaaaugcugcuugauaacauuaauacaccggaagggaucauuccuucuauguucgagcccgaaagagagaagguggacgccaucgauggagaauaccggcugcgcggcgaggcuagaaaaaccuuuguggaccucaugcggcgcggggaucugccugucuggcuggccuauaagguggcugccgagggaauuaacuacgcugacagaaagugguguuucgauggcaucaaaaauaaccagauccucgaagagaacguugaaguggagauuuggacaaaggagggggaacggaagaaacuuaaacccagauggcuggacgcccgcaucuauagcgauccucuggcgcucaaagaguucaaggaauuugccgcuggccggaaaucccugacccuuaaucugauuacggagaugggaaagcuccccaccuucaugacacagaaagccagaaacgcucuggacaaucuggccguccuccauaccgccgaagcuggcgggcgcgcguacaaccacgcccuuucugagcugccggagacacuggaaacccuccugcuucugacacuccuggcuaccgugacgggaggcaucuuucuguuccucaugagcgggaagggaauuggcaaaaugacacuuggcaugugcugcaucaucaccgccuccguucugcugugguaugcccagauucaaccucacuggaucgcugccagcauuauccucgaguuuuuccugauugugcuucugauccccgaacccgagaagcagcggaccccucaggauaaucagcucacauacgucgugaucgcgauucugaccgucguggccgcuacaauggccaacgaaaugggguuucuggagaagacgaaaaaggaccucggacuuggcucuaucaccacacaagaguccgaaagcaauauucuggacaucgaucugagaccggcuuccgccuggacccucuaugcgguugccacaaccuucgugacgcccaugcugcggcauucuauugagaacagcuccgugaaugucucucuuaccgcuaucgccaaccaggcuacaguucugauggggcucggaaaaggcuggccucugagcaagauggacauuggggugccccugcucgccaucggauguuacucccaggugaauccuaucacccuuacagcugcccugcugcuccuggucgcgcacuacgccauuaucggccccggccuucaggcuaaagccacccgcgaagcucaaaagagagccgccgcggggauuaugaagaacccuacgguggauggaaucacaguuauugaccuggagccgauccccuaugauccuaaauuugaaaagcagcucggccaggugaugcugcugauccucugcgucacccaggugcuuaugaugcggacaaccugggcucugugugaggcccugacccucgcuacagggcccauuagcacgcugugggagggaaauccuggccgcuucuggaacaccacaaucgccgucucuauggccaauauuuuuagaggguccuaccuugcuggagccggccuccuguucagcaucaugaaaaacaccacaaauacccggcgcggcacggggaacauuggagaaacacugggcgagaaguggaaaucuagacugaacgcgcucgggaaguccgaauuucaaaucuauaaaaagagcggaauccaggagguggaccggacccuugccaaggagggcauuaaacgcggggaaaccgaucaucacgcuguuucuagaggaagcgccaagcugcggugguucguggagagaaauauggucacacccgaaggcaaagugguugaccugggcugcgggcgcggaggcugguccuacuauugugggggacucaagaacgugcgggaggucaaaggccugaccaaagggggaccgggccaugaagaaccuauccccaugucuacauacggcuggaaucuugugagacugcagagcgggguggauguuuucuuuacgcccccugagaagugcgacacccuccugugugauauuggagaauccagccccaacccuacaaucgaggcuggccgcacccugcggguccucaaucuuguggaaaacuggcugaauaacaauacacaauucugcauuaaagugcugaacccguauaugcccuccgucaucgagaagauggaaacccuccagagaaaauacgggggagcccugguucgcaauccucuuucucggaacagcacgcacgagauguacuggguguccaaugcgaccggcaacaucgugucuagcgucaauaugauuuccagaaugcugaucaaccgcuuuacaaugaagcacaaaaaggccaccuaugagcccgacguggaucucgggucuggaacacggaacauuggcaucgaaagcgagauuccuaaucuggacaucauuggcaagagaaucgagaagauccgccaggagcaugaaaccuccuggcacuacgaccaggaucaucccuauaagacaugggcuuaccacgggagcuaugagaccaaacaaacgggaucugccuccagcaugguuaacggcgugguccggcugcucacaaagccgugggacgugguuccuauggugacccagauggcuaugaccgauacaacgcccuucgggcagcagagagucuuuaaagagaagguggacacccgcacacaagaaccuaaggagggaaccaagaaacuuaugagaauuacagccgaauggcuguggaaagagcugggcaaaaagaaaacaccccggauguguacacgcgaggaguucaccagaaaagugcggucuaaugcugcccucggggcgaucuuuacggaugagaacaaguggaaguccgccagagaagcugucgaggacggacgguucugggaacugguugauaaagagcgcaaucuucaccuggagggcaagugcgaaaccuguguguacaacaugaugggcaaaagagagaagaaacucggggaauuuggaaaggccaagggcagccgggcuauuugguauauguggcugggggcccgcuuccuggaguuugaagcccucggauuccugaaugaggaccauugguuuucuagaggcaacucccuuagcgggguggagggcgaaggacugcaccggcucggcuacauccugcgcgaugucgggaaaaaggagggaggcgcgauguacgcugacgauacagccgggugggacaccagaauuacacuugaagaccugaaaaaugaggaaauggugaccaaccauaugaagggagagcacaaaaagcucgccgaggcuaucuucaagcugacguaucagaauaaaguugugcggguccagcgcccuacacccagaggcaccgugauggauaucauuucccggcgcgaccagagagggagcggccaaguuggaacauacggccugaacaccuucacgaauauggaagcccagcucauccggcagauggagggggaaggaauuuuuaagucuauccaacaucugaccgcuacagaggagauugccgugcagaacuggcuugcgcgcgucggcagagaacggcugagcagaauggccaucuccggggaugacugcgugguuaaaccgaucgaugaccgcuucgcuucugcccucaccgcucugaaugauaugggaaaggugcggaaagacauucagcagugggagccuagcagaggcuggaacgauuggacacaaguccccuuuugcucccaccacuuccaugaacuugugaugaaggacgggcgcguccuggugguucccugucggaaccaggaugagcucaucggcagagcccgcauuucucagggagcgggcuggagccugaaggaaaccgccugccuggggaaauccuaugcucagauguggacacucauguacuuucaccggagagaccugcgccuugccgcuaaugccaucuguucugcugugccuagccauugggucccgaccucccggacgacauggagcauucacgccaagcacgaguggaugaccaccgaggauaugcuggcgguguggaacagaguguggauccaagaaaaucccuggauggaggacaaaacaccuguugaaucuugggaggaagugcccuaucucggaaagcgcgaggaccaguggugcggcucccugauugggcuuaccagccgggccacaugggcuaaaaacauccagacggccaucaaucaggucagaucucugauuggaaacgaggaauacaccgauuauaugccuuccaugaagcgguucagacgcgaggaagaggaagccggcgugcucugguga

SEQ ID NO: 20023 - RNA, 9876 nt, Artificial Sequence
  derived and/or modified CDS sequence (opt5) from DENV-2__FJ850108__SS-prME
acagccggcgugaucgucaugcugauucccacagcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugauugaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucgggguggugaucaccuggauuggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugagguuaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcuaucaaagacaauagagccguucacgcggauaugggcuauuggaucgaaucugcccucaacgacacguggaagauggagaaggcuuccuucauugaggugaaaagcugccacuggccuaagucucauacacuguggagcaaugggguccuggaauccgagaugaucauucccaaaaacuucgccggaccggugagccagcacaacuaccgcccuggcuaucauacccaaaucgcugggcccuggcaccuuggaaagcucgaaauggauuuugacuucugugagggcaccacaguggucguuaccgaagauugcgggaaucggggacccucucugagaacgacaaccgccuccggcaaacugauuacagaguggugcugucggagcugcacccucccuccgcugcgcuacagaggcgaggacggguguugguacggaauggaaauccggccccuuaaggagaaggaagagaaccuggugaauagccucgugacagccggccaugggcagauugauaacuuuucucugggaguccugggcauggcucuuuuccucgaagagaugcugagaacccgcguggggacgaaacacgcgauccugcucguugccgugagcuuugucacccugaucacaggaaauauguccuuccgggaccuuggcagaaugauggugaugguuggcgcuaccaugacagaugacauugggaugggagugaccuaucuggcccuccuggccgcuuuuaagguccgcccuacguucguggccggccugcuucugagaaaacucacaucuaaggagcugaugauggcgaccaucgggauuacacuccugagccaguccaccauccccgaaaccauucuugagcugacagaugcucucgcccugggaaugaugguucugaaaaucgugcggaacauggaaaaguaccaacuugccgucacgaucauggcuauuucuugcgugccuaaugccgugauccugcgcaacgcguggaaggucagcuguaccauucucgcugccguuuccgugagcccccugcuccugacaucuucccagcagaaagccgacuggaucccucuugcucugaccauuaagggccucaaucccacagccaucuuucugaccacgcugagcagaacaucuaaaaagcgguccuggccgcuuaacgaggcuaucauggccguggggauggucagcauucuggcgucuucccuccugaaaaaugacaucccuaugaccggaccccucguggccggcggccugcuuaccguuugcuaugugcugacagggcgcagcgcugaucuggaacucgagagagccgcugacgucaagugggaggaucaggccgaaauuuccggaagcucuccuauccugagcauuaccaucuccgaggacggcucuaugagcauuaaaaacgaagaggaggaacaaacacuuacgauccugauccggaccgggcuccuggugauuuccggaguuuuccccgugucuaucccgauuacagccgcugcgugguaccucugggaggucaagaagcagcgcgccggcgugcugugggaugucccuucucccccucccguggggaaagcugaacuugaggacggagccuauagaaucaagcagcggggcauucugggcuacucccagaucggggccggaguuuauaaagaaggcaccuuucacacaauguggcaugugacccgcggggcuguccugaugcacagaggaaagcggaucgagcccuccugggccgaugugaaaaaggaccucauuagcuacggcgggggauggaagcuggagggcgaauggaaagagggcgaagagguucaagugcuugcgcuggaaccugggaagaauccgagagcuguccagacgaaacccggaaucuucaagaccaacacaggcaccauuggggccgugucccucgauuuuagcccuggaacaucuggcucccccaucguggaccgcaaagggaagguugucggacuguacggcaauggcguggugacccggagcggggccuaugucucugcuauugcccagacagagaaguccaucgaggauaacccugaaaucgaggacgauauuuuccgcaagaagcgccucacgaucauggaccugcaucccggagcgggcaaaaccaagcgguaccuuccugcuauugugagagaagccaucaaacgcgggcugcggacacugauucucgccccgaccagaguuguggcugccgagauggaagaggcucugcgcggacuucccauccgguaucagaccccugccauuaaggcggagcacacaggcagagaaaucgucgaccugaugugucaugccacguucaccaugcggcuccugagccccgugcgcguuccuaacuacaaucucaucauuauggaugaggcucacuuuacagaccccgccuccaucgcugccagaggguauauuucuacccggguggaaaugggcgaggccgcuggaaucuucaugacagcgaccccgccuggcagccgcgaucccuuuccccaauccaacgccccuauuauggacgaggaaagagagauccccgaacggagcuggaacucugggcacgagugggucacggauuucaagggaaaaacagugugguuuguuccuuccaucaaggcuggcaacgacauugccgccugccugcgcaagaaugggaagaaagugauccagcuuagccgcaagaccuucgauucugaauacgucaagacccgggcuaacgacugggauuuuguggugacaaccgacauuagcgagaugggagccaauuucaaagcggagagagucaucgauccgcgccgguguaugaagcccguuauucugacagacggcgaagagagagugauccuggcugggccuaugcccgugacccauuccucugccgcccagcgccggggcagaaucggacgcaacccuaaaaaugaaaacgaccaauauauuuacaugggcgagccccucgaaaaugaugaggacugcgcucacuggaaggaggccaaaaugcugcuugauaacaucaauacgccggaagggauuaucccuagcauguuugagcccgaaagagagaaggucgacgcgauugauggagaauaccggcugcgcggcgaggccagaaaaacauucguggaccucaugcggcgcggggaucugccuguuuggcuggcuuauaagguggccgcugagggaaucaacuacgccgacagaaagugguguuuugauggcauuaaaaauaaccagauccucgaagagaacgucgaaguggagaucuggaccaaggagggggaacggaagaaacuuaaacccagauggcuggacgcucgcauuuauuccgauccucuggcccucaaagaguucaaggaguucgcggccggccggaaaucucugacacuuaaucugaucaccgagaugggaagacuccccacguuuaugacccagaaggcucgcaacgcccuggacaaucuggcuguucuccauacagccgaagccggcgggcgggcuuacaaccacgcgcuuagcgagcugccggagacccuggaaacacuccugcuucugacccuccuggccacagugaccggaggcauuuuccuguuucucauguccgggaaaggaaucggcaagaugacgcuuggcaugugcugcauuaucacagcuagcguccugcugugguaugcccagauccaaccucacuggauugccgcuucuaucauucucgaguucuuucugaucgugcuucugauucccgaacccgagaaacagagaaccccucaggauaaucagcucaccuacgucgugaucgccauccugacaguuguggcggccaccauggcuaacgaaaugggguuccuggagaagacaaagaaagaccucggacuuggcuccauuacgacccaagagccggaaagcaauauccuggacauugaucugcggcccgccuccgcuuggacacucuaugccguggcgaccacauuugucaccccuaugcugcgccauucuaucgagaacagcuccguuaaugugucucuuacggccauugcuaaccaggccaccgugcugauggggcucggaaagggcuggccccugagcaaaauggacaucggggucccucugcucgcuauuggauguuacucccaggugaaucccaucacacuuaccgccgcucugcugcuccugguugcccacuacgcgaucauuggcccuggccuucaggccaaggcuacaagagaagcccaaaaacgggcugccgccgggaucaugaagaacccgaccguggauggaauuacggucaucgaccuggagcccauuccuuaugaucccaaguucgaaaaacagcucggccaggugaugcugcugauccucugcgucacacaggugcuuaugaugcgcaccacaugggcgcugugugaggcucugacccucgccaccgggccuaucagcacacugugggagggaaaucccggcagauuuuggaacacgaccauugcuguuucuauggccaauaucuuccggggguccuaccuugccggagcuggccugcucuuuagcauuaugaagaacacaaccaauacacgcagaggcaccgggaacaucggagaaacgcugggcgagaaauggaagucucggcugaacgcccucgggaaauccgaguuccaaauuuauaagaaaagcggaauccaggagguggaccgcacacuugcgaaggagggcaucaagagaggggaaaccgaucaucacgccgucucucggggaagcgcuaaacugagaugguuuguggagcgcaauaugguuaccccggaaggcaagguggucgaccugggcugcgggcggggaggcugguccuacuauugugggggacucaaaaacgugagagaggugaagggccugacaaaagggggaccuggccaugaagaacccauucccaugucuaccuacggcuggaaucuuguucgccugcagagcggggucgauguguucuucacaccucccgagaagugcgacacgcuccugugugauaucggagaauccagcccuaacccgaccauugaggccggccggacacugagagugcucaaucuugucgaaaacuggcugaauaacaauacccaauuuugcaucaagguucugaaccccuauaugccuuccgugauugagaaaauggaaacacuccagcgcaaguacgggggagcucuggugcggaauccccuuucuagaaacagcacccacgagauguacugggucuccaaugccacgggcaacaucgugucuagcguuaauaugaucucccgcaugcugauuaaccgguucaccaugaaacacaagaaagcgacauaugagccugacguggaucucgggucuggaaccagaaacaucggcauugaaagcgagauccccaaucuggacauuaucggcaagcgcauugaaaagaucaaacaggagcaugaaacauccuggcacuacgaccaggaucauccguauaagaccugggccuaccacgggagcuaugagacaaaacaaaccggaucugcuuccagcauggucaacggcgugguucggcugcucacgaagccuugggacgugguccccauggugacacagauggccaugaccgauaccacaccuuuugggcagcagagaguguucaaagagaaggucgacacgcgcacccaagaacccaaggagggaaccaagaaacuuaugagaaucaccgcugaauggcuguggaaagagcugggcaagaaaaagacaccucggauguguacccgcgaggaauuuacaagaaaaguucggucuaaugccgcucucggggccauuuucaccgaugagaacaaguggaaguccgcgagagaagccguggaggacggacgguuuugggaacugguggaucgcgagagaaaucuucaccuggagggcaaaugcgaaacgugugucuacaacaugaugggcaagcgggagaaaaagcucggggaguucggaaaagcuaagggcagccgcgccaucugguauauguggcugggggcuagauuucuggaguucgaagcccucggauuucugaaugaggaccauugguucucucggggcaacucccuuagcgggguggagggcgaaggacugcaccgccucggcuacauucugagagauguugggaagaaagagggaggcgccauguacgcggacgauaccgcugggugggacacacggaucacccuugaagaccugaagaaugaggaaauggugacaaaccauaugaaaggagagcacaagaaacucgccgaggccauuuuuaagcugaccuaucagaauaaggucgugcgcguucagagacccacgccgcggggcacagugauggauaucaucucccgcagagaccagcgggggagcggccaagucggaaccuacggccugaacacauucaccaauauggaagcucagcucauucgccagauggagggggaaggaaucuucaaaucuauucaacaucugacggugaccgaggagaucgccguucagaacuggcuugcuagagugggccgggaaagacugagccgcauggccauuuccggggaugacugcgucgugaagccuaucgaugaccgguuugcgucugcccucacagcucugaaugauaugggaaaagucagaaaggacauccagcagugggagcccagccgcggcuggaacgauuggacccaagugcccuucugcucccaccacuuucaugaacuuguuaugaaagacgggcgggugcuggucgugccuuguagaaaccaggaugagcucauuggccgcgcccggaucucucagggagcuggcuggagccugaaggaaacagccugccuggggaaguccuaugcgcagauguggacccucauguacuuccacagacgcgaccugcggcuugccgcuaaugccauuuguucugcugugccgagccauuggguucccacauccagaaccacguggagcauccacgccaaacacgaguggaugacaaccgaggauaugcuggcuguguggaaccgcgucuggauucaagaaaauccuuggauggaggacaagacccccguggaaucuugggaggaaguuccuuaucucggaaaacgggaggaccaguggugcggcucccugaucgggcuuacaagcagagccaccugggcgaagaacauucagacagccaucaaucaggugcggucucugaucggaaacgaggaauacacggauuauaugcccuccaugaaaagauuucgccgggaggaagaggaagcuggcguccucugguga

SEQ ID NO: 20024 - RNA, 9876 nt, Artificial Sequence
  derived and/or modified CDS sequence (opt5) from DENV-2__JN819407__SS-prME
acagccggcgugaucgucaugcugauucccacagcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugagacaaaacgaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagccuuggaaaucugcucuuuaccggccaucugaaaugcagacuucggauggauaagcugcaacucaaagggauguccuacucuauguguaccggaaaguucaagaucgucaaagaaauugcggagacacagcacggcacgaucgugaucagaguccaguaugagggggacggaagccccugcaagauucccuucgaaaucaccgaucuggagaaacgccaugugcugggccggcucauuacaguuaacccuaucgugauugaaaaggacuccccggucaacaucgaggccgaacccccuuuuggggauagcuacauuaucaucggcguggagcccggacagcugaaacuuaauugguucaagaagggaucuuccauugggcaaauguuugagaccacaaugagaggagcuaaacgcauggccauccugggcgacaccgccugggauuucgggagccucggaggcguuuuuacgucuauugggaaggcucugcaccagguguucggcgccaucuacggagcggcuuuuagcggcgucuccuggacaaugaaaauucugaucgggguggugaucaccuggauuggaaugaacucucggagcaccucccuuagcguuucucucguccuggugggcguggucacacuguaucucggggccauggugcaggccgacuccggauguguugugagcuggaagaauaaagaacugaagugcggcucugggaucuucauuaccgauaacguccacacauggacggagcaguacaaguuucaaccugaaucccccagcaaacuugcuuccgccauccagaaggcucaugaggaaggcauuuguggaaucagaucugugacccgccuggagaaucucauguggaaacagaucacaccggagcugaaccacauucugagcgaaaaugagguuaaacuuaccaucaugacaggcgacaccaaagggauuaugcaggccggaaagcggucccucagaccucaacccacggaacugaaauauucuuggaagaccuggggcaaggcgaaaaugcuguucacagagagccauaaccagaccuuucucaucgaugggccugaaacagccgagugccccaauaccaaccgcgcuuggaacucccuggagguggaagacuacggauucggcgucuuuagcacaaacauuuggcuuaagcugcgggagaaacaggacguguucugugauucuaagcucauguccgccgcuaucaaagacaauagagccguucacgcggauaugggcuauuggaucgaaagcgcccugaacgacaccuggaagauggagaaggcuucuuucauugaggugaaauccugccacuggccuaagagccauacgcuguggucuaaugggguccuugaaagcgagaugaucauucccaaaaacuuugccggaccggugucccagcacaacuaccgcccuggcuaucauacacaaaccgcugggcccuggcaccucggaaagcuggaaauggauuucgacuuuugugagggcaccacaguggucguuaccgaagauugcgggaaucggggacccagccugagaacgacaaccgccucuggcaaacucaucacagaguggugcugucgguccugcacccugccuccgcuucgcuacagaggcgaggacggguguugguacggaauggaaauucggccccugaaggagaaggaagagaaccucgugaauagccuggugacagccggccaugggcagaucgauaacuucucccugggaguccuuggcauggcucucuuucuggaagagaugcugagaacccgcguggggacgaaacacgcgauucuccugguugccgugucuuucgucacccuuaucacaggaaauaugagcuuucgggaccugggcagagugaugguuauggugggcgcuaccaugacagaugacaucgggaugggagucaccuaucucgcccugcuggccgcuuucaaggugcgcccuacguuugccgcgggccuucugcucagaaaacugacauccaaggagcucaugauggcuaccauugggaucacacugcuuucucagagcaccauucccgaaaccauccuggagcucacagaugcccuggcccugggaaugaugguucuuaaaauugugcggaacauggaaaaguaccaacuggcugucacgaucauggccaucuccugcgugccuaaugcggugauucuccgcaacgcuuggaaggucucuuguaccauccuggccgccguuagcgugagcccccuccugcuuacaagcucucagcagaaagcugacuggauuccucuggcccucaccaucaagggccugaaucccacagcuauuuuccugaccacgcuuuccagaacaagcaaaaagcggucuuggccgcugaacgaggccaucauggcgguggggauggucuccauccucgccagcucucugcucaaaaaugacauuccuaugaccggaccccugguggcuggcggccuucugaccguuugcuaugugcugacagggcgcuccgccgaucucgaacuggagagagcugccgacgucaagugggaggaucaggccgaaaucagcggauccagcccuauucuuucuaucaccauuagcgaggacggcuccaugucuaucaaaaacgaagaggaggaacaaacacugacgauucucauccggaccgggcugcucgugaucagcggaguuuuucccguguccauuccgaucacagcugcggccugguaccugugggaggucaagaagcagcgcgcuggcgugcuuugggaugucccuucucccccucccguggggaaagccgaacuggaggacggagccuauagaauuaagcagcggggcauccugggcuacagccagauuggggcuggaguuuauaaagaaggcaccuuccacacaauguggcaugugacccgcggggccguccucaugcacagaggaaagcggaucgagcccuccugggcggaugugaaaaaggaccugaucucuuacggcgggggauggaaacuugagggcgaauggaaagagggcgaagagguucaagugcuggcucucgaaccugggaagaauccgagagccguccagacgaaacccggaauuuuuaagaccaacacaggcaccaucggggccgugagccuggauuucuccccuggaacaagcggcucucccauuguggaccgcaaagggaagguugucggacucuacggcaauggcguggugacccgguccggggcuuaugucagcgccaucgcgcagacagagaagucuauugaggauaacccugaaaucgaggacgauaucuuccgcaagaagcgccugacgauuauggaccuucaucccggagcuggcaaaaccaagcgguaccugccugccaucgugagagaagccauuaaacgcgggcugcggacacucauccuggcuccgaccagaguuguggccgcugagauggaagaggcccuucgcggacugcccauucgguaucagaccccugcgaucaaggccgagcacacaggcagagaaauugucgaccucaugugucaugcuacguuuaccaugcggcugcucucccccgugcgcguuccuaacuacaaucugaucaucauggaugaggcccacuucacagaccccgcuagcauugccgccagaggguauaucuccacccggguggaaaugggcgaggcugcgggaauuuuuaugacagccaccccgccuggcucucgcgaucccuucccccaaagcaacgcuccuaucauggacgaggaaagagagauucccgaacgguccuggaauagcgggcacgagugggucacggauuuuaagggaaaaacagugugguucguuccuucuaucaaggccggcaacgacaucgccgcuugccuucgcaagaaugggaagaaagugauucagcugucccgcaagaccuuugauagcgaauacgucaagacccgggccaacgacugggauuucguggugacaaccgacaucucugagaugggagcgaauuuuaaagcugagagagucauugauccgcgccgguguaugaagcccguuauccugacagacggcgaagagagagugauucucgccgggccuaugcccgugacccauagcuccgccgcucagcgccggggcagaaucggacgcaacccuaaaaaugaaaacgaccaauauaucuacaugggcgagccccuggaaaaugaugaggacugcgcccacuggaaggaggcgaaaaugcuucuggauaacauuaauacgccggaagggaucauuccuucuauguucgagcccgaaagagagaaggucgacgccaucgauggagaauaccggcuccgcggcgaggcuagaaaaacauuuguggaccugaugcggcgcggggaucugccuguuuggcucgccuauaagguggcugccgagggaauuaacuacgcugacagaaagugguguuucgauggcaucaaaaauaaccagauucuugaagagaacgucgaaguggagaucuggaccaaggagggggaacggaaaaagcugaaacccagauggcuggacgcccgcaucuauagcgauccucucgcgcugaaggaguucaaggaauuugccgcuggccggaaaucccuuacacugaaucucauuaccgagaugggaagacugcccacguucaugacccagaaggcccgcaacgcucuggacaaucucgccguucuucauacagccgaagcuggcgggcgggcguacaaccacgcccugucugagcugccggagacccucgaaacacugcuucugcucacccugcuggcuacagugaccggaggcaucuuucucuuccuuaugagcgggaaaggaauuggcaagaugacgcugggcaugugcugcaucauuacagccuccguccugcucugguaugcccagauccaaccucacuggaucgcugccagcauuauccuggaguuuuuccuuauugugcugcucauccccgaacccgagaaacagagaaccccucaggauaaucagcugaccuacgucgugauugcgauccugacaguuguggccgcuaccauggccaacgaaaugggguuucucgagaagacaaagaaagaccuuggacugggcucuaucacgacccaagagccggaauccaauauucuggacaucgaucuccggcccgcuagcgccuggacacuguaugcgguggccaccacauucgucaccccuaugcuucgccauuccauugagaacucuagcguuaaugugucccugacggcuaucgccaaccaggcuaccgugcucauggggcugggaaagggcuggccccugucuaaaauggacauuggggucccucuccuugccaucggauguuacagccaggugaaucccauuacacugaccgcugcccugcuccugcuuguugcgcacuacgccaucaucggcccuggccugcaggcuaaggccacaagagaagcucaaaaacgggccgccgcggggauuaugaagaacccgaccguggauggaaucacggucauugaccucgagcccaucccuuaugaucccaaguuugaaaaacagcugggccaggugaugcugcucauucuuugcgucacacaggugcugaugaugcgcaccacaugggcucugugugaggcccucacccuggcuaccgggccuaucuccacacuuugggagggaaaucccggcagauucuggaacacgaccaucgccguuagcauggccaauauuuuucgggggucuuaccuggcuggagccggccuccuguucuccaucaugaagaacacaaccaauacacgcagaggcaccgggaacauuggagaaacgcugggcgagaaauggaagucccggcucaacgcgcuugggaaaucugaauuucaaaucuauaagaaauccggcauucaggagguggaccgcacacuggccaaggagggcaucaagagaggggaaaccgaucaucacgcugucagccggggaucugccaaacugagaugguucguggagcgcaauaugguuaccccggaaggcaagguggucgaccucggcugcgggcggggaggcuggagcuacuauugugggggacugaaaaacgugagagaggugaagggccuuacaaaagggggaccuggccaugaggaacccauccccauguccaccuacggcuggaaucugguucgccuccagucuggggucgauguguucuuuacaccucccgagaagugcgacacgcugcugugugauauuggagaaagcuccccuaacccgaccaucgaggcuggccggacacucagagugcuuaaucuggucgaaaacuggcugaauaacaauacccaauucugcauuaagguucucaaccccuauaugccuagcgugaucgagaaaauggaaacacugcagcgcaaguacgggggagcccuugugcggaauccccuguccagaaacucuacccacgagauguacugggucagcaaugcgacgggcaacauuguguccucuguuaauaugaucagccgcaugcucaucaaccgguuuaccaugaaacacaagaaagccacauaugagccugacguggaucugggguccggaaccagaaacauuggcaucgaaucugagauucccaaucuggacaucauuggcaagcgcaucgaaaagauuaaacaggagcaugaaacaagcuggcacuacgaccaggaucauccguauaagaccugggcuuaccacggguccuaugagacaaaacaaaccggaagcgccucuuccauggucaacggcgugguucggcuccuuacgaagccuugggacgugguccccauggugacacagauggcuaugaccgauaccacaccuuucgggcagcagagaguguuuaaagagaaggucgacacgcgcacccaagaacccaaggagggaaccaaaaagcugaugagaaucaccgccgaauggcuguggaaagagcucggcaagaaaaagacaccucggauguguacccgcgaggaguucacaagaaaaguucggagcaaugcugcccugggggcgaucuuuaccgaugagaacaaguggaagucugccagagaagcuguggaggacggacgguucugggaacuuguggaucgcgagagaaaucugcaccucgagggcaaaugcgaaacgugugucuacaacaugaugggcaagcgggagaaaaagcugggggaauuuggaaaagccaagggcucccgcgcuauuugguauauguggcugggggccagauuccucgaguuugaagcccugggauuccuuaaugaggaccauugguuuagccggggcaacucucuguccgggguggagggcgaaggacuccaccgccugggcuacauccuuagagauguugggaagaaagagggaggcgcgauguacgcugacgauaccgccgggugggacacacggauuacccuggaagaccucaagaaugaggaaauggugacaaaccauaugaaaggagagcacaagaaacuggccgaggcuaucuucaagcugaccuaucagaauaaggucgugcgcguucagagacccacgccgcggggcacagugauggauauuaucagccgcagagaccagcggggguccggccaagucggaaccuacggccucaacacauucaccaauauggaagcccagcugauccgccagauggagggggaaggaauuuuuaaaagcauccaacaucuuacggugaccgaggagauugcuguucagaacuggcuggccagagugggccgggaaagacucucucgcauggcgaucagcggggaugacugcgucgugaagccuauugaugaccgguucgccuccgcucugacagcccuuaaugauaugggaaaagucagaaaggacauccagcagugggagcccucucgcggcuggaacgauuggacccaagugcccuuuugcagccaccacuuccaugaacugguuaugaaagacgggcgggugcucgucgugccuuguagaaaccaggaugagcugaucggccgcgcucggauuucccagggagccggcuggucucugaaggaaacagcgugccucggaaagagcuaugcccagauguggacccugauguacuuucacagacgcgaccuucggcuggcugccaaugcuaucuguuccgccgugccgucucauuggguucccacaagcagaaccacgugguccauucacgcuaaacacgaguggaugacaaccgaggauaugcucgccguguggaaccgcgucuggauccaagaaaauccuuggauggaggacaagacccccguggaaagcugggaggaaguuccuuaucugggaaaacgggaggaccaguggugcggcucucuuauugggcugacauccagagcgaccugggccaagaacauccagacagcuauuaaucaggugcggagccucaucggaaacgaggaauacacggauuauaugcccucuaugaaaagauuccgccgggaggaagaggaagccggcguccugugguga

SEQ ID NO: 20025 - RNA, 9876 nt, Artificial Sequence
  derived and/or modified CDS sequence (opt5) from DENV-2__FJ898465__SS-prME
accgcgggagugaucauuaugcugauccccaccgcuauggccuuccaccucacgaccagaaauggggagccucauaugauugucggacggcaggaaaagggcaagagccugcuuuuuaagacggaggacgggguuaauaugugcacccugauggcgaucgaucucggagaacugugugaggacaccauuaccuacaagugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagaaggcccugauuuucauccuucugacagcgguggccccuagcaugacgaugagaugcauuggcaucuccaaccgggauuuugucgaaggggugucuggaggcagcuggguugacaucgugcucgagcacggguccugugucaccacaauggcuaagaauaaacccacccuggauuucgaacuuauuaagacagaggccaaacagccugcuacccugcgcaaguauugcaucgaagccaaacucacgaacacaaccaccgagagcagauguccgacacaaggagagcccucucugaaugaagaacaggacaagcgguuuauuugcaagcauuccaugguggaucgcggcuggggcaacggguguggacuguucggcaaagggggaaucgugaccugcgcgauguuuacaugcaagaaaaauauggaaggcaaggucguucucccugagaaccuggaauacacgauugugaucacaccccacagcggggaggagcaugccgugggaaaugacacaggcaaacacggcaaggaaaucaaaauuaccccucagucuuccaucacagaggcugaacuuaccggguauggaacggucaccauggaguguagccccagaacaggccuggauuucaacgaaauggugcuccugcagauggaggagaaggccuggcuuguucaccggcaaugguuucuggaccucccgcugccuuggcugcccggggcugauacccagggaucuaauuggauucagaaggaaacacucgugaccuucaaaaacccucaugccaagaaacaggacgucgugguucugggcucccaagagggggccaugcacacggcucuuacaggcgcgaccgaaauccagaugagcuccggaaaucugcucuuuacaggccaucugaagugccgccuuagaauggacaaacugcagcucaaggggaugucuuacagcauguguaccggaaaguucaaaauugugaaggagaucgccgagacccaacacggcacaaucgucauucgggugcaguaugaaggggauggaucccccugcaaaauccccuucgagauuauggaccuggaaaagagacauguccugggccgccucaucacggugaacccuauuguuaccgagaaagauagcccggugaacaucgaagcugagcccccuuuuggggacucuuacauuaucaucggcgucgagcccggacagcugaaacuuaauugguucaagaaaggcuccagcauugggcagauguuugaaacaaccaugcggggagccaagagaauggccauccugggcgauacagcuugggacuucgggucucucggaggcguguuuaccagcauugggaaagcccugcaccaaguuuucggcgcgaucuacggagcugccuuuuccggcgugucuuggacgaugaagauucugaucggggucaucauuacauggaucggaaugaacagccgcuccaccagccuuucugugucccucgugcugguuggcgucgugacccuguaucucggggccauggugcaggcugauagcggaugugucgugucuuggaaaaauaaggagcugaagugcggcuccgggauuuucaucacagacaacguucacaccuggacagaacaguacaaauuucagccugagagccccuccaaacuugccucugcuauucaaaaagcccaugaagagggcaucuguggaauccggagcgugacgagacuggagaaucucauguggaagcagauuaccccggaacugaaccacauccuguccgagaaugaagucaaacuuacaauuaugaccggcgauaucaaggggauuaugcaggcgggaaaacgcucucuccggccucagcccacagagcugaaguauagcuggaagaccuggggcaaagccaagaugcuguccacggaaagccauaaccaaaccuuccucaucgacgggccugagacagcugagugccccaauaccaacagagccuggaacucucuggaaguggaggauuacggauuuggcguuuucuccacaaacaucuggcuuaaacugcgcgaaaagcaggacguguuuugugacagcaaacucaugucugcugccauuaaggauaaucgggcgguccacgccgacaugggcuauuggaucgaguccgcucugaacgauaccuggaagauggagaaagccagcuucauugaagugaagucuugccacuggccuaaaagccauacacugugguccaaugggguucuugagagcgaaaugaucauucccaagaacuucgcuggaccggugucucagcacaacuacagaccuggcuaucauacccagacggccgggcccuggcaccucggaaaacuggagauggacuuugauuucugugaaggcacaaccgucguggugaccgaggacugcgggaaucgcggacccucccugcggacaaccacggccagcggcaagcucaucacagaguggugcuguagauccugcacccugccuccgcuucgguaccgcggcgaagauggguguugguacggaauggagauuagaccccugaaggaaaaagaggaaaaccucgucaauucucugguuacagcuggccaugggcaaaucgacaacuuuagccugggagugcuuggcauggcccucuuccuggaggagaugcugcggaccagaguggggacaaagcacgccaugcuccuggucgcuguguccuuuguuacccuuaucacgggaaauaugucuuuccgcgaucugggccgggugauggucauggugggcgccaccaugacagacgauauugggaugggaguuaccuaucucgcccugcuggcugccuuuaaagugagaccuacauucgcggcuggccuucugcuccgcaagcugaccagcaaagaacucaugauggccacgaucgggauugcccugcuuucccagucuacaauccccgagaccauucuggaacucacagacgcucuggcccugggaaugaugguccuuaagaucgugagaaacauggagaauuaccagcuggcgguuaccaucauggcuauuagcugcgugccuaacgccgucauccuccugaaugccuggaagguguccuguaccauucucgcugccgugagcgucucuccccugcuucugacauccagccaacagaaagcugauuggaucccucucgcccugacgauuaagggccugaaccccaccgcgaucuuucuuacaacccugucucggacauccaaaaagcgcagcuggccgcucaaugaagccguuauggcuguggggauggugucuauccuggccuccagccuccugaaaaacgacauuccuaugaccggaccccuugucgcuggcggccugcugacggugugcuauguucucacagggagauccgccgaccuggagcuugagcgggccgcugaugugaagugggaagaccacgcggagaucagcggaucuagcccuauucuguccaucaccauuucugaagauggcagcauguccaucaaaaaugaggaggaagaacagacccucacaauucugauccgcaccgggcuccuggucaucucuggaguguuccccguuagcauuccgaucacagccgcugccugguaccuuugggaagugaagaagcagagagccggcguccugugggacgugccuucucccccucccgucgggaaagcugagcuggaagauggagccuaucggauuaagcaacgcggcauccucggcuacagccagauuggggcgggaguguauaaagagggcacguuucauaccauguggcacguuacaagaggggcugugcugaugcaucggggaaagcgcaucgagcccagcugggccgacgucaaaaaggaucuuaucuccuacggcgggggauggaagcuggaaggcgaguggaaagaaggcgaggaagugcagguucucgcccuggagccugggaagaacccgagagcugugcagaccaaacccggacucuucaagacaaauaccggcacgauuggggccgucagccuggacuuuucuccuggaaccuccggcagccccaucguggaucggaaagggaaggugguuggacuuuacggcaacggcgucgugacaagaucuggggcguauguguccgcuauugcccaaaccgaaaagagcaucgaagacaacccugagauugaagaugacaucuuccgcaaaaagcggcugacaaucauggaucugcaccccggagccggcaaaaccaagagauaccucccugcuauuguccgcgaggccaucaaacgggggcugagaacacuuauucuggcuccgacgcgcgugguugccgcggaaauggaggaggcccuccggggacugcccaucagauaucagaccccugcuauucgcgccgaacauacaggccgggagaucguggaccucaugugucacgcuaccuucaccaugagacugcuuucccccguccgggugccuaauuacaaccugauuaucauggacgaagcccacuuuacagaucccgccucuaucgcugcgcgcggguauauuagcacgagaguugagaugggcgaggccgcuggaaucuucaugaccgccacaccgccuggcucccgggaccccuuuccccagagcaaugccccuauuauggaugaggaacgcgaaauccccgagagaucuuggaacuccgggcaugaaugggugaccgacuucaagggaaagacagucugguuugugccuagcauuaaagcuggcaaugauaucgccgcgugccugcggaagaacgggaaaaagguuauccagcucucuagaaaaaccuucgacagcgaguacgugaagacgcgcgcuaaugauugggacuuugucgugacaaccgauauuuccgagaugggagccaacuuccgggccgaaagagugaucgacccgcgccgguguaugaagcccgucauucugaccgauggcgaggaaagaguuauccuugcugggccuaugcccgugacacacucuagcgccgcgcaacgccggggcagaauuggacgcaauccuaaaaacgagaaugaccaguauaucuacaugggcgaaccccuggagaacgacgaggauugcgcccauuggaaggaagcuaaaaugcuccuggacaauaucaacaccccggaggggauuaucccuuccauguuugaacccgagagagaaaagguggaugccauugacggagaguaccggcugcgcggcgaggcuagaaaaacauucgucgaucucaugcggcgcggggaccuuccuguguggcuggccuauagaguugcugccgaaggaaucaauuacgcggaucggagaugguguuuugacggcauuaagaacaaccagauccuggaggaaaauguggaggucgagauuuggaccaaagaaggggagcgcaagaagcucaaaccccgguggcuggaugccagaaucuauucugacccucuugcucugaaggaguucaaagaguucgccgcuggccgcaagagccucacgcugaaccugaucacagaaaugggacggcuccccaccuuuaugacacaaaaagccagagaugcccuugacaaucuggcugugcugcacaccgcggaggccggcgggcgggcuuacaaccacgcccucuccgagcugccggaaacgcuugagacccugcuccugcugacacuccuugccaccguuacaggaggcauuuuccuguuucugaugagcgggaagggaaucggcaagaugacccucggcaugugcugcauuaucacagcuucuauucugcuuugguaugcccagauccagccucauuggaucgcggccuccauuauccuggaguucuuucucauugugcugcugauccccgagcccgaaaaacagcgcaccccucaagauaaucagcucacguacgucgugauugcuauccuuacagucguggccgcuaccauggccaacgagaugggguuccuggagaagaccaaaaaggaccugggacucggcagcaucacaacccaggaauccgagucuaauauucuggacaucgaucuuagaccggcgagcgccuggacacuguaugcuguugccacgaccuuugugacacccaugcuccggcacuccauugaaaacucuagcgugaaugucucccugaccgcuaucgccaaccaggcuacaguucugauggggcucggaaaaggcuggccucuuagcaagauggacauuggggugccccugcuggccaucggauguuacucucaagugaauccuauuacccucacggcggcccugcuucugcucgucgcucauuacgccaucaucggccccggccugcaggcuaaggccacccgcgaggcccagaaaagagcggcugccgggauuaugaagaacccuacaguggauggaaucaccguuauugaccuggaaccgauccccuaugauccuaaauucgagaagcagcucggccaagugaugcuucugauucugugcgucacacaggugcucaugaugcggaccacgugggcucugugugaggcccuuacacuggccaccgggcccaucuccacacucugggaaggaaauccuggccgcuuuuggaacaccaccaucgcugucagcauggccaauauuuucagagggucuuaccuggcgggagccggccugcucuuuuccaucaugaaaaacacaacgaauacccggcgcggcacagggaacauuggagagacccuuggcgaaaaguggaaguccagacugaacgcucuggggaaaucugaguuccagaucuauaagaaaagcggcauucaggagguggaccggacacucgccaaggaaggcaucaaaagaggggagaccgaucaccaugcuguuucccgcggaucugccaagcugcggugguuuguggaaagaaauauggucacgcccgagggcaaagugguugaccuuggcugcgggcgcggaggcuggagcuacuauugugggggacugaagaacgugcgggaagucaagggccucacaaaagggggaccgggccacgaggagccuauccccauguccaccuacggcuggaaucuggugagacugcaaagcgggguggauguuuucuucacacccccugaaaagugcgacacacuccuuugugauauuggagaguccucucccaacccuaccaucgaagcgggccgcacacugcggguccugaaucucguggagaacuggcugaauaacaauacgcaguuuugcauuaaagugcuuaacccguauaugcccagcgucaucgaaaagauggagacccugcagagaaaauacgggggagcccucguucgcaauccucugucccggaacucuacacacgagauguacugggugagcaaugcuaccggcaacauuguguccucugucaauaugaucagcagaaugcugaucaaccgcuucacaaugaagcauaagaaagccaccuaugaacccgacguggaucucggguccggaacgcggaacauuggcaucgagagcgaaauuccuaaucuugacaucauuggcaagagaaucgagaaaauuaagcaagaacacgagaccucuuggcauuacgaccaggaucaccccuauaaaacaugggcuuaccacggguccuaugagaccaagcagacaggaagcgccucuuccaugguuaacggcgugguccgccugcugaccaagccgugggacgugguuccuauggugacacagauggcuaugaccgauacgacacccuuugggcaacagagagucuucaaagaaaagguggacacccggacccaggagccuaaagaaggaacaaagaaacucaugcgcaucacggccgaguggcuguggaaggagcuuggcaagaaaaagacccccagaauguguacacgggaagaguuuaccagaaaagugcggagcaaugcggcccugggggcuaucuucacagaugaaaacaaguggaaaucugcccgcgaggcugucgaagacuccagauuuugggagcucguugaucgggagcgcaaucugcaucuggaaggaaagugcgagaccuguguguacaacaugaugggcaaaagagaaaagaagcucggcgaguucgggaaagccaagggaagccgggccauuugguauauguggcugggcgcgcgcuuucuugaguucgaggcucugggguuucucaaugaggaccacugguucuccagaggaaacagccugucuggcguggaaggggagggccuucaucggcugggauacauccuccgcgaugucagcaaaaaggaaggcggggccauguacgccgacgauacagcuggaugggacaccagaauuacgcuggaggaccugaaaaaugaagagauggugaccaaccacaugaagggcgagcauaagaaacucgccgaagcuaucuuuaagcugacauaucagaauaaaguugugcggguccaacgcccuacccccagagggacagugauggauauuaucucccggcgcgaccagagaggaucuggccagguugggaccuacggccuuaacacguucacaaauauggaggcccagcugauccggcaaauggaaggagagggcauuuucaagagcauccagcaccucaccgugacagaggaaauugcgguccagaacuggcuggccagaguggggcgcgagcggcuuuccagaauggcuaucucuggagaugacugcguugugaaaccgcuggaugaccgcuuugccagcgcucucaccgcccugaaugauaugggcaagguccggaaggacauucaacagugggaaccuuccagaggguggaacgauuggacacaggugcccuucugcucucaccauuuucacgagcuggucaugaaagacggacgcgugcucguugugcccugucggaaccaggaugaacugaucggcagagcgcgcaucagccaaggggccggcuggucccuuaaggagaccgcuugccugggaaaaagcuaugcccagauguggacacucauguacuuccaucggagagaccugcgccuugcugccaaugcuauuuguucugccgucccuucccacugggugccgaccagccggacaaccuggucuauccacgcgaagcaugaguggaugacaaccgaagauaugcuggccguguggaacagaguuuggauucaggagaaucccuggauggaagacaaaacgccuguggaguccugggaagagguccccuaucucggcaagcgggaggaccaguggugcgggagccugaucggacugacauccagagcuaccugggccaagaacauucaaaccgccaucaaucaggugcgcucucucauuggcaacgaagaguacacagauuauaugccuagcaugaaacgguuuagacgcgaagaggaagaggcugggguucugugguga

SEQ ID NO: 20026 - RNA, 9876 nt, Artificial Sequence
  derived and/or modified CDS sequence (opt5) from DENV-2__FJ898466__SS-prME
accgccggagugaucgugaugcugauucccacagcuauggccuuccaccucacgacccggaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagagagcucaugaggaaggcauuuguggaauccgcagcgucacacggcuugagaaucugauguggaagcagaucaccccggagcucaaccacauucuguccgaaaaugaggugaaacugacaaucaugaccggcgacacgaaggggauuaugcaggccggaaaaagaucucuucgcccucaacccaccgaacucaaguauagcuggaaaacauggggcaaggcgaagaugcuguccaccgagagccauaaccagacauuccugaucgaugggccugaaaccgccgagugccccaauacaaaccgggcuuggaacucucucgagguugaagacuacggauuuggcguguucaccacgaacauuuggcugaaacuuagagagaagcaggacaucuuuugugauuccaaacugaugagcgccgcuaucaaggacaaucgcgccguccacgcggauaugggcuauuggauugaaucugcccucaacgacacauggaaaauggagaaggcuuccuucaucgaggucaagagcugccacuggccuaaaucucauacccuguggagcaaugggguucuggaauccgagaugauuauccccaagaacuucgccggaccggugagccagcacaacuaccggccuggcuaucauacccaaacagcugggcccuggcaccuuggaaaacucgaaauggauuuugacuucugugagggcaccacggucguggugacagaagauugcgggaauagaggacccucucugcggaccacaaccgccuccggcaagcugauuacagaguggugcugucgcagcugcacccucccuccgcugagauaccggggcgaggacggguguugguacggaauggaaaucagaccccuuaaagagaaggaagagaaccuggucaauucccucguuacggccggccaugggcagauugauaacuuuucucugggagugcugggcauggcucuuuuccucgaagagaugcugcgcacccggguggggacaaagcacgcgauccugcucgucgccgugagcuuuguuacccugaucacaggaaauauguccuucagagaccuuggccgcgugauggucauggugggcgcuaccaugacggaugacauugggaugggaguuacauaucuggcccuccuggccgcuuuuaaagugagaccuaccuucgccgcgggccugcuucugcggaagcucacaucuaaagagcugaugauggcuaccaucgggauugcccuccugagccaguccaccauccccgaaacaauucuugagcugacggaugcccucgcucugggaaugauggcccugaagaucguccgcaacauggaaaaauaccaacuugcggugaccaucauggcuauuucuugcguuccuaaugccgugauccugcagaacgccuggaaggucagcuguacaauucucgcugccguguccgugagcccccugcuccugaccucuucccagcagaaggcugacuggaucccucuugcccugacaauuaaaggccucaaucccaccgcgaucuuucugacgacacugagcagaaccucuaagaaacgguccuggccgcuuaacgaggccaucauggcugucgggaugguuagcauucuggccucuucccuccugaagaaugacaucccuaugaccggaccccucguggcuggcggccugcuuacagugugcuauguccugaccgggcgcagcgccgaucuggaacucgagagagccgcugacgugaaaugggaggaucaagcggaaauuuccggaagcucuccuauccugagcauuacaaucuccgaggacggcucuaugagcauuaagaacgaagaggaggaacagacgcuuaccauccugauccggacagggcuccugguuauuuccggaguguuccccgucucuaucccgauuaccgccgcugccugguaccucugggaggugaaaaagcagcgcgccggcguucugugggaugugccuucucccccucccgucgggaaggcugaacuugaggacggagccuauagaaucaaacagcggggcauucugggcuacucccaaaucggggcgggaguguauaaggaaggcacauuucacaccauguggcaugucacgcgcggggcugugcugaugcacagaggaaaacggaucgagcccuccugggccgauguuaagaaagaccucauuagcuacggcgggggauggaagcuggagggcgaauggaaggagggcgaagaggugcagguccuugcccuggaaccugggaaaaauccgagagcugugcagaccaagcccggaaucuuccgcacaaacaccggcacaauuggggccguuucccucgauuuuagcccuggaaccucuggcucccccaucguggaccggaaagggaaggucgugggacuguacggcaauggcgugguuacaagaagcggggcguaugucucugcuauugcccagacggagaaauccaucgaggauaacccugaaaucgaggacgauauuuuccgcaagaagcggcucaccaucauggaccugcaucccggagccggcaaaacaaagagauaccuuccugcuauugugcgcgaagccaucaaacgggggcugagaacccugauucucgcuccgacccgcguggucgccgcggagauggaagaggcccugcggggacuucccaucagauaucaaaccccugcuauuaaggccgagcacacgggccgggaaaucguggaccugaugugucaugcuaccuucacaaugcgccuccugagccccguuagagugccuaacuacaaucucaucauuauggaugaggcccacuuuaccgaccccgccuccaucgcugcgcggggguauauuucuacacgcgucgaaaugggcgaggccgcuggaaucuucaugaccgccacgccgccuggcagcagagaucccuuuccccaguccaacgccccuauuauggacgaggaacgggagauccccgaaagaagcuggaacucugggcacgagugggugacagauuucaaaggaaagaccguuugguuugugccuuccaucaaggcuggcaacgacauugccgcgugccugcgcaaaaaugggaagaaagucauccagcuuagccggaagaccuucgauucugaauacgugaaaacaagagcuaacgacugggauuuuguugugaccacagacauuagcgagaugggagccaauuucaaggccgagcgcgucaucgauccgcggagauguaugaagcccgugauucugaccgacggcgaagaaagagugauccuggcugggccuaugcccgucacgcauuccucugccgcgcaacggagaggccgcaucggaagaaacccuaaaaaugaaaacgaccaguauauuuacaugggcgagccccucgaaaaugaugaggacugcgcccacuggaaggaggcuaaaaugcugcuugauaacaucaauacaccggaagggauuaucccuagcauguuugagcccgaacgggagaagguugacgccauugauggagaauaccgccugagaggcgaggcucggaaaaccuucguggaccucaugcgcagaggggaucugccuguguggcuggccuauaaggucgcugccgagggaaucaacuacgcggaccggaaaugguguuuugauggcauuaagaauaaccagauccucgaagagaacguggaaguugagaucuggacaaaggagggggaacgcaagaaacuuaaaccccgcuggcuggacgcccggauuuauuccgauccucuggcucucaaggaguucaaagaguucgccgcuggcagaaagucucugacccuuaaucugaucacggagaugggacgccuccccaccuuuaugacacagaaggcccggaacgcccuggacaaucuggcugugcuccauaccgcggaagccggcgggagagcuuacaaccacgcccuuagcgagcugccggagacacuggaaacccuccugcuucugacacuccuggccaccgucacgggaggcauuuuccuguuucucauguccgggaaaggaaucggcaagaugacacuuggcaugugcugcauuaucaccgcuagcauccugcugugguaugcccaaauucagccucacuggaucgcggccucuauuauccucgaguucuuucugauugugcuucugauccccgaacccgagaaacagcggaccccucaggauaaucaacucacauacguugugaucgcuauucugaccgucguggccgcuacaauggccaacgaaaugggguuccuggagaagacgaaaaaggaccucggacuuggcuccaucaccacacaggagagcgaauccaauauucuggacaucgaucugcgcccggcgucugccuggacccucuaugcugucgccacaaccuuuauuacgcccaugcugagacauagcaucgagaacuccucugugaauguuagccuuaccgcuauugccaaccaggcuacagugcugauggggcucggaaagggcuggccucuguccaaaauggacaucggggugccccugcucgccaucggauguuacagccaggucaauccuauuacccuuacagcggcccugcugcuccugguugcucacuacgccaucauuggccccggccuucaagcuaaggccacccgggaagcccagaaacgcgcggcugccgggaucaugaagaacccuacgguggauggaauuacagugaucgaccuggagccgauccccuaugauccuaaauucgaaaagcagcucggccaggucaugcugcugauucucugcgugacccaaguucuuaugaugagaacaaccugggcucugugugaggcccugacccucgccacagggcccaucucuacgcugugggagggaaauccuggccgguuuuggaacaccacaauugcuguguccauggccaauaucuuccgcgggagcuaccuugcgggagccggccugcucuuuucuauuaugaagaacaccacaaauaccagacggggcacggggaacaucggagaaacacugggcgagaaauggaagucccgccugaacgcucucgggaaaagcgaguuccagaucuauaagaaaucuggcauucaggaggucgacagaacccuugccaaggagggcaucaaaagaggggaaaccgaucaucacgcugugagcagaggauccgccaagcugcgcugguuugucgagcggaauauggugacacccgaaggcaagguuguggaccugggcugcgggagaggaggcuggucuuacuauugugggggacucaaaaacguccgcgaggugaagggccugaccaaagggggaccgggccaugaagaaccuauucccaugagcacauacggcuggaaucuuguucggcugcaauccgggguggaugucuucuucacgcccccugagaagugcgacacccuccugugugauaucggagaaagcucccccaacccuacaauugaggcgggcagaacccugcgcgugcucaaucuuguggaaaacuggcugaauaacaauacacaguuuugcaucaaaguucugaacccguauaugcccucugucaucgagaagauggaaacccuccagcggaaguacgggggagcccuggugagaaauccucuuagccgcaacuccacgcacgagauguacugggugucuaaugcuaccggcaacauugucagcuccguuaauaugaucucucggaugcugauuaacagauucacaaugaaacacaagaaagccaccuaugagcccgacguggaucucgggagcggaacacgcaacaucggcauugaauccgagaucccuaaucuggacauuaucggcaagcggaucgagaagauuaagcaggagcaugaaaccagcuggcacuacgaccaagaucaucccuauaagacaugggcuuaccacgggucuuaugagaccaaacagacgggauccgccagcucuauggugaacggcgucgugagacugcucacaaagccgugggacguugugccuauggucacccagauggcuaugaccgauacaacgcccuuugggcagcaacgcguguucaaagagaagguugacaccagaacacaggaaccuaaagagggaaccaagaaacuuaugaaaaucacagccgaauggcuguggaaggagcugggcaaacggaagacaccccgcauguguacaagagaggaauuuaccaaaaaggugcgguccaaugcggcccucggggcuauuuucacggaugagaacaaauggaaaagcgccagagaagcugucgaggacggacgguuuugggaacugguggaucgcgagagaaaucuucaccuggagggcaagugcgaaaccuguguguacaacaugaugggcaaacgggagaagaaacucggggaguucggaaaggccaaaggcucucgcgccaucugguauauguggcugggggcgagauuucuggaguucgaagcucucggauuucugaaugaggaccauugguucucccggggcaacagccuuuccggggucgagggcgaaggacugcaccgccucggcuacauucugagagauguugggaagaaggagggaggcgccauguacgccgacgauacagcugggugggacacccggaucacacuugaagaccugaaaaaugaggaaauggugaccaaccauaugaagggagagcacaaaaagcucgccgaggcuaucuuuaaacugacguaucagaauaaggugguccgcgugcagagaccuacaccccggggcaccguuauggauauuaucagccgcagagaccaacgggggucuggccaggugggaacauacggccugaacaccuucacgaauauggaagcccagcucauucgccaaauggagggggaaggaaucuucaagagcauucagcaucugaccgcgacagaggagaucgccguccagaacuggcuugcuagagugggccgggaaagacugucccgcauggccaucucuggggaugacugcguugugaaaccgauugaugaccgguuugcuagcgcccucaccgcgcugaaugauaugggaaaggucagaaaagacauccagcaaugggagccuucccgcggcuggaacgauuggacacaggugcccuucugcucucaccacuuucaugaacuuguuaugaaggacgggcgggugcuggucgugcccuguagaagccaggaugagcucauuggccgcgcccggaucucccagggagcuggcuggucucugaaagaaaccgccugccugggaaagagcuaugcucaaauguggacacucauguacuuccacagacgcgaccugcggcuugccgcuaacgccauuuguuccgcggucccuagccauugggugccgaccucuagaacgacaugguccauccacgccaagcacgaguggaugaccaccgaggauaugcuggcuguuuggaaucgcguguggauucaggaaaaccccuggauggaggacaaaacaccugucgaaagcugggaggaagugcccuaucucggaaagcgggaggaccaguggugcggcucucugaucgggcuuaccuccagagccacaugggccaaaaauauccagacggcuauuaaccaagugcggagccugaucggaaaugaggaauacaccgauuauaugccuuccaugaagagauuucgccgggaggaagaggaagccggcguucucugguga

SEQ ID NO: 20027 - RNA, 9876 nt, Artificial Sequence
  derived and/or modified CDS sequence (opt5) from DENV-2__FJ898467__SS-prME
acagccggcgugaucauuaugcugauccccacagcuauggccuuccaccucacgaccagaaauggggaaccucauaugauugucggacggcaggaaaagggcaagagccugcuuuuuaagacagaagacgggguuaauaugugcacccugauggcgaucgaucucggagaacugugugaggacacaauuaccuacaaaugcccgcuucugagacaaaaugaacccgaggauaucgacuguuggugcaauagcacaucuaccugggugacguauggcaccuguacaaccacaggggagcacagacgggaaaagagaagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagaauccaguaugagggggacggaucccccugcaagauucccuucgaaaucaccgaucucgagaaacgccaugugcugggccggcugauuacagucaacccuaucgugauugaaaaggacagcccgguuaacaucgaggccgaacccccuuuuggggauucuuacaucauuaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcgucuuuacgagcauugggaaggcucuccaccagguguucggcgccaucuacggagcggcuuuuuccggcguuucuuggacaaugaaaauccugauugggguggucaucaccuggauuggaaugaacagccgguccaccagccugucugugucccuugugcucguuggcgucgugacacuguaucugggggccauggugcaggccgacagcggaugugucgugucuuggaagaauaaagaacucaagugcggcuccgggaucuucauuaccgauaacguucacacauggacggagcaguacaaguuucaaccugaaagccccuccaaacuggcuucugccauccagaaggcucaugaggaaggcaucuguggaauuagaagcgugacccgccuugagaaucugauguggaaacagaucacaccggagcucaaccacauucuguccgaaaaugaggucaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgauccugcucgucgccgugagcuuuguuacacugauuaccggaaauauguccuuccgggaccuuggcagagugauggucauggugggcgcuacaaugaccgaugacaucgggaugggaguuacguaucuggcccuccuggccgcuuuuaaggugcgcccuacauucgccgcgggccugcuucugagaaaacucaccucuaaggagcugaugauggcuacaauugggaucacccuccugagccaguccaccauucccgaaacaauccuugagcugacggaugcccucgcccugggaaugaugguccugaaaaucgugcggaacauggaaaaguaccaacuugcuguuaccauuauggccaucucuugcgugccuaaugcggucauucugcgcaacgcuuggaaggugagcuguacaauccucgccgccguguccgucagcccccugcuccugaccucuucccagcagaaagcugacuggauuccucuugcccugacaaucaagggccucaaucccaccgcuaucuuucugacgacacugagcagaaccucuaaaaagcgguccuggccgcuuaacgaggccauuauggcgguugggauggugagcauccuggccucuucccuccugaaaaaugacauuccuaugaccggaccccucguggcuggcggccugcuuacagucugcuaugugcugaccgggcgcagcgccgaucuggaacucgagagagcugccgacguuaagugggaggaucaggccgaaaucuccggaagcucuccuauucugagcaucacaauuuccgaggacggcucuaugagcaucaaaaacgaagaggaggaacaaacgcuuaccauccugauucggacagggcuccuggugaucuccggagucuuccccgugucuauuccgaucaccgcugcggccugguaccucugggagguuaagaagcagcgcgcuggcgugcugugggaugucccuucucccccucccguggggaaagccgaacuugaggacggagccuauagaauuaagcagcggggcauccugggcuacucccagaucggggcuggagucuauaaagaaggcacauuucacaccauguggcaugugacgcgcggggccguucugaugcacagaggaaagcggauugagcccuccugggcggaugugaaaaaggaccucaucagcuacggcgggggauggaagcuggagggcgaauggaaagagggcgaagagguccaagugcuugcucuggaaccugggaagaauccgagagccguucagaccaaacccggaauuuucaagacaaacaccggcacaaucggggccgugucccucgauuuuagcccuggaaccucuggcucccccauugucgaccgcaaagggaagguggugggacuguacggcaauggcguugucacacggagcggggcuuaugugucugccaucgcgcagacggagaaguccaucgaggauaacccugaaauugaggacgauaucuuccgcaagaagcgccucaccauuauggaccugcaucccggagcuggcaaaacaaagcgguaccuuccugccaucgugagagaagccauuaaacgcgggcugcggacccugauccucgcuccgaccagagucguggccgcugagauggaagaggcccugcgcggacuucccauucgguaucagaccccugcgaucaaggccgagcacacgggcagagaaaucguugaccugaugugucaugcuaccuucacaaugcggcuccugagccccgugcgcgucccuaacuacaaucucauuaucauggaugaggcccacuuuaccgaccccgcuuccauugccgccagaggguauaucucuacacggguggaaaugggcgaggcugcgggaauuuucaugaccgccacgccgccuggcagccgcgaucccuuuccccaauccaacgcuccuaucauggacgaggaaagagagauccccgaacggagcuggaacucugggcacgaguggguuacagauuucaagggaaaaaccgugugguuugucccuuccauuaaggccggcaacgacaucgccgcuugccugcgcaagaaugggaagaaagugauucagcuuagccgcaagaccuucgauucugaauacguuaagacacgggccaacgacugggauuuuguggucaccacagacaucagcgagaugggagcgaauuucaaagcugagagagugauugauccgcgccgguguaugaagcccgugauccugaccgacggcgaagagagagucauccuggccgggccuaugcccguuacgcauuccucugccgcucagcgccggggcagaauuggacgcaacccuaaaaaugaaaacgaccaauauaucuacaugggcgagccccucgaaaaugaugaggacugcgcccacuggaaggaggcgaaaaugcugcuugauaacauuaauacaccggaagggaucauuccuagcauguuugagcccgaaagagagaagguggacgccaucgauggagaauaccggcugcgcggcgaggcuagaaaaaccuucguggaccucaugcggcgcggggaucugccugucuggcuggccuauaagguggcugccgagggaauuaacuacgcugacagaaagugguguuuugauggcaucaaaaauaaccagauccucgaagagaacguugaaguggagauuuggacaaaggagggggaacggaagaaacuuaaacccagauggcuggacgcccgcaucuauuccgauccucuggcgcucaaagaguucaaggaguucgccgcuggccggaaaucucugacccuuaaucugauuacggagaugggaagacuccccaccuuuaugacacagaaggcccgcaacgcucuggacaaucuggccguccuccauaccgccgaagcuggcgggaaagcguacaaccacgcccuuagcgagcugccggagacacuggaaacccuccugcuucugacacuccuggcuaccgugacgggaggcaucuuccuguuucucauguccgggaagggaauuggcaaaaugacacuuggcaugugcugcaucaucaccgccagcguucugcugugguaugcccagauucaaccucacuggaucgcugccucuauuauccucgaguucuuucugauugugcuucugauccccgaacccgagaagcagcggaccccucaggauaaucagcucacauacgucgugaucgcgauucugaccgucguggccgcuacaauggccaacgaaaugggguuccuggagaagacgaaaaaggaccucggacuuggcuccaucaccacacaagagagcgaauccaauauucuggacaucgaucugagaccggcuucugccuggacccucuaugcgguugccacaaccuuugugacgcccaugcugcggcauagcauugagaacuccucugugaaugucagccuuaccgcuaucgccaaccaggcuacaguucugauggggcucggaaaaggcuggccucuguccaagauggacauuggggugccccugcucgccaucggauguuacagccaggugaauccuaucacccuuacagcugcccugcugcuccuggucgcgcacuacgccauuaucggccccggccuucaggcuaaagccacccgcgaagcucaaaagagagccgccgcggggauuaugaagaacccuacgguggauggaaucacaguuauugaccuggagccgauccccuaugauccuaaauucgaaaagcagcucggccaggugaugcugcugauccucugcgucacccaggugcuuaugaugcggacaaccugggcucugugugaggcccugacccucgcuacagggcccauuucuacgcugugggagggaaauccuggccgcuuuuggaacaccacaaucgccgucuccauggccaauauuuucagagggagcuaccuugcuggagccggccugcucuuuucuaucaugaaaaacaccacaaauacccggcgcggcacggggaacauuggagaaacacugggcgagaaguggaaauccagacugaacgcgcucggaaagagcgaguuccaaaucuauaaaaagucuggaauccaggagguggaccggacccuugccaaggagggcauuaaacgcggggaaaccgaucaucacgcuguuagcagaggauccgccaagcugcggugguuuguggagagaaauauggucacacccgaaggcaaagugguugaccugggcugcgggcgcggaggcuggucuuacuauugugggggacucaagaacgugcgggaggucaaaggccugaccaaagggggaccgggccaugaagaaccuauccccaugagcacauacggcuggaaucuugugagacugcaguccgggguggauguuuucuucacgcccccugagaagugcgacacccuccugugugauauuggagaaagcucccccaacccuacaaucgaggcuggccgcacccugcggguccucaaucuuguggaaaacuggcugaauaacaauacacaauuuugcauuaaagugcugaacccguauaugcccucugucaucgagaagauggaaacccuccagagaaaauacgggggagcccugguucgcaauccucuuagccggaacuccacgcacgagauguacugggugucuaaugcgaccggcaacaucgugagcuccgucaauaugauuucuagaaugcugaucaaccgcuucacaaugaagcacaaaaaggccaccuaugagcccgacguggaucucgggagcggaacacggaacauuggcaucgaauccgagauuccuaaucuggacaucauuggcaagagaaucgagaagaucaagcaggagcaugaaaccagcuggcacuacgaccaggaucaucccuauaaaacaugggcuuaccacgggucuuaugagaccaagcaaacgggauccgccagcucuaugguuaacggcgugguccgccugcucacaaaaccgugggacgugguuccuauggugacccagauggcuaugaccgauacaacgcccuuugggcagcagcgggucuucaaggagaagguggacaccagaacacaagaaccuaaagagggaaccaagaaacuuaugcgcauuacagccgaauggcuguggaaggagcugggcaaaaagaaaacccccagaauguguacacgggaggaauuuacccgcaaggugagauccaaugcugcccucggggcgaucuucacggaugagaacaaguggaaaagcgcccgggaagcugucgaggacggaagauuuugggaacugguugauaaggagcggaaucuucaccuggagggcaaaugcgaaaccuguguguacaacaugaugggcaagcgcgagaaaaagcucggggaguucggaaaggccaaaggcucuagagcuauuugguauauguggcugggggcccgguuucuggaguucgaagcccucggauuucugaaugaggaccauugguucucccgcggcaacagccuuuccgggguggagggcgaaggacugcacagacucggcuacauccugcgggaugucgggaagaaagagggaggcgcgauguacgcugacgauacagccgggugggacacccgcauuacacuugaagaccugaagaaugaggaaauggugaccaaccauaugaaaggagagcacaagaagcucgccgaggcuaucuuuaaacugacguaucagaauaagguugugagaguccagcggccuacaccccgcggcaccgugauggauaucauuagcagacgggaccagcgcgggucuggccaaguuggaacauacggccugaacaccuucacgaauauggaagcccagcucaucagacagauggagggggaaggaauuuucaaaagcauccaacaucugaccgcuacagaggagauugccgugcagaacuggcuugcgcgggucggccgcgaaagacugucccggauggccaucucuggggaugacugcgugguuaagccgaucgaugacagauuugcuagcgcccucaccgcucugaaugauaugggaaaagugcgcaaggacauucagcagugggagccuucccggggcuggaacgauuggacacaaguccccuucugcucucaccacuuucaugaacuugugaugaaggacgggagaguccuggugguucccugucgcaaccaggaugagcucaucggccgggccagaauuagccagggagcgggcuggucccugaaagaaaccgccugccuggggaagucuuaugcucagauguggacacucauguacuuccaccgccgggaccugagacuugccgcuaaugccaucuguagcgcugugccuucccauugggucccgaccagccgcacgacauggucuauucacgccaaacacgaguggaugaccaccgaggauaugcuggcgguguggaaccggguguggauccaagaaaaucccuggauggaggacaagacaccuguugaauccugggaggaagugcccuaucucggaaaaagagaggaccaguggugcggcagccugauugggcuuaccucucgcgccacaugggcuaagaacauccagacggccaucaaucagguccggucccugauuggaaacgaggaauacaccgauuauaugccuagcaugaagagauuucggagagaggaagaggaagccggcgugcucugguga

SEQ ID NO: 20028 - RNA, 9876 nt, Artificial Sequence
  derived and/or modified CDS sequence (opt5) from DENV-2__GQ868595__SS-prME
acagcgggagugaucauuaugcugauccccacagcuauggccuuccaccucacgaccagaaauggggagccucauaugauugucagccggcaggaaaaggggaagucccugcuuuuuaagacagaggacggcguuaauaugugcacccugauggcgaucgaucucggggaacugugugaggacacaauuaccuacaaaugcccgcuucugcgccaaaaugaacccgaggauaucgacuguuggugcaauucuacaagcaccugggugacguauggaaccuguacaaccacaggcgagcacagacgggaaaagcgcuccguggcucucgucccucauguggggaugggacuggagaccagaacggaaacauggaugucuagcgagggcgccuggaaacacguucagcggaucgagaccuggauucugcgccaucccggcuucgccaucauggcugccauucucgcuuacacaaucgggaccacccacuuucagagagcccugauuuucauccuucugacagcgguggccccuuccaugacgaugcggugcauuggaaucucuaaccgcgauuuugucgaaggcgugagcgggggauccuggguugacaucgugcucgagcacggcagcugugucaccacaauggcuaagaauaagcccacccuggauuucgaacuuauuaaaacagaggccaagcagccugcuacccugagaaaauauugcaucgaagccaagcucacgaacacaaccaccgagucucgguguccgacacaaggggagcccucccugaaugaagaacaggacaaacgcuuuauuugcaagcauagcaugguggauagaggauggggcaacggcugugggcuguucggaaagggcgggaucgugaccugcgcgauguuuacaugcaaaaagaauauggaaggaaaagucguucucccugagaaccuggaauacacgauugugaucacaccccacucuggcgaggagcaugccguggggaaugacacaggaaagcacggcaaagaaaucaagauuaccccucaguccagcaucacagaggcugaacuuaccggcuaugggacggucaccauggaguguucuccccggacaggacuggauuucaacgaaauggugcuccugcagauggaggagaaagccuggcuuguucaccgccaaugguuucuggaccucccgcugccuuggcugcccggcgcugauacccagggguccaauuggauucagaaggaaacacucgugaccuucaagaacccucaugccaaaaagcaggacgucgugguucugggaagccaagagggcgccaugcacacggcucuuacaggggcgaccgaaauccagauguccucuggcaaucugcucuuuacaggacaucugaaaugcagacuucggauggacaagcugcagcucaaaggcaugagcuacuccauguguaccgggaaguucaagauugugaaagagaucgccgagacccaacacggaacaaucgucauuagagugcaguaugaaggcgaugggagccccugcaagauccccuucgagauuauggaccuggaaaaacgccauguccugggacggcucaucacggugaacccuauuguuaccgagaaggauucuccggugaacaucgaagcugagcccccuuuuggcgacuccuacauuaucaucggggucgagcccggccagcugaaacuuaauugguucaagaagggaagcucuauuggccagauguuugaaacaaccaugagaggggccaaacgcauggccauccugggagauacagcuugggacuucggcagccucgggggaguguuuaccuccauuggcaaggcccugcaccaaguuuucggggcgaucuacggcgcugccuuuucuggagugagcuggacgaugaaaauucugaucggcgucaucauuacauggaucgggaugaacucccggagcaccucucuuuccgugagccucgugcugguuggagucgugacccuguaucucggcgccauggugcaggcugauucugggugugucguguccuggaagaauaaagagcugaagugcggaagcggcauuuucaucacagacaacguucacaccuggacagaacaguacaaguuucagccugagucccccucuaaacuugccagcgcuauucaaaaggcccaugaagaggggaucuguggcaucagauccgugacgcgccuggagaaucucauguggaaacagauuaccccggaacugaaccacauccugucugagaaugaagucaaacuuacaauuaugaccggagauaucaaaggcauuaugcaggcggggaagcggagccucagaccucagcccacagagcugaaauauuccuggaagaccuggggaaaggccaaaaugcugagcacggaaucucauaaccaaaccuuccucaucgacggcccugagacagcugagugccccaauaccaaccgcgccuggaacucccuggaaguggaggauuacggguuuggaguuuucacaaccaacaucuggcuuaagcugcgggaaaaacaggacguguuuugugacagcaagcucaugucugcugccauuaaagauaauagagcgguccacgccgacaugggcuauuggaucgaguccgcucugaacgauacauggaagauggagaaggccagcuucauugaagugaaaucuugccacuggccuaagagccauacccugugguccaauggcguucuugagagcgaaaugaucauucccaaaaacuucgcugggccggugucucagcacaacuaccgcccuggauaucauacgcagacagccggccccuggcaccucgggaagcuggagauggacuuugauuucugugaaggaaccaccgucguggugacagaggacugcggcaaucgggggcccucccugagaaccacgacagccagcggaaaacucaucaccgaguggugcugucgguccugcacacugccuccgcuucgcuacagaggcgaagauggcuguugguacgggauggagauucggccccugaaggaaaaggaggaaaaccucgucaauucucugguuaccgcuggacauggccaaaucgacaacuuuagccugggggugcuuggaauggcccucuuccuggaggagaugcugagaacacgcgugggcaccaaacacgccauccuccuggucgcuguguccuuuguuacgcuuauuaccgggaauaugucuuuccgggaucugggaagagugauggucauggugggcgccacaaugaccgacgauaucggcauggggguuacauaucucgcccugcuggcugccuuuaaggugcgcccuaccuucgcggcuggacuucugcucagaaaacugacgagcaaggaacucaugauggccacaauuggcaucgcccugcuuucccagucuaccauucccgagacaauccuggaacucaccgacgcucuggcccuggggaugaugguccuuaaaaucgugcggaacauggagaaguaccagcuggcgguuaccauuauggcuaucagcugcgugccuaaugccgucauucuccugaacgccuggaagguguccuguacaauccucgcugccgugagcgucucuccccugcuucugacguccagccaacagaaagcugauuggauuccucucgcccugaccaucaagggacugaaucccacagcgaucuuucuuaccacacugucucgcaccuccaaaaagagaagcuggccgcucaacgaagccguuauggcugugggcauggugucuauucuggccuccagccuccugaaaaaugacaucccuaugacggggccccuugucgcuggaggccugcugacagugugcuauguucucaccggccgguccgccgaccuggagcuugagcgcgccgcugaugugaagugggaagaccaggcggagauuagcgggucuagcccuauccuguccauuaccaucucugaagauggaagcauguccauuaaaaacgaggaggaagaacagacacucaccauccugaucagaacaggccuccuggucauuucugggguguuccccguuagcaucccgauuacggccgcugccugguaccuuugggaagugaagaagcaacgggccggaguccugugggacgugccuucucccccucccgucggcaaagcugagcuggaagauggggccuaucgcaucaagcagagaggcauucucggcuacagccagaucggcgcggggguguauaaagagggaaccuuucacacaauguggcauguuacccggggcgcugugcugaugcaccgcgggaagagaaucgagcccagcugggccgacgucaaaaaggaucuuauuuccuacggaggcggguggaagcuggaaggagaguggaaagaaggcgaggaagugcagguucucgcccuggagccuggcaagaauccgcgggcugugcaaacaaaacccggacucuucaagaccaacacgggaaccaucggcgccgucagccuggacuuuucuccugggacauccggaagccccauuguggauagaaaaggcaaggugguugggcuuuacggaaauggcgucgugacccgcucuggcgcguauguguccgcuaucgcccagacagaaaagagcauugaagacaacccugagaucgaagaugacaucuuccggaaaaagagacugaccauuauggaucugcaucccggggccggaaaaacaaagcgcuaccucccugcuaucguccgggaggccauuaaaagaggccugcgcacgcuuauccuggcuccgacccgggugguugccgcggaaauggaggaggcccucagagggcugcccauucgcuaucagaccccugcuauccgggccgaacacaccggaagagagauuguggaccucaugugucaugcuaccuucacaaugcggcugcuuucccccguccgcgugccuaacuacaaucugaucaucauggacgaagcccacuuuacggaucccgccucuauugcugcgagaggcuauaucagcacccggguugagaugggggaggccgcuggcauuuucaugacagccaccccgccuggaucccgcgaccccuuuccccagagcaacgccccuaucauggaugaagagagagaaauucccgagcggucuuggaacuccggccacgaaugggugacagacuucaaggggaagaccgucugguuugugccuagcaucaaagcuggaaacgauaucgccgcgugccugagaaagaauggcaaaaagguuauucaacucucucgcaaaacguucgacagcgaguacgugaagacacgggcuaacgauugggacuuugucgugaccaccgauaucuccgagaugggggccaauuucagagccgaacgcgugauugacccgcggagauguaugaagcccgucauccugacagauggagaggaacgcguuauucuugcuggcccuaugcccgugacccauucuagcgccgcgcagcggagagggcgcaucggcagaaacccuaaaaaugagaacgaccaguauaucuacaugggagaaccccuggagaaugacgaggauugcgcccacuggaaggaagcuaaaaugcuccuggacaacauuaauacaccggagggcaucauuccuuccauguuugaacccgagcgggaaaagguggaugccaucgacggggaguaccgccugagaggagaggcucggaaaaccuucgucgaucucaugcgcagaggcgaccuuccuguguggcuggccuaucggguugcugccgaagggauuaacuacgcggauagacgcugguguuuugacggaaucaagaauaaccaaauucuggaggaaaacguggaggucgagaucuggacgaaagaaggcgagcggaagaagcucaaacccagauggcuggaugcccgcaucuauucugacccucuugcucugaaggaguucaaagaguucgccgcugggcggaagucccucacacugaaucugauuaccgaaaugggcagacuccccacauuuaugacccagaaagcccgggaugcccuugacaaccuggcugugcugcauacggcggaggccggaggccgcgcuuacaaucacgcccucuccgagcugccggaaacccuugagacacugcuccugcugacccuccuugccacaguuaccgggggaaucuuccuguuucugaugagcggcaaggggauuggaaagaugacacucggcaugugcugcaucauuaccgcuucuauccugcuuugguaugcccagauccagccucacuggauugcggccuccaucauucuggaguucuuucucaucgugcugcugauucccgagcccgaaaaacaaagaacgccucaggauaaccagcucacauacgucgugaucgcuauccuuaccgucguggccgcuaccauggccaaugagaugggcuuccuggagaagaccaagaaggaccuggggcucggaagcauuaccacacaggaauccgagucuaacauccuggacauugaucuucggccggcgagcgccuggacgcuguaugcuguugccaccacauuugugacccccaugcuccgccauuccaucgaaaauucuagcgugaacgucucccugacagcuauugccaaucaagcuaccguucugaugggccucgggaaaggauggccucuuagcaagauggacaucggcgugccccugcuggccauuggguguuacucucaggugaacccuaucacgcucaccgcggcccugcuucugcucgucgcucacuacgccaucauuggacccggccugcaggcuaaggccacaagagaggcccagaaacgggcggcugccggcaucaugaagaauccuaccguggaugggauuacaguuaucgaccuggaaccgauucccuaugauccuaaauucgagaagcaacucggacaggugaugcuucugauccugugcgucacccaggugcucaugaugcgcacgacaugggcucugugugaggcccuuacccuggccacaggccccaucuccacccucugggaagggaacccuggaagauuuuggaauaccacaauugcugucagcauggccaacaucuuccggggcucuuaccuggcgggggccggacugcucuuuuccauuaugaaaaauacgaccaacacacgcagaggcaccggcaauaucggggagacacuuggagaaaaguggaaaagccggcugaacgcucugggcaaaucugaguuccagauuuauaagaaaagcgggauccaagagguggacagaacccucgccaaggaaggaaucaaacgcggcgagacggaucaucacgcuguuucccgggggucugccaagcugagaugguuuguggaacgcaacauggucacacccgagggaaaagugguugaccuuggcugcggcagagggggauggagcuacuauuguggcgggcugaagaaugugcgggaagucaagggacucaccaaaggcgggccgggacaugaggagccuauucccauguccaccuacggcuggaaccuggugcgccugcagagcggcguggauguuuucuucacacccccugaaaagugcgacacccuccuuugugauaucggggaguccucucccaauccuacaauugaagcgggacggacgcugagaguccugaaccucguggagaauuggcugaacaauaacacccaguuuugcaucaaagugcuuaauccguauaugcccagcgucauugaaaagauggagacacugcaacgcaaauacggcggggcccucguucggaacccucuguccagaaauucuacccacgagauguacugggugagcaacgcuacaggaaauaucguguccucugucaacaugaucagccgcaugcugauuaaucgguucaccaugaagcacaagaaagccacguaugaacccgacguggaucucggcuccgggaccagaaacaucggaauugagagcgaaaucccuaaccuugacauuaucggcaagcgcauugagaaaaucaagcaggaacaugagacaucuuggcacuacgaccaggaucaucccuauaaaaccugggcuuaccacggcuccuaugagacaaagcagaccgggagcgccucuuccaugguuaauggaguggucagacugcugacaaagccgugggacgugguuccuauggugacccaaauggcuaugacggauacaacccccuuuggccagcagcgggucuucaaagaaaagguggacacccgcacacaggagccuaaagaagggacgaagaaacucaugagaaucaccgccgaguggcuguggaaggagcuuggaaagaaaaagacaccccggauguguaccagagaagaguuuacacggaaagugcgcagcaacgcggcccugggcgcuauuuucaccgaugaaaauaaguggaaaucugccagagaggcugucgaagacucccgguuuugggagcucguugaucgcgagagaaaccugcaccuggaagggaagugcgagacauguguguacaauaugaugggaaaacgggaaaagaagcucggcgaguucggcaaagccaaggggagccgcgccaucugguauauguggcugggagcgagauuucuugaguucgaggcucugggcuuucucaacgaggaccauugguucucccgggggaauagccugucuggaguggaaggcgaggggcuucaccgccugggcuacauucucagagaugucagcaaaaaggaaggaggcgccauguacgccgacgauaccgcugggugggacacgcggaucacccuggaggaccugaaaaacgaagagauggugacaaaucauaugcgcggagagcacaagaagcucgccgaagcuauuuuuaaacugaccuaucaaaacaagguugugagaguccagcggccuacaccccgcggcaccgugauggauaucaucuccagacgggaccagagagggucuggacagguuggcacguacgggcuuaauacauucaccaacauggaggcccaacugauucgccagauggaaggcgagggaaucuucaaaagcauuaagcaucucacagugaccgaggaaaucgcgguccagaauuggcuggcccgggugggcagagagcgccuuucccggauggcuauuucuggggaugacugcguugugaaaccgcuggaugacagauuugccagcgcucucacggcccugaacgauaugggaaagguccgcaaggacauccaacagugggaaccuucccggggcuggaaugauuggacccaggugcccuucugcucucaccacuuucaugagcuggucaugaaagacgggagagugcucguugugcccugucgcaaccaggaugaacugaucggacgggcgagaauuagccaaggcgccggguggucccuuaaggagacagcuugccugggcaaaagcuaugcccagauguggacccucauguacuuccaccgccgggaccugagacuugcugccaacgcuaucuguucugccgucccuucccauugggugccgacaagccggaccacauggucuauucacgcgaagcacgaguggaugaccacggaagauaugcuggccguguggaauagaguuuggauccaggagaaccccuggauggaagacaaaacaccuguggaguccugggaagagguccccuaucucggaaagcgcgaggaccaguggugcggcagccugauugggcugaccucccgggcuaccugggccaagaauauccaaacagccauuaaccaggugagaucucucaucggaaaugaagaguacaccgauuauaugccuagcaugaaacgcuuuagacgggaagaggaagaggcuggcguucugugguga

SEQ ID NO: 20029 - RNA, 9876 nt, Artificial Sequence
  derived and/or modified CDS sequence (opt5) from DENV-2__GQ868540__SS-prME
acagcgggagugaucauuaugcugauccccacagcuauggccuuccaccucacgacccggaauggggaaccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaagggggaaucgugaccugcgcgauguuuacaugcaaaaagaauauggaaggcaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggagaaagccuggcuuguucaccgccaaugguuucuggaccucccgcugccuuggcugcccggggcugauacccagggaucuaauuggauucagaaggaaacacucgugaccuucaagaacccucaugccaaaaagcaggacgucgugguucugggcucccaagagggggccaugcacacggcucuuacaggcgcgaccgaaauccagaugagcuccggaaaucugcucuuuacaggccaucugaaaugcagacuucggauggacaagcugcagcucaaagggaugucuuacagcauguguaccggaaaguucaagauugugaaagagaucgccgagacccaacacggcacaaucgucauuagagugcaguaugaaggggauggaucccccugcaagauccccuucgagauuauggaccuggaaaaacgccauguccugggccggcucaucacggugaacccuauuguuaccgagaaggauagcccggugaacaucgaagcugagcccccuuuuggggacucuuacauuaucaucggcgucgagcccggacagcugaaacuuaauugguucaagaagggcuccagcauugggcagauguuugaaacaaccaugagaggagccaaacgcauggccauccugggcgauacagcuugggacuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggccauggugcaggcugauagcggaugugucgugucuuggaagaauaaagagcugaagugcggcuccgggauuuucaucacagacaacguucacaccuggacagaacaguacaaguuucagccugagagccccuccaaacuugccucugcuauucaaaaggcccaugaagagggcaucuguggaaucagaagcgugacgcgccuggagaaucucauguggaaacagauuaccccggaacugaaccacauccuguccgagaaugaagucaaacuuacaauuaugaccggcgauaucaaagggauuaugcaggcgggaaagcggucucucagaccucagcccacagagcugaaauauagcuggaagaccuggggcaaggccaaaaugcuguccacggaaagccauaaccaaaccuuccucguggacgggccugagacagcugagugccccaauaccaaccgcgccuggaacucucuggaaguugaggauuacggauuuggcguguucacaaccaacaucuggcuuaagcugcgggaaaaacaggacgucuuuugugacuccaagcucaugagcgcugccaucaaagauaauagagcggugcacgccgacaugggcuauuggauugagucugcucugaacgauacauggaagauggagaaggccuccuucaucgaaguuaaaagcugccacuggccuaagucucauacccuguggagcaauggggugcuugaguccgaaaugauuauccccaaaaacuucgcuggaccggucagccagcacaacuaccgcccuggcuaucauacgcagacagccgggcccuggcaccucggaaagcuggagauggacuuugauuucugugaaggcaccaccgugguggucacagaggacugcgggaaucggggacccucucugagaaccacgacagccuccggcaaacucauuaccgaguggugcugucggagcugcacacugccuccgcuucgcuacagaggcgaagauggguguugguacggaauggagauccggccccugaaggaaaaggaggaaaaccucguuaauucccuggugaccgcuggccaugggcaaauugacaacuuuucucugggagugcuuggcauggcccucuuccuggaggagaugcugagaacacgcgucgggaccaaacacgccauccuccugguggcuguuagcuuugugacgcuuaucaccggaaauauguccuuccgggaucugggcagagucauggugaugguuggcgccacaaugaccgacgauauugggaugggagugacauaucucgcccugcuggcugccuuuaagguccgcccuaccuucgcggcuggccuucugcucagaaaacugacgucuaaggaacucaugauggccacaaucgggauugcccugcuuagccaguccaccauccccgagacaauucuggaacucaccgacgcucuggcccugggaaugauggugcuuaaaaucguucggaacauggagaaguaccagcuggcggugaccaucauggcuauuucuugcgucccuaaugccgugauccuccugaacgccuggaaggugagcuguacaauucucgcugccgucuccguuagcccccugcuucugacgucuucccaacagaaagcugauuggaucccucucgcccugaccauuaagggccugaaucccacagcgaucuuucuuaccacacugagccgcaccucuaaaaagagauccuggccgcucaacgaagccgugauggcuguggggauggucagcauccuggccucuucccuccugaaaaaugacauuccuaugacgggaccccuuguggcuggcggccugcugacaguuugcuaugugcucaccgggcggagcgccgaccuggagcuugagcgcgccgcugaugucaagugggaagaccaggcggagaucuccggaagcucuccuauucugagcaucaccauuuccgaagauggcucuaugagcaucaaaaacgaggaggaagaacagacacucaccauucugaucagaacagggcuccuggugaucuccggaguuuuccccgugucuauuccgaucacggccgcugccugguaccuuugggaagucaagaagcaacgggccggcgugcugugggacgucccuucucccccucccguggggaaagcugagcuggaagauggagccuaucgcauuaagcagagaggcauccucggcuacucccagauuggggcgggaguuuauaaagagggcaccuuucacacaauguggcaugugaccagaggggcuguccugaugcaccgcggaaagagaaucgagcccuccugggccgacgugaaaaaggaucuuaucagcuacggcgggggauggaagcuggaaggcgaguggaaagaaggcgaggaaguucaggugcucgcccuggagccugggaagaauccgcgggcuguccaaacaaaacccggacucuucaagaccaacacgggcaccauuggggccgugucccuggacuuuagcccuggaacaucuggcucccccaucguggauagaaaagggaagguugucggacuuuacggcaauggcguggugacccgcagcggggcguaugucucugcuauugcccagacagagaaguccaucgaagacaacccugagauugaagaugacaucuuccggaaaaagagacugaccaucauggaucugcaucccggagccggcaaaacaaagcgcuaccucccugcuauugugcgggaggccaucaaaagagggcugcgcacgcuuauucuggcuccgacccggguuguggccgcggaaauggaggaggcccucagaggacugcccauccgcuaucagaccccugcuauucgggccgaacacaccggcagagagaucgucgaccucaugugucaugcuaccuucacaaugcggcugcuuagccccgugcgcguuccuaacuacaaucugauuaucauggacgaagcccacuuuacggaucccgccuccaucgcugcgagaggguauauuucuacccggguggagaugggcgaggccgcuggaaucuucaugacagccaccccgccuggcagccgcgaccccuuuccccaguccaacgccccuauuauggaugaagagagagaaauccccgagcggagcuggaacucugggcacgaaugggucacagacuucaagggaaagaccgugugguuuguuccuuccauuaaagcuggcaacgauaucgccgcgugccugagaaagaaugggaaaaaggugauccaacucagccgcaaaacguucgacucugaguacgucaagacacgggcuaacgauugggacuuuguggugaccaccgauauuagcgagaugggagccaauuucagagccgaacgcgucaucgacccgcggagauguaugaagcccguuauucugacagauggcgaggaacgcgugauccuugcugggccuaugcccgugacccauuccucugccgcgcagcggagaggccgcauuggaagaaacccuaaaaaugagaacgaccaguauaucuacaugggcgaaccccuggagaaugacgaggauugcgcccacuggaaggaagcuaaaaugcuccuggacaacaucaauacaccggaggggauuaucccuagcauguuugaacccgagcgggaaaaggucgaugccauugacggagaguaccgccugagaggcgaggcucggaaaaccuucguggaucucaugcgcagaggggaccuuccuguuuggcuggccuaucggguggcugccgaaggaaucaacuacgcggauagacgcugguguuuugacggcauuaagaauaaccaaauccuggaggaaaacauggaggucgagauuuggacgaaagaaggggagcggaagaagcucaaacccagauggcuggaugcccgcaucuauuccgacccucuugcucugaaggaguucaaagaguucgccgcuggccggaagucucucacacugaaucugaucaccgaaaugggaagacuccccacauuuaugacccagaaagcccgggaugcccuugacaaccuggcugugcugcauacggcggaggccggcgggcgcgcuuacaaucacgcccucagcgagcugccggaaacccuugagacacugcuccugcugacccuccuugccacaguuaccggaggcauuuuccuguuucugauguccgggaagggaaucggcaagaugacacucggcaugugcugcauuaucaccgcuagcauucugcuuugguaugcccagauccagccucacuggaucgcggccucuauuauccuggaguucuuucucauugugcugcugauccccgagcccgaaaaacaaagaacgccucaggauaaccagcucacauacgucgugauugcuauccuuaccgucguggccgcuaccauggccaaugagaugggguuccuggagaagaccaagaaggaccugggacucggcuccaucaccacacaggaaagcgaguccaacauucuggacaucgaucuucggccggcgucugccuggacgcuguaugcuguugccaccacauuugugacccccaugcuccgccauagcauugaaaauuccucugugaacgucagccugacagcuaucgccaaucaagcuaccguucugauggggcucggaaaaggcuggccucuuuccaagauggacauuggggugccccugcuggccaucggauguuacagccaggugaacccuauuacgcucaccgcggcccugcuucugcucgucgcucacuacgccaucaucggccccggccugcaggcuaaggccacaagagaggcccagaaacgggcggcugccgggauuaugaagaauccuaccguggauggaaucacaguuauugaccuggaaccgauccccuaugauccuaaauucgagaagcaacucggccaggugaugcuucugauucugugcgucacccaggugcucaugaugcgcacgacaugggcucugugugaggcccuuacccuggccacagggcccaucucuacccucugggaaggaaacccuggcagauuuuggaauaccacaaucgcugucuccauggccaacauuuuccgggggagcuaccuggcgggagccggccugcucuuuucuaucaugaaaaauacgaccaacacacgcagaggcaccgggaauauuggagagacacuuggcgaaaaguggaagucccggcugaacgcucuggggaaaagcgaguuccagaucuauaagaaaucuggcauucaagagguggacagaacccucgccaaggaaggcaucaaacgcggggagacggaucaucacgcuguuagccggggauccgccaagcugagaugguuuguggaacgcaacauggucacacccgagggcaaagugguugaccuuggcugcgggcggggaggcuggucuuacuauugugggggacugaagaaugugagagaagucaagggccucaccaaagggggaccgggccaugaggagccuauccccaugagcaccuacggcuggaaccuggugcgccugcaguccgggguggauguuuucuucacacccccugaaaagugcgacacccuccuuugugauauuggagagagcucccccaauccuacaaucgaagcgggccggacgcugagaguccugaaccucguggagaauuggcugaacaauaacacccaguuuugcauuaaagugcuuaauccguauaugcccucugucaucgaaaagauggagacacugcaacgcaaauacgggggagcccucguucggaacccucugagcagaaauuccacccacgagauguacugggugucuaacgcuacaggcaauauugugagcuccgucaacaugaucucucgcaugcugaucaaucgguucaccaugaagcacaagaaagccacguaugaacccgacguggaucucgggagcggaaccagaaacauuggcaucgaguccgaaauuccuaaccuugacaucauuggcaagcgcaucgagaaaauuaagcaggaacaugagacaagcuggcacuacgaccaggaucaucccuauaaaaccugggcuuaccacgggucuuaugagacaaagcagaccggauccgccagcucuaugguuaauggcguggucagacugcugacaaagccgugggacgugguuccuauggugacccaaauggcuaugacggauacaacccccuuugggcagcagcgggucuucaaagaaaagguggacacccgcacacaggagccuaaagaaggaacgaagaaacucaugagaaucaccgccgaguggcuguggaaggagcuuggcaagaaaaagacaccccggauguguaccagagaagaguuuacacggaaagugcgcuccaacgcggcccugggggcuaucuucaccgaugaaaauaaguggaaaagcgccagagaggcugucgaagacucucgguuuugggagcucguugaucgcgagagaaaccugcaccuggaaggaaagugcgagacauguguguacaauaugaugggcaaacgggaaaagaagcucggcgaguucgggaaagccaagggaucccgcgccauuugguauauguggcugggcgcgagauuucuugaguucgaggcucugggguuucucaacgaggaccauugguucagccggggaaauucccugagcggcguggaaggggagggccuucaccgccugggauacauccucagagaugucucuaaaaaggaaggcggggccauguacgccgacgauaccgcuggaugggacacgcggauuacccuggaggaccugaaaaacgaagagauggugacaaaucauaugaagggcgagcacaagaaacucgccgaagcuaucuuuaagcugaccuaucaaaacaaaguugugcgcguccagagaccuacaccccgggggaccgugauggauauuaucagccgcagagaccagcggggauccggccagguugggacguacggccuuaauacauucaccaacauggaggcccaacugaucagacagauggaaggagagggcauuuucaagucuauccagcaucucacagugaccgaggaaauugcgguccaaaauuggcuggcccgcguggggcgggagagacuuagccgcauggcuaucuccggagaugacugcguugugaaaccgcuggaugaccgguuugccucugcucucacggcccugaacgauaugggcaaggucagaaaggacauucagcagugggaaccuagccgcggguggaaugauuggacccaggugcccuucugcucccaccacuuucaugagcuggucaugaaagacggacgggugcucguugugcccuguagaaaccaagaugaacugaucggccgcgcgcggaucucucagggggccggcuggagccuuaaggagacagcuugccugggaaaauccuaugcccagauguggacccucauguacuuccacagacgcgaccugcggcuugcugccaacgcuauuuguagcgccgucccuucucauugggugccgacauccagaaccacauggagcauccacgcgaagcacgaguggaugaccacggaagauaugcuggccguguggaaucggguuuggauucaggagaaccccuggauggaagacaaaacaccuguggagucuugggaagagauccccuaucucggcaagagagaggaccaauggugcgggucccugauuggacugaccagccgcgcuaccugggccaagaauauccagacagccauuaaccagguccggucccucaucggcaaugaagaguacaccgauuauaugccuucuaugaaaagauuucgcagagaagaggaagaggcuggggugcugugguga

SEQ ID NO: 20030 - RNA, 9876 nt, Artificial Sequence
  derived and/or modified CDS sequence (opt5) from DENV-2__GQ868541__SS-prME
acagcgggcgugaucauuaugcugauccccacagcuauggccuuccaccucacgacccggaauggggaaccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaagggggaaucgugaccugcgcgauguuuacaugcaaaaagaauauggaaggcaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggagaaagccuggcuuguucaccgccaaugguuucuggaccucccgcugccuuggcugcccggggcugauacccagggaucuaauuggauucagaaggaaacacucgugaccuucaagaacccucaugccaaaaagcaggacgucgugguucugggcucccaagagggggccaugcacacggcucuuacaggcgcgaccgaaauccagaugagcuccggaaaucugcucuuuacaggccaucugaaaugcagacuucggauggacaagcugcagcucaaagggaugucuuacagcauguguaccggaaaguucaagauugugaaagagaucgccgagacccaacacggcacaaucgucauuagagugcaguaugaaggggauggaucccccugcaagauccccuucgagauuauggaccuggaaaaacgccauguccugggccggcucaucacggugaacccuauuguuaccgagaaggauagcccggugaacaucgaagcugagcccccuuuuggggacucuuacauuaucaucggcgucgagcccggacagcugaaacuuaauugguucaagaagggcuccagcauugggcagauguuugaaacaaccaugagaggagccaaacgcauggccauccugggcgauacagcuugggacuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggccauggugcaggcugauagcggaugugucgugucuuggaagaauaaagagcugaagugcggcuccgggauuuucaucacagacaacguucacaccuggacagaacaguacaaguuucagccugagagccccuccaaacuugccucugcuauucaaaaggcccaugaagagggcaucuguggaaucagaagcgugacgcgccuggagaaucucauguggaaacagauuaccccggaacugaaccacauccuguccgagaaugaagucaaacuuacaauuaugaccggcgauaucaaagggauuaugcaggcgggaaagcggucucucagaccucagcccacagagcugaaauauagcuggaagaccuggggcaaggccaaaaugcuguccacggaaagccauaaccaaaccuuccucaucgacgggccugagacagcugagugccccaauaccaaccgcgccuggaacucucuggaaguggaggauuacggauuuggcguuuucacaaccaacaucuggcuuaagcugcgggaaaaacaggacguguuuugugacuccaagcucaugagcgcugccauuaaagauaauagagcgguccacgccgacaugggcuauuggaucgagucugcucugaacgauacauggaagauggagaaggccuccuucauugaagugaaaagcugccacuggccuaagucucauacccuguggagcaaugggguucuugaguccgaaaugaucauucccaaaaacuucgcuggaccggugagccagcacaacuaccgcccuggcuaucauacgcagacagccgggcccuggcaccucggaaagcuggagauggacuuugauuucugugaaggcaccaccgucguggugacagaggacugcgggaaucggggacccucucugagaaccacgacagccuccggcaaacucaucaccgaguggugcugucggagcugcacacugccuccgcuucgcuacagaggcgaagauggguguugguacggaauggagauucggccccugaaggaaaaggaggaaaaccucgucaauucccugguuaccgcuggccaugggcaaaucgacaacuuuucucugggagugcuuggcauggcccucuuccuggaggagaugcugagaacacgcguggggaccaaacacgccauccuccuggucgcugugagcuuuguuacgcuuauuaccggaaauauguccuuccgggaucugggcagagugauggucauggugggcgccacaaugaccgacgauaucgggaugggaguuacauaucucgcccugcuggcugccuuuaaggugcgcccuaccuucgcggcuggccuucugcucagaaaacugacgucuaaggaacucaugauggccacaauugggaucgcccugcuuagccaguccaccauucccgagacaauccuggaacucaccgacgcucuggcccugggaaugaugguccuuaaaaucgugcggaacauggagaaguaccagcuggcgguuaccauuauggcuaucucuugcgugccuaaugccgucauucuccugaacgccuggaaggugagcuguacaauccucgcugccguguccgucagcccccugcuucugacgucuucccaacagaaagcugauuggauuccucucgcccugaccaucaagggccugaaucccacagcgaucuuucuuaccacacugagccgcaccucuaaaaagagauccuggccgcucaacgaagccguuauggcuguggggauggugagcauucuggccucuucccuccugaaaaaugacaucccuaugacgggaccccuugucgcuggcggccugcugacagugugcuauguucucaccgggcggagcgccgaccuggagcuugagcgcgccgcugaugugaagugggaagaccacgcggagauuuccggaagcucuccuauccugagcauuaccaucuccgaagauggcucuaugagcauuaaaaacgaggaggaagaacagacacucaccauccugaucagaacagggcuccuggucauuuccggaguguuccccguuucuaucccgauuacggccgcugccugguaccuuugggaagugaagaagcagcgggccggcguccugugggacgugccuucucccccucccgucgggaaagcugagcuggaagauggagccuaucgcaucaagcaaagaggcauucucggcuacucccagaucggggcgggaguguauaaagagggcaccuuucauacaauguggcacguuaccagaggggcugugcugaugcaucgcggaaagagaaucgagcccuccugggccgacgucaaaaaggaucuuauuagcuacggcgggggauggaagcuggaaggcgaguggaaagaaggcgaggaagugcagguucucgcccuggagccugggaagaauccgcgggcugugcagacaaaacccggacucuucaagaccaacacgggcaccaucggggccgucucccuggacuuuagcccuggaacaucuggcucccccauuguggauagaaaagggaaggugguuggacuuuacggcaauggcgucgugacccgcagcggggcguaugugucugcuaucgcccaaacagagaaguccauugaagacaacccugagaucgaagaugacaucuuccggaaaaagagacugaccauuauggaucugcaccccggagccggcaaaacaaagcgcuaccucccugcuaucguccgggaggccauuaaaagagggcugcgcacgcuuauccuggcuccgacccgggugguugccgcggaaauggaggaggcccucagaggacugcccauucgcuaucagaccccugcuauccgggccgaacauaccggcagagagauuguggaccucaugugucacgcuaccuucacaaugcggcugcuuagccccguccgcgugccuaacuacaaucugaucaucauggacgaagcccacuuuacggaucccgccuccauugcugcgagaggguauaucucuacccggguugagaugggcgaggccgcuggaauuuucaugacagccaccccgccuggcagccgcgaccccuuuccccaguccaacgccccuaucauggaugaagagagagaaauucccgagcggagcuggaacucugggcaugaaugggugacagacuucaagggaaagaccgucugguuugugccuuccaucaaagcuggcaacgauaucgccgcgugccugagaaagaaugggaaaaagguuauucagcucagccgcaaaacguucgacucugaguacgugaagacacgggcuaacgauugggacuuugucgugaccaccgauaucagcgagaugggagccaauuucagagccgaacgcgugauugacccgcggagauguaugaagcccgucauccugacagauggcgaggaacgcguuauucuugcugggccuaugcccgugacccacuccucugccgcgcaacggagaggccgcaucggaagaaacccuaaaaaugagaacgaccaguauaucuacaugggcgaaccccuggagaaugacgaggauugcgcccauuggaaggaagcuaaaaugcuccuggacaacauuaauacaccggaggggaucauuccuagcauguuugaacccgagcgggaaaagguggaugccaucgacggagaguaccgccugagaggcgaggcucggaaaaccuucgucgaucucaugcgcagaggggaccuuccuguguggcuggccuaucggguugcugccgaaggaauuaacuacgcggauagacgcugguguuuugacggcaucaagaauaaccagauucuggaggaaaacguggaggucgagaucuggacgaaagaaggggagcggaagaagcucaaacccagauggcuggaugcccgcaucuauuccgacccucuugcucugaaggaguucaaagaguucgccgcuggccggaagucucucacacugaaucugauuaccgaaaugggaagacuccccacauuuaugacccaaaaagcccgggaugcccuugacaaccuggcugugcugcacacggcggaggccggcgggcgcgcuuacaaucacgcccucagcgagcugccggaaacccuugagacacugcuccugcugacccuccuugccacaguuaccggaggcaucuuccuguuucugauguccgggaagggaauuggcaagaugacacucggcaugugcugcaucauuaccgcuagcauccugcuuugguaugcccagauccagccucauuggauugcggccucuaucauucuggaguucuuucucaucgugcugcugauucccgagcccgaaaaacagagaacgccucaagauaaccagcucacauacgucgugaucgcuauccuuaccgucguggccgcuaccauggccaaugagaugggguuccuggagaagaccaagaaggaccugggacucggcuccauuaccacacaggaaagcgaguccaacauccuggacauugaucuucggccggcgucugccuggacgcuguaugcuguugccaccacauuugugacccccaugcuccgccacagcaucgaaaauuccucugugaacgucagccugacagcuauugccaaucaggcuaccguucugauggggcucggaaaaggcuggccucuuuccaagauggacaucggggugccccugcuggccauuggauguuacagccaagugaacccuaucacgcucaccgcggcccugcuucugcucgucgcucauuacgccaucauuggccccggccugcaggcuaaggccacaagagaggcccagaaacgggcggcugccgggaucaugaagaauccuaccguggauggaauuacaguuaucgaccuggaaccgauucccuaugauccuaaauucgagaagcagcucggccaagugaugcuucugauccugugcgucacccaggugcucaugaugcgcacgacaugggcucugugugaggcccuuacccuggccacagggcccaucucuacccucugggaaggaaacccuggcagauuuuggaauaccacaauugcugucuccauggccaacaucuuccgggggagcuaccuggcgggagccggccugcucuuuucuauuaugaaaaauacgaccaacacacgcagaggcaccgggaauaucggagagacacuuggcgaaaaguggaagucccggcugaacgcucuggggaaaagcgaguuccagauuuauaagaaaucuggaauccaggagguggacagaacccucgccaaggaaggcaucaaacgcggggagacggaucaccaugcuguuagccggggauccgccaagcugagaugguuuguggaacgcaacauggucacacccgagggcaaagugguugaccuuggcugcgggcggggaggcuggucuuacuauugugggggacugaagaaugugagagaagucaagggccucaccaaagggggaccgggccacgaggagccuauucccaugagcaccuacggcuggaaccuggugcgccugcaauccgggguggauguuuucuucacacccccugaaaagugcgacacccuccuuugugauaucggagagagcucccccaauccuacaauugaagcgggccggacgcugagaguccugaaccucguggagaauuggcugaacaauaacacccaguuuugcaucaaagugcuuaauccguauaugcccucugucauugaaaagauggagacacugcagcgcaaauacgggggagcccucguucggaacccucugagcagaaauuccacccacgagauguacugggugucuaacgcuacaggcaauaucgugagcuccgucaacaugaucucucgcaugcugauuaaucgguucaccaugaagcauaagaaagccacguaugaacccgacguggaucucgggagcggaaccagaaacaucggcauugaguccgaaaucccuaaccuugacauuaucggcaagcgcauugagaaaaucaagcaagaacacgagacaagcuggcaucacgaccaggaucaccccuacaaaaccugggcuuaucaugggucuuacgagacaaagcagaccggauccgccagcucuaugguuaauggcguggucagacugcugacaaagccgugggacgugguuccuauggugacccagauggcuaugacggauacaacccccuuugggcaacagcgggucuucaaagaaaagguggacacccgcacacaggagccuaaagaaggaacgaagaaacucaugagaaucaccgccgaguggcuguggaaggagcuuggcaagaaaaagacaccccggauguguaccagagaagaguuuacacggaaagugcgcuccaacgcggcccugggggcuauuuucaccgaugaaaauaaguggaaaagcgccagagaggcugucgaagacucucgguuuugggagcucguugaucgcgagagaaaccugcaccuggaaggaaagugcgagacauguguguauaauaugaugggcaaacgggaaaagaagcucggcgaguucgggaaagccaagggaucccgcgccaucugguacauguggcugggcgcgagauuucuugaguucgaggcucugggguuucucaacgaggaccauugguucagccggggaaauucccugagcggcguggaaggggagggccuucaccgccugggauauauucucagagaugucucuaaaaaggaaggcggggccauguacgccgacgauaccgcuggaugggacacgcggaucacccuggaggaccugaaaaacgaagagauggugacaaaucauaugaagggcgagcacaagaaacucgccgaagcuauuuuuaagcugaccuaccagaacaaaguugugcgcguccaaagaccuacaccccgggggaccgugauggauaucaucagccgcagagaccagcggggauccggccagguugggacguauggccuuaauacauucaccaacauggaggcccagcugauuagacaaauggaaggagagggcaucuucaagucuauucagcaccucacagugaccgaggaaaucgcgguccagaauuggcuggcccgcguggggcgggagagacuuagccgcauggcuauuuccggagaugacugcguugugaaaccgcuggaugaccgguuugccucugcucucacggcccugaacgauaugggcaaggucagaaaggacauccaacagugggaaccuagccgcggguggaaugauuggacccaggugcccuucugcucccaucacuuucaugagcuggucaugaaagacggacgggugcucguugugcccuguagaaaccaggaugaacugaucggccgcgcgcggauuucucaaggggccggcuggagccuuaaggagacagcuugccugggaaaauccuacgcccagauguggacccucauguauuuccacagacgcgaccugcggcuugcugccaacgcuaucuguagcgccgucccuucucacugggugccgacauccagaaccacauggagcauucaugcgaagcacgaguggaugaccacggaagauaugcuggccguguggaaucggguuuggauccaggagaaccccuggauggaagacaaaacaccuguggagucuugggaagagguccccuaccucggcaagagagaggaccaguggugcgggucccugauuggacugaccagccgcgcuaccugggccaagaauauccaaacagccauuaaccaggugcggucccucaucggcaaugaagaguauaccgauuacaugccuucuaugaaaagauuucgcagagaagaggaagaggcugggguucugugguga

SEQ ID NO: 20031 - RNA, 9876 nt, Artificial Sequence
  derived and/or modified CDS sequence (opt5) from DENV-2__GQ868603__SS-prME
accgccggagugaucauuaugcugauccccacagcuauggccuuccaccuuacgaccagaaauggggagccucauaugauugucggacggcaggaaaagggcaagagccugcuuuuuaagaccgaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuucugugcaagcauuccaugguggauagaggcuggggcaacggguguggacucuucggcaaaggcgggauugugacaugcgccauguuuacgugcaaaaagaauauggaagggaaagucguucugccugagaaccuugaauacaccaucgugauuacaccccacagcggggaggagcaugcggugggaaaugacaccggcaagcacggcaaagaaaucaagaucacaccucagucuuccauuaccgaggccgaacugacgggguauggaaccgucacaauggaguguagcccccggaccggccucgauuucaacgaaauggugcugcuucagauggaggacaaggcuuggcugguucaccgccaaugguuucucgaucugccgcugccuuggcuccccggggccgacacacagggaucuaauuggauccagaaggagacccuggugacguucaagaacccucaugcuaaaaagcaggacgucgugguucuuggcucccaagaaggggccaugcacacagcccugaccggcgcuacagagauucagaugagcuccggaaaucuccuguuuaccggccaucuuaaaugcagacugcggauggauaagcuccagcugaaagggaugucuuacagcauguguaccggaaaguucaagaucgugaaagaaauugcggagacacaacacggcacgaucgucaucagagugcaguaugagggggacggaucccccugcaagauucccuucgaaaucauggaucuggagaaacgccauguccucggccggcugauuaccgugaacccuaucguuacagaaaaggacagcccggugaacauugaggccgaacccccuuuuggggauucuuacaucauuaucggcgucgagcccggacagcuuaaacugaauugguucaagaagggcuccagcaucgggcagauguuugagaccacaaugagaggagcuaaacgcauggccauucucggcgacaccgccugggauuucgggucucugggaggcguguuuacgagcaucgggaaggcucugcaccaaguuuucggcgccauuuacggagcggcuuuuuccggcgugucuuggacaaugaaaauccuuauuggggucaucaucaccuggauuggaaugaacagccgguccaccagccucucugugucccuggugcugguuggcgucgugacacucuaucugggggccauggugcaggccgacagcggaugugucgugucuuggaagaauaaagaacuuaagugcggcuccgggaucuucauuaccgauaacguucacacauggacggagcaguacaaguuucagccugaaagccccuccaaacuggcuucugccauccaaaaggcucaugaggaaggcauuuguggaaucagaagcgugacccgccucgagaaucugauguggaaacagaucacaccggagcugaaccacauucuuuccgaaaaugaggucaagcucaccaucaugacaggcgacauuaaagggaucaugcaggccggaaagcggucucugagaccucagcccaccgaacugaaauauagcuggaagacguggggcaaggcgaaaaugcucuccaccgagagccauaaccaaacauuccugauugaugggccugaaaccgccgagugccccaauacaaaccgcgcuuggaacucucuugagguggaagacuacggauuuggcguuuucaccacaaacaucuggcugaagcuccgggagaaacaggacgugcugugugauuccaagcugaugagcgccgcuaucaaagacaauagagccguccacgcggauaugggcuauuggauugaaucugcccuuaacgacaccuggaagauggagaaggcuuccuuuaucgaggugaaaagcugccacuggccuaagucucauacgcucuggagcaaugggguucuggaauccgagaugauuauccccaaaaacuucgccggaccggugagccagcacaacuaccgcccuggcuaucauacacagaccgcugggcccuggcaccugggaaagcucgaaauggauuucgacuuuugugagggcaccacagucguggugaccgaagauugcgggaaucggggacccucucugagaacgacaaccgccuccggcaaacuuauuacagaguggugcugucggagcugcacccugccuccgcuccgcuacagaggcgaggacggguguugguacggaauggaaauccggccccugaaggagaaggaagagaaccuggucaauucccuuguuacagccggccaugggcaaauugauaacuucucucucggagugcugggcauggcucuguuucucgaagagaugcugagaacccgcguggggacgaaacacgcgauccuucuggccgcugucagcuucgugacccucaucacaggaaauauguccuuucgggaccugggcagaguuauggugauggucggcgccaccaugacagaugacauugggaugggagugaccuaucuggcccuucuggcugccuucaagguucgcccuacguuugcggcuggccuccugcucagaaaacugacaucuaaggagcuuaugauggccaccaucgggauugcccugcucagccaguccacaauccccgaaaccauucuggagcugaccgaugcucuugcccugggaaugauggugcucaaaaucguccggaacauggaaaaguaccagcuggugguuacaaucauggcgauuucuugcgugccuaaugcugucauccuccaaaacgccuggaaggugagcuguacgauucuggccgcuguguccgucagcccccuucugcucaccucuucccgccagaaagccgacuggaucccucuggcucugacaauuaagggccuuaaucccaccgccaucuuccugacaacccucagcagaacgucuaaaaagcgguccuggccgcugaacgaggcgaucauggccguugggauggugagcauucucgcuucuucccugcuuaaaaaugacaucccuaugacaggaccccugguggccggcggccugcucaccgucugcuaugugcugaccgggcgcagcgcugaucuugaacuggagagagccgccgacguuaagugggaggaucaggcugaaauuuccggaagcucuccuauccucagcauuacaaucuccgaggacggcucuaugagcauuaaaaacgaagaggaggaacagacccugacaauccucauccggacggggcugcuugugauuuccggagucuuucccgugucuaucccgauuaccgcggccgcuugguaccugugggagguuaagaagcaacgcgccggcgugcugugggaugucccuucucccccucccguggggaaagccgaacucgaggacggagcuuauagaaucaagcagcggggcauucugggcuacucccagaucggggccggagucuauaaagaaggcacauuccacaccauguggcaugugacacgcggggcgguucuuaugcacagaggaaagcggaucgagcccuccugggcugaugugaaaaaggaccugauuagcuacggcgggggauggaagcucgagggcgaauggaaagagggcgaagagguccaggugcuggcccucgaaccugggaagaauccgagagccguucaaaccaaacccggacuguuuaagacgaacaccggcacaaucggggcugugucccuugauuucagcccuggaaccucuggcucccccauugucgaccgcaaagggaagguggugggacuguacggcaauggcguugucacacggagcggggccuaugugucugcgaucgcucagaccgagaaguccauugaggauaacccugaaaucgaggacgauaucuuucgcaagaagcgccugacaauuauggaccuccaucccggagccggcaaaacgaagcgguaccugccugccaucgugagagaagcuauuaaacgcgggcuucggacccugauccucgccccgacaagagucguggcugccgagauggaagaggcgcugcgcggacuccccauucgguaucagaccccugccaucagagcugagcacaccggccgggaaauuguugaccugaugugucaugccacauucacgaugcgccuucugagccccgugagagucccuaacuacaaucugaucaucauggaugaggcucacuucaccgaccccgccuccauugccgcucggggguauaucucuacacgcguggaaaugggcgaggcggccggaauuuuuaugaccgcuacaccgccuggcagcagagaucccuucccccaguccaacgccccuaucauggacgaggaacgggagauucccgaaagaagcuggaacucugggcacgaguggguuaccgauuuuaagggaaagacggugugguucgucccuuccaucaaagccggcaacgacaucgcugccugccuccgcaagaaugggaaaaaggugauucaacugagccggaaaacauuugauucugaauacguuaagaccagagcgaacgacugggauuucguggucaccacagacaucagcgagaugggagcuaauuuuaaggccgagcgcgugauugauccgcggagauguaugaaacccgugauccuuaccgacggcgaagaaagagucauucuggccgggccuaugcccguuacacauuccucugcugcccagcggagaggccgcaucggaagaaacccuaagaaugaaaacgaccaguauaucuacaugggcgagccccucgaaaaugaugaggacugcgcgcacuggaaagaggccaagaugcugcuggauaacauuaauaccccggaagggaucauuccuagcauguucgagcccgaacgggagaaaguggacgcuaucgauggagaauaccgccucagaggcgaggcccggaagacguuuguggaccuuaugcgcagaggggaucugccugucuggcuggcuuaucggguggccgcugagggaauuaacuacgccgacagacgcugguguuucgauggcaucaaaaauaaccaaauucucgaagagaacguugaaguggagaucuggacaaaggagggggaacggaagaaacugaagcccagauggcuugacgcgcgcaucuauuccgauccucuggcccucaaagaguuuaaggaguucgcugccggccggaaaucucugacccugaaucucauuacagagaugggaagacuucccaccuucaugacgcagaaggcucgggacgcccuggauaaccuggccguccuccauaccgcugaagcgggcgggcgcgccuacaaucacgcucugagcgagcuuccggagacacuggaaacccuccugcugcucacacuucuggccaccgugacaggaggcaucuuucuguuccucauguccgggaagggaguuggcaaaaugacccugggcaugugcugcauuaucacggccagcauucuucugugguaugcucagauccagccucacuggaucgccgcgucuauuauccucgaguuuuuccugauugugcugcucauccccgaacccgagaagcaaagaacaccucaggacaaccagcuuaccuacgucgugauugccauccugaccgucguggcugccacaauggcuaaugaaaugggguuucuggagaaaaccaagaaagaccucggacugggcuccaucacaacgcaggagagcgaauccaacauucuugauaucgaccugcggccggccucugcguggacccucuaugccguugcuacaaccuucuuuacacccaugcugcgccauagcauugaaaauagcucugugaacgugagccugaccgccaucgcuaaucaagccacgguccucauggggcuuggaaagggcuggccucuguccaagauggauauugggguuccccugcucgcuaucggauguuacagccaggugaacccuauuacccugacagccgcgcuucugcuccugguggcccacuacgcuaucaucggccccggccugcaggccaaagcuaccagagaagcccagaagcgggccgcggcugggauuaugaaaaauccuacagucgacggaaucaccgugauugaucucgagccgauccccuaugacccuaaguucgaaaaacaacuuggccagguuaugcugcugauucucugcgugacgcagguccugaugaugcgcacaaccugggcccuuugugaggcucugacacucgccaccgggcccaucucuacccugugggagggaaacccuggcagauuuuggaauacaacgaucgccguguccauggcuaacauuuuccgggggagcuaccuggccggagcgggccuccucuuuucuaucaugaagaauaccacaaacacccgcagaggcacagggaauauuggagaaacccugggcgagaaguggaaaucccggcugaacgcccucggaaagagcgaguuccagaucuauaaaaagucuggcauucaagaggucgauagaacgcuggcuaaagagggcaucaagcgcggggaaacagaccaucacgccgugagccggggauccgcuaaacuuagaugguuuguugagcgcaacauggugacccccgaaggcaaggucguggaucugggcugcgggcggggaggcuggucuuacuauugugggggacucaagaauguuagagaggugaaaggccugaccaaagggggaccgggccaugaggaaccuauccccaugagcacauacggcuggaaccugguccgccuccaguccgggguggacguguucuucacacccccugagaaaugcgauacacuucugugugacauuggagaaagcucccccaauccuacgaucgaggccggccggacccugagaguucucaaccuggucgaaaauuggcuuaacaauaacacacaguuuugcauuaaggugcugaauccguauaugcccucugugaucgagaaaauggaaacccuccaacgcaaguacgggggagcgcugguccggaacccucugagcagaaauuccacacacgagauguacuggguuucuaacgccaccggcaauauugugagcuccgugaacaugaucucucgcaugcucaucaaucgguucacgaugaagcacaaaaaggcuaccuaugagcccgaugucgaccuugggagcggaacaagaaacauuggcaucgaauccgagauuccuaaccuggacaucauuggcaaacgcaucgaaaagauuaaacaggagcaugaaaccagcuggcacuacgaucaggaccaucccuauaagacaugggccuaccacgggucuuaugagaccaagcagacaggauccgcuagcucuauggugaauggcguugugagacugcucaccaaaccgugggaugucgugccuaugguuacgcaaauggccaugacagacaccacccccuuugggcagcagcggguguucaaggagaaagucgauacacgcacgcaggaaccuaaggagggaaccaaaaagcugaugaagaucacagcugaauggcuuuggaaagagcugggcaagaaaaagauccccagaauguguacccgggaggaauuuacaagaaaagugcgguccaacgccgcgcucggggccauuuucaccgacgagaauaaguggaaaagcgcucgcgaagccguggaggauucuagauuuugggaacuggucgaccgggagcgcaaccugcaccucgagggaaagugcgaaacauguguuuacaauaugaugggcaagagagagaaaaagcugggcgaguucgggaaagcuaagggaucccgggccaucugguauauguggcuuggcgcccgcuuucuggaguucgaagcgcucggguuucugaacgaggaucauugguucagcagaggaaauucccuuagcggcguggagggggaaggccugcaccggcucggauacauucugcgcgacgugucuaaaaaggagggcggggcuauguacgccgaugacaccgccggaugggacacgagaaucacccuggaagaucucaagaacgaggaaauggucacaaaucauaugaaaggcgagcacaagaaacuggcugaggccauuuuuaaacuuaccuaucaaaacaaagugguucgggugcagcgcccuacacccagagggaccgucauggacaucaucagccggcgcgaucagagaggauccggccagguggggacguacggccugaauacauucaccaacauggaagcucaacucauucggcagauggagggagaaggcaucuucaagucuauucagcaucugacaguuaccgaggagaucgccgugcaaaauuggcuugcgagagucgggcgcgaacggcugagcagaauggccauuuccggagacgauugcgugguuaagccgcucgacgaucgcuuugcuucugcccugacggcucugaacgacaugggcaaagugcggaaggauauccagcagugggagccuagcagaggguggaaugacuggacccagguccccuucugcucccaccacuuucaugaacucgugaugaaagauggacgcguccuggugguucccugucggaaccaagacgagcuuaucggcagagcccgcauuucucagggggcgggcuggagccugaaggaaacagccugccucggaaaauccuaugcucagauguggacccugauguacuuccaccggagagaucuucgccuggccgcuaacgccaucuguagcgcugugccuucucauugggucccgacaucccggaccacauggagcauucacgccaagcacgaguggaugaccacggaggacaugcucgcgguguggaauagaguguggauccaggaaaaccccuggauggaggacaagacaccuguugaaucuugggaggaagugcccuaucugggcaaacgggaggaucaauggugcgggucccugauuggacucaccagcagagccaccugggcuaagaauauccagacagccauuaaccagguccgcucccugaucggcaaugaggaauacaccgacuauaugccuucuaugaaacgguuuagacgcgaggaagaggaagccggggugcuuugguga

SEQ ID NO: 20032 - RNA, 9876 nt, Artificial Sequence
  derived and/or modified CDS sequence (opt5) from DENV-2__FJ898450__SS-prME
accgcgggcgugaucauuaugcugauccccaccgcuauggccuuccaccucacgacccggaauggggaaccucauaugauugucggacggcaggaaaagggcaagagccugcuuuuuaagaccgaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucucccugagaaccuggaauacaccauugugaucacaccccacagcggggaggagcaugcggugggaaaugacaccggcaagcacggcaaagaaaucaagauuacaccucagucuuccaucaccgaggccgaacuuacgggguauggaaccgucacaauggaguguagcccccggaccggccuggauuucaacgaaauggugcuccugcagauggaggacaaggcuuggcuuguucaccgccaaugguuucuggaucucccgcugccuuggcugcccggggccgacacacagggaucuaauuggauucagaaggagacccucgugacguucaagaacccucaugcuaaaaagcaggacgucgugguucugggcucccaagaaggggccaugcacacagcccuuaccggcgcuacagagauccagaugagcuccggaaaucugcucuuuaccggccaucugaaaugcagacuucggauggauaagcugcagcucaaagggaugucuuacagcauguguaccggaaaguucaagauugugaaagaaaucgcggagacacaacacggcacgaucgucauuagagugcaguaugagggggacggaucccccugcaagauccccuucgaaauuauggaucuggagaaacgccauguccugggccggcucaucaccgugaacccuauuguuacagaaaaggacagcccggugaacaucgaggccgaacccccuuuuggggauucuuacauuaucaucggcgucgagcccggacagcugaaacuuaauugguucaagaagggcuccagcauugggcagauguuugagaccacaaugagaggagcuaaacgcauggccauccugggcgacaccgccugggauuucgggucucucggaggcguguuuacgagcauugggaaggcucugcaccaaguuuucggcgccaucuacggagcggcuuuuuccggcgugucuuggacaaugaaaauucugaucggggucaucauuaccuggaucggaaugaacagccgguccaccagccuuucugugucccucgugcugguuggcgucgugacacuguaucucggggccauggugcaggccgacagcggaugugucgugucuuggaagaauaaagaacugaagugcggcuccgggauuuucaucaccgauaacguucacacauggacggagcaguacaaguuucagccugaaagccccuccaaacuugcuucugccauucaaaaggcucaugaggaaggcaucuguggaaucagaagcgugacccgccuggagaaucucauguggaaacagauuacaccggagcugaaccacauccuguccgaaaaugaggucaaacuuaccauuaugacaggcgacaucaaagggauuaugcaggccggaaagcggucucucagaccucagcccaccgaacugaaauauagcuggaagacguggggcaaggcgaaaaugcuguccaccgagagccauaaccaaacauuccucaucgaugggccugaaaccgccgagugccccaauacaaaccgcgcuuggaacucucuggagguggaagacuacggauuuggcguuuucaccacaaacaucuggcuuaagcugcgggagaaacaggacgccuuuugugauuccaagcucaugagcgcugccauuaaagacaauagagcggugcacgccgauaugggcuauuggaucgaaucugcucugaacgacaccuggaagauggagaaggccuccuucauugaggucaaaagcugccacuggccuaagucucauacgcuguggagcaauggggugcuugaauccgagaugaucauucccaaaaacuucgcuggaccgguuagccagcacaacuaccgcccuggcuaucauacacagaccgccgggcccuggcaccucggaaagcuggaaauggauuuugacuucugugagggcaccacaguggucgugaccgaagauugcgggaaucggggacccucucugagaacgacaaccgccuccggcaaacucaucacagaguggugcugucggagcugcacccugccuccgcuucgcuacagaggcgaggacggguguugguacggaauggaaauucggccccugaaggagaaggaagagaaccucgugaauagccuggucacagcuggccaugggcaaaucgauaacuuuucucugggaguucuuggcauggcccucuuccuggaagagaugcugagaacccgcguggggacgaaacacgccauccuccugguggcugucagcuuugugacccuuauuacaggaaauauguccuuccgggaccugggcagaguuauggugauggucggcgccaccaugacagaugacaucgggaugggagugaccuaucucgcccugcuggcugccuuuaagguucgcccuacguucgcggcuggccuucugcucagaaaacugacaucuaaggagcucaugauggccaccauugggaucgcccugcuuagccaguccacaauucccgaaaccauccuggagcucaccgaugcucuggcccugggaaugauggugcuuaaaaucguccggaacauggaaaaguaccagcuggcggugacaauuauggcuaucucuugcguuccuaaugccgugauucuccaaaacgccuggaaggucagcuguacgauccuggcugccguguccgugagcccccuccugcuuaccucuucccagcagaaagcugacuggauuccucuggcccucacaaucaagggccugaaucccaccgcgaucuuucugacaacccuuagccgcacgucuaaaaagagauccuggccgcugaacgaggccgucauggcuguugggauggugagcauucucgccucuucccugcucaaaaaugacaucccuaugacaggaccccugguggcuggcggccuucugaccgucugcuaugugcugaccgggcggagcgccgaucucgaacuggagcgcgccgcugacguuaagugggaggaucaggcggaaauuuccggaagcucuccuauccuuagcauuacaaucuccgaggacggcucuaugagcauuaaaaacgaagaggaggaacaaacccugacaauccucaucagaacggggcugcucgugauuuccggagucuuccccgugucuaucccgauuaccgccgcugccugguaccugugggagguuaagaagcagcgggccggcgugcuuugggaugucccuucucccccucccguggggaaagcugaacuggaggacggagccuaucgcaucaagcagagaggcauucugggcuacucccagaucggggcgggagucuauaaagaaggcacauuucacaccauguggcaugugacaagaggggcuguucucaugcaccgcggaaagagaaucgagcccuccugggccgaugugaaaaaggaccugauuagcuacggcgggggauggaaacuugagggcgaauggaaagagggcgaagagguccaagugcuggcccucgaaccugggaagaauccgcgggcuguucagaccaaacccggacuguucaagacgaacaccggcacaaucggggccgugucccucgauuuuagcccuggaaccucuggcucccccauugucgacagaaaagggaagguggugggacuguacggcaauggcguugucacacgcagcggggcguaugugucugcuaucgcccagaccgagaaguccauugaggauaacccugaaaucgaggacgauaucuuccggaaaaagagacuuacaauuauggaccugcaucccggagccggcaaaacgaagcgcuaccugccugcuaucgugcgggaagccauuaaaagagggcuccgcacccugauccuugcuccgacacgggucguggccgcggagauggaagaggcccugagaggacuccccauucgcuaucagaccccugcuauccgggccgagcacaccggcagagaaauuguugaccugaugugucaugcuacauucacgaugcggcuccugagccccgugcgcgucccuaacuacaaucuuaucaucauggaugaggcccacuuuaccgaccccgccuccauugcugcgagaggguauaucucuacacggguggaaaugggcgaggccgcuggaauuuucaugaccgccacaccgccuggcagccgcgaucccuuuccccaauccaacgccccuaucauggacgaggaaagagagauucccgaacggagcuggaacucugggcacgaguggguuaccgauuucaagggaaagacggugugguuugucccuuccaucaaagcuggcaacgacaucgccgcgugccugagaaagaaugggaaaaaggugauucagcugagccgcaaaacauucgauucugaauacguuaagacccgggcuaacgacugggauuuuguggucaccacagacaucagcgagaugggagccaauuucagagccgagcgcgugauugauccgcggagauguaugaagcccgugauccucaccgacggcgaagaacgcgucauucuggcugggccuaugcccguuacacauuccucugccgcgcagcggagaggccgcaucggaagaaacccuaaaaaugaaaacgaccaauauaucuacaugggcgagccccuugaaaaugaugaggacugcgcccacuggaaggaggcuaaaaugcugcucgauaacauuaauaccccggaagggaucauuccuagcauguuugagcccgaacgggagaagguggacgccaucgauggagaauaccgccugagaggcgaggcucggaaaacguucguggaccugaugcgcagaggggaucucccugucuggcuugccuaucggguggcugccgagggaauuaacuacgcggacagacgcugguguuuugauggcaucaagaauaaccagauucuggaagagaacguugaaguggagaucuggacaaaagagggggaacggaagaagcugaaacccagauggcucgacgcccgcaucuauuccgauccucuggcucuuaaggaguucaaagaguucgccgcuggccggaagucucugacccucaaucugauuacagagaugggaagacugcccaccuuuaugacgcagaaagcccgggacgcccucgauaaccuugcuguccugcauaccgcggaagccggcgggcgcgcuuacaaucacgcccugagcgagcucccggagacacuggaaacccuucugcuccugacacugcucgccaccgugacaggaggcaucuuccuuuuucugauguccgggaagggaauuggcaagaugacccugggcaugugcugcaucauuacggcuagcauccuccugugguaugcccagauccaaccucacuggauugcggccucuaucauucuugaguucuuucugaucguucuccugauucccgaacccgagaaacagagaacaccucaggacaaccagcugaccuacguggucaucgcuauccucaccguggucgccgcuacaauggccaaugaaaugggguuccuugagaagaccaaaaaggaccugggacugggcuccauuacaacgcaagagagcgaauccaacauccucgauauugaccugcggccggcgucugccuggacccuuuaugcuguggccacaaccuuuguuacacccaugcugcgccauagcaucgaaaauuccucugugaacgugagccucaccgcuauugccaaucaggcuacgguccugauggggcugggaaaaggcuggccucucuccaagauggauaucgggguuccccuucuggccauuggauguuacagccaggugaacccuaucacccugacagcggcccuccugcuucugguggcucacuacgccaucauuggccccggccuccaggcuaaggccaccagagaagcccaaaaacgggcggcugccgggaucaugaagaauccuacagucgacggaauuaccgugaucgaucuggagccgauucccuaugacccuaaauucgaaaagcagcugggccagguuaugcuccuuauccugugcgugacgcagguccugaugaugcgcacaaccugggcucucugugaggcccugacacuugccaccgggcccaucucuacccugugggagggaaacccuggcagauuuuggaauacaacgauugcuguguccauggccaacaucuuccgggggagcuaccucgcgggagccggccugcuguuuucuauuaugaaaaauaccacaaacacccgcagaggcacagggaauaucggagaaacccucggcgagaaguggaagucccggcuuaacgcucuggggaaaagcgaguuccaaauuuauaagaaaucuggaauccaggaggucgauagaacgcuggccaaggagggcaucaaacgcggggaaacagaccaucacgcugugagccggggauccgccaagcucagaugguuuguugagcgcaacauggugacccccgaaggcaaagucguggaucugggcugcgggcggggaggcuggucuuacuauugugggggacuuaagaauguuagagaggugaagggccugaccaaagggggaccgggccaugaagaaccuauucccaugagcacauacggcuggaaccucguccgccugcaguccgggguggacguguucuucacacccccugagaagugcgauacacugcucugugacaucggagaaagcucccccaauccuacgauugaggcgggccggacccuuagaguucugaaccuggucgaaaauuggcucaacaauaacacacaauuuugcaucaaagugcugaauccguauaugcccucugugauugagaagauggaaacccuucagcgcaaauacgggggagcccugguccggaacccucucagcagaaauuccacacacgagauguacuggguuucuaacgcuaccggcaauaucgugagcuccgugaacaugaucucucgcaugcugauuaaucgguucacgaugaagcacaagaaagccaccuaugagcccgaugucgaccuggggagcggaacaagaaacaucggcauugaauccgagaucccuaaccucgacauuaucggcaagcgcauugagaagaucaagcaggagcaugaaaccagcuggcacuacgaucaggaccaucccuauagaacaugggcuuaccacgggucuuaugagaccaaacaaacaggauccgccagcucuauggugaauggcguugugcggcuucugaccaagccgugggaugucgugccuaugguuacgcagauggcuaugacagacaccacccccuuugggcagcagcgcguguucaaggagaaagucgauacaagaacgcaagaaccuaaggagggaaccaaaaagcugaugcggaucacagccgaauggcucuggaaagagcugggcaagaagaaaacccccagaauguguacacgggaggaauuuacccgcaaggugagauccaacgcggcccuuggggcuauuuucacagacgagaauaaauggaaaagcgcccgggaagcuguggaggauucucgcuuuugggaacuggucgacagagagcggaaccuccaccuggagggaaaaugcgaaaccuguguuuacaauaugaugggcaagcgcgagaaaaagcugggcgaguucgggaaggccaaaggauccagagccaucugguauauguggcucggcgcgcgguuucuggaguucgaagcucuuggguuucugaacgaggaucauugguucagccgcggaaauucccucagcggcguggagggggaaggccugcacagacuuggauacauucugcgggacgugucuaagaaagagggcggggccauguacgccgaugacacggcuggaugggacacccgcaucacacucgaagaucugaagaacgaggaaauggucaccaaucauaugaaaggcgagcacaagaagcuggccgaggcuauuuuuaaacucacauaucagaacaaggugguuagagugcagcggccuacaccccgcgggacggucauggacaucaucagcagacgggaucagagaggauccggccaaguggggacauacggccugaauaccuucacaaacauggaagcccagcuuauucgccagauggagggagaaggcaucuucaaaucuauucaacaucugaccguuacggaggagaucgcggugcagaauuggcucgcccgggucgggagagaacgccugagccggauggcuauuuccggagacgauugcgugguuaagccgcuugacgauagauuugccucugcucugaccgcccucaacgacaugggcaaagugcgcaaggauauccagcagugggagccuagccggggguggaaugacuggacacaaguccccuucugcucccaccacuuucaugaacuggugaugaaggauggaagaguccuggugguucccugucgcaaccaggacgagcucaucggccgggcgagaauuucucagggggccggcuggagccugaaagaaaccgcuugccuuggaaaguccuaugcccagauguggacacugauguacuuccaccgccgggaucucagacuggcugccaacgcuaucuguagcgccgugccuucucauugggucccgaccucccggacaaccuggagcauucacgcgaaacacgaguggaugacgacagaggacaugcuugccguguggaauagaguguggauccaagaaaaccccuggauggaggacaagaccccuguugaaucuugggaggaagugcccuaucugggcaaacgcgaggaucaguggugcgggucccucauuggacugaccagccgggcuacaugggccaagaauauccagaccgccauuaaccaggucagaucccugaucggcaaugaggaauacacagacuauaugccuucuaugaagcgcuuuagacgggaggaagaggaagcuggggugcucugguga

SEQ ID NO: 20033 - RNA, 9876 nt, Artificial Sequence
  derived and/or modified CDS sequence (opt5) from DENV-2__FJ898453__SS-prME
accgccggagugaucgucaugcugauucccaccgcuauggccuuccaccucacgacccggaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucuccaccaacaucuggcugaaacuucgggagagacaggacguguuuugugauagcaaacugaugucugccgcuaucaaggacaaucgcgccguccacgcggauaugggcuauuggauugaauccgcccucaacgacacguggaaaauggagaaggcuagcuucaucgaggugaagucuugccacuggccuaaaagccauacacugugguccaaugggguucuggaaagcgagaugauuauccccaagaacuucgccggaccggugucucagcacaacuaccggccuggcuaucauacccaaaccgcugggcccuggcaccuuggaaaacucgaaauggauuuugacuucugugagggcacaaccgucguggugacggaagauugcgggaauagaggacccucccugcggacaaccacagccagcggcaagcugauuaccgaguggugcugucgcuccugcacacucccuccgcugagauaccggggcgaggacggguguugguacggaauggaaaucagaccccuuaaagagaaggaagagaaccuggucaauucucucguuaccgccggccaugggcagauugauaacuuuagccugggagugcugggcauggcucuuuuccucgaagagaugcugcgcacgcggguggggaccaagcacgcgauccugcucgucgcccuguccuuugugacacuuaucaccggaaauaugucuuucagagaccugggccgcguuauggugauggucggcgcuacaaugaccgaugacauugggaugggagugacguaucucgcccugcuggccgcuuuuaaaguuagaccuacauucgccgcgggccuucugcuccggaagcugaccagcaaagagcucaugauggcuacaaucgggauugcccugcuuucccagucuacccugcccgaaaccauccucgagcugacagaugcccuggcucuuggaaugauggugcugaagauuguccgcaacauggaaaaauaccaacucgccgugacgaucauggcgaucagcugcguuccuaaugcugugauucugcagaacgccuggaaggucuccuguaccauccucgccgcugugagcgugucuccccugcuucugacauccagccagcagaaggccgacuggauuccucucgcucugaccaucaaaggccugaaucccacagccauuuuucuuaccacgcugucuagaacauccaagaaacggagcuggccgcucaacgaggcgaucauggccgucgggaugguuucuauccuggcuuccagccuccugaagaaugacauuccuaugaccggaccccuuguggccggcggccugcugaccgugugcuauguccucacagggcgcuccgcugaucuggaacuugagagagccgccgacgugaaaugggaggaucaagcugaaaucagcggaucuagcccuauucuguccaucaccauuucugaggacggcagcauguccaucaagaacgaagaggaggaacagacacucacgauucugauccggaccgggcuccugguuaucucuggaguguuccccgucagcauuccgaucacagcggccgcuugguaccuuugggaggugaaaaagcagcgcgccggcguucugugggaugugccuucucccccucccgucgggaaggccgaacuggaggacggaguguauagaauuaaacagcggggcauccucggcuacagccaaauuggggcuggagucuauaaggaaggcaccuuucacacaauguggcaugugacccgcggggccguucugaugcacagaggaaaacggaucgagcccagcugggcggaugugaagaaagaccuuaucuccuacggcgggggauggaagcuggagggcgaauggaaggagggcgaagagguccaggugcucgcucuggaaccugggaaaaauccgagagccguucagacgaagcccggaauuuucaaaaccaacacaggcaccaucggggccgugagccucgauuuuucuccuggaacauccggcagccccauugucgaccgcaaggggaaaguggugggacuguacggcaauggcguugucacccggucuggggcuuauguguccgccaucgcgcagacagaaaagagcauugaggauaacccugaaaucgaggacgauaucuucagaaagaaacgccuuacgauuauggaccugcaucccggagcuggcaagaccaaacgguaccugccugccaucgugagagaagccauuaagcgcgggcuccggacacugauccuugcuccgaccagagucguggccgcugagauggaagaggcccugcgcggacuccccauucgguaucaaaccccugcgaucagagccgagcacacaggccgggaaauuguugaccugaugugucaugcuacguucaccaugcgccuccugucccccgugagagucccuaacuacaaucuuaucaucauggaugaggcccacuuuacagaccccgcuucuauugccgcccggggguauaucagcacccgcguggaaaugggcgaggcugcgggaauuuucaugacagccaccccgccuggcuccagagaucccuuuccccagagcaacgcuccuaucauggacgaggaacgggagauucccgaaagaucuuggaacuccgggcacgaguggguuacggauuucaaaggaaagacagugugguuugucccuagcaucaaggccggcaacgacaucgccgcuugccugcgcaaaaaugggaagaaagugauucagcugucucggaagaccuucgauagcgaauacguuaaaaccagagccaacgacugggauuuuguggucacaaccgacaucuccgagaugggagcgaauuucaaggcugagcgcgugauugauccgcggagauguaugaagcccgugauccucacagacggcgaagaaagagucauucuggccgggccuaugcccguuacccauucuagcgccgcucaacggagaggccgcaucggaagaaacccuaaaaaugaaaacgaccaguauaucuacaugggcgagccccuugaaaaugaugaggacugcgcccacuggaaggaggcgaaaaugcugcucgauaacauuaauacgccggaagggaucauuccuuccauguuugagcccgaacgggagaagguggacgccaucgauggagaauaccgccugagaggcgaggcucggaaaacauucguggaccugaugcgcagaggggaucucccugucuggcuugccuauaagguggcugccgagggaauuaacuacgcugaccggaaaugguguuuugauggcaucaagaauaaccagauucuggaagagaacguugaaguggagaucuggaccaaggagggggaacgcaagaagcugaaaccccgcuggcucgacgcccggaucuauucugauccucuggcgcuuaaggaguucaaagaguucgccgcuggcagaaagagccugacacucaaucugauuaccgagaugggacgccugcccacguuuaugacccagaaggcccggaacgcucucgacaaucuugccguccugcauacagccgaagugggcgggagagcuuacaaccacgcgcuguccgagcucccggagacccuggaaacacuucugcuccugacccugcucgccacaguuaccggaggcaucuuccuuuuucugaugagcgggaaaggaauuggcaagaugacgcugggcaugugcugcaucauuacagcuucuauccuccugugguaugcccaaauccagccucacuggauugccgcuuccaucauucuugaguucuuucugaucgugcuccugauucccgaacccgagaaacagcggaccccucaggauaaucaacugaccuacgucgugaucgccauccucacagucguggcggccaccauggcuaacgaaaugggguuccuugagaagaccaagaaggaccugggauuuggcagcauuacgacccaggaguccgaaucuaauauccuggacauugaucuccgcccggccagcgcuuggacacuguaugccguugcgaccacauucgugacccccaugcuuagacauuccaucgagaacucuagcgugaaugucucccugacggccauugcuaaccaggccaccguucucauggggcugggaaagggcuggccucugagcaaaauggacaucggggugccccuccuugcuauuggauguuacucucaggugaauccuaucacacugaccgccgcucugcuccugcuugucgcccacuacgcgaucauuggccccggccugcaagccaaggcuacacgggaagcccagaaacgcgcugccgccgggaucaugaagaacccuaccguggauggaauuacgguuaucgaccucgagccgauucccuaugauccuaaauuugaaaagcagcugggccaggugaugcugcucauccuuugcgucacacaagugcugaugaugagaaccacaugggcgcugugugaggcucucacccuggccaccgggcccaucuccacacuuugggagggaaauccuggccgguucuggaacacgaccauugcugucagcauggccaauaucuuucgcgggucuuaccuggccggagcuggccuccuguucuccauuaugaagaacacaaccaauacaagacggggcaccgggaacgugggagaaacgcugggcgagaaauggaagucccgccucaacgcccuugggaaaucugaauuucagaucuauaagaaaagcggcauucaggagguugacagaacacuggcgaaggagggcaucaaaagaggggaaaccgaucaucacgccguguccagaggaucugcuaagcugcgcugguucgucgagcggaauaugguggcccccgaaggcaagguuguggaccucggcugcgggagaggaggcuggagcuacuauugugggggacugaaaaacguccgcgaggugaagggccuuaccaaagggggaccgggccaugaggaaccuauccccauguccacauacggcuggaaucuggugcggcuccaaagcgggguugaugucuucuuuacacccccugagaagugcgacacccugcugugugauauuggagaauccucucccaacccuacgaucgaggcuggcagaacccuccgcgugcuuaaucugguggaaaacuggcugaauaacaauacacaguucugcauuaaaguccucaacccguauaugcccagcguuaucgagaagauggaaacccugcagcggaaguacgggggagcccuugugagaaauccucugucccgcaacucuacacacgagauguacugggugagcaaugcgaccggcaacauugucuccucugugaauaugaucagccggaugcucaucaacagauuuacgaugaaacacaagaaagccaccuaugagcccgacguugaucugggguccggaacacgcaacauuggcaucgaaagcgagauuccuaaucuggacaucauuggcaagcggaucgagaaaauuaagcaggagcaugaaaccucuuggcacuacgaccaagaucaucccuauaagacaugggcuuaccacggguccuaugagaccaaacagacaggaagcgccucuuccauggugaacggcgucgugagacuccuuaccaagccgugggacguugugccuauggucacgcagauggcuaugacagauaccacccccuucgggcagcaacgcguguuuaaagagaagguggacacaagaacgcaggaaccuaaagagggaaccaagaagcugaugaaaaucacagccgaauggcuguggaaggagcucggcaaagagaagacaccccggauguguacacgcgaagaguucaccagaaaaguccggagcaaugcugcccugggggcgaucuuuacagaugaaaacaaguggaaaucugccagagaggcuguugaagacggacgguucugggagcuuguggaucgcgagagaaaucugcaccucgaaggcaagugcgagaccuguguguacaacaugaugggcaagcgggagaaaaagcugggggaguuuggaaaagccaagggcucccgcgcuauuugguauauguggcugggggccagauuccucgaauuugaggcccugggauuccuuaaugaggaccauugguuuagccggggcaacucccugagcggggucgaaggcgagggacuccaccgccugggcuacauccuuagagaaguggggaaaaaggagggaggcgcgauguacgcugaugacacggccgggugggauacccggauuacacuggaagaccucaagaaugaggagaugguuaccaaccauaugaaaggagaacacaagaaacuggccgaggcuaucuucaagcugacauaucagaauaaagugguccgcgugcagagaccuacaccccggggcacgguuauggacauuaucucucgcaaggaucaaagagggagcggccaggugggaacauacggccucaacaccuucacaaauauggaagcccagcugauccggcaaauggagggggagggaauuuuuaaguccauccagcaucuuaccgucacggaagagauugcugugcagaacuggcuggcccgcguuggcagagaacggcucucuagaauggcgaucagcggggacgauugcguggucaaaccgauugacgaucgcuucgccuccgcucugaccgcccuuaaugacaugggaaaggugcggaaagauauccagcaaugggagccuucuagaggcuggaacgacuggacacagguccccuuuugcagccaccacuuccaugaacuggugaugaaggaugggcgcguucucgugguccccugucggaaccaggacgagcugaucggcagagcucgcauuucccagggagccggcuggucucugaaagagaccgcgugccucggaaagagcuaugcccaaauguggacacugauguacuuucaccggagagaucuucgccuggcugccaaugcuaucuguuccgccgugccuagccauugggugccgaccucucggacaaccugguccauucacgcuaagcacgaauggaugacgacagaggacaugcucgccguuuggaacagaguguggauccaggaaaaucccuggauggaggauaaaaccccugucgaaagcugggaggaggugcccuaucugggaaagcgcgaagaccaguggugcggcucucuuauugggcugaccucccgggcgacaugggccaaaaacauccagaccgcuauuaaucaaguuagaagccucaucggaaacgaggaauacacagacuauaugccuuccaugaagcgguucagacgcgaggaagaggaggccggcgugcugugguga

SEQ ID NO: 20034 - RNA, 9876 nt, Artificial Sequence
  derived and/or modified CDS sequence (opt5) from DENV-2__EU482445__SS-prME
agcgccggaaugaucauuaugcugauccccaccgucauggcuuuccaccugaccacgagaaauggggagccucauaugauugucggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggacccugaaaauccugauuggcguuaucauuacguggaucgggaugaacucccgcagcacaucucuuuccgucagccucgugcuggugggaaucgucacccuguaccucggcgugaugguucaggcugauucuggguguguggucuccuggaagaauaaggagcugaaaugcggaagcggcauuuucaucaccgacaacgugcacacauggaccgaacaguauaaguuucaaccugagucccccucuaaacuugccagcgccauucagaaggcucaggaagaggggaucuguggcauucgguccguuacaagacuggagaaucucauguggaaacagaucacgccggaacugaaccacauccuggccgagaaugaagugaaacuuaccauuaugacaggagauaucaaaggcauuaugcaagcugggaagcgcucucuccggccucagcccaccgagcugaaguacagcuggaaaacauggggaaaggccaaaaugcuguccaccgaaagcuauaaccagacguuccucaucgacggcccugagaccacagagugccccaauaccaacagagcguggaacucucuggaagucgaggauuacggguuuggaguguucacaaccaacauuuggcuuaagcugaaagaaaagcaggacgccuuuugugacuccaagcucaugagcgcugccaucaaagauaaucgcgcuguucaugccgacaugggcuauuggaucgagucugcgcugaacgauacauggaagauugagaaagccuccuucaucgaagugaagaauugccacuggccuaaaagccauacccuguggucuaacggcguccuugagagcgaaaugauuauccccaagaaccucgcugggccggugucccaacacaauuaccggccuggauaccacacgcagauugccggccccuggcaucuggggaagcuggagauggacuucgauuuuugugacggaacaaccgugaucgucaccgaagauugcggcaacagagggcccagccuccgcacaaccacggcuucuggaaaacugauuacagaguggugcugucgguccugcacccuuccuccgcugagauaucggggcgaggacggcuguugguacgggauggaaauccgcccccucaaggagaaagaagagaaucugguuaacagccuggugacagccggacacggccagguggauaauuucucccuugggguccucggaauggcccuguuucuggaagagaugcucagaacccgggugggcacaaagcaugcuauccugcuuguugcggugucuuucgucacccugauuacggggaacaugagcuuuaaagaccucggaagagugguugugauggucggcgccaccauggcugaugacaucggcaugggggugacauaucuggcccugcuugccgcuuucaagguucgcccuaccuuugccgcgggacugcuccugcggaagcucacauccaaagagcugaugaugaccacgauuggcaucgugcuucugucucaaagcacaauucccgaaaccguccucgagcugacagaugcucuggcccuugggaugauggugcugaagaucgugagaaauauggaaaaauaccagcucgccgucaccaucauggcuauucugugcguuccuaacgccgugauccuccagaaugcguggaagguguccuguaccauucuggcugucgugucuguuagcccccuucugcucacauccagccagcagaagacggacuggaucccucuggcccugaccauuaagggacuuaaccccacagccaucuuccugaccacacucucucgcaccaauaaaaagagauccuggccgcugaacgaggcuaucauggccgugggcauggucagcauucucgcuucuucccugcuuaagaaugacaucccuaugacggggccccugguggccggaggccugcucacaguuugcuaugugcugaccggccggagcgcggaucuugaacuggagcgcgccaccgacgucaaaugggaggaucaggcugaaauuucuggguccagcccuauccucuccauuacaaucagcgaggacggaucuaugagcauuaagaacgaagaggaggaacagacccugacaauccucaucagaacgggccugcuugugauuuccgggcuguuucccaucucuauuccgaucaccgccgcugccugguaccugugggaggucaaaaagcagcgggccggagugcucugggauguuccuucucccccucccaugggcaaagcugaacuggaggacggggcguaucgcauuaagcaaaagggaauccuuggcuacucccagaucggcgccgggguguacaaagaaggaacauuccacaccauguggcaugucacaagaggcgcugugcugaugcacaaggggaaacggauugagcccuccugggccgauguuaagaaagaccucaucagcuauggaggcggguggaagcuggagggagaauggaaggagggcgaagaggugcagguccucgcccuggaaccuggcaaaaauccgcgcgcugugcagaccaagcccgggcuuuuuaaaacgaacaccggaacaauuggcgccgugucccuggauuucucuccugggaccagcggaucccccaucauugacaagaaaggcaagguugucgggcuguacggaaacggcguggugacaagaagcggcgcguaugucucugcuaucgcccaaaccgagaaguccaucgaggauaauccugaaauugaggacgauaucuuucggaaacgcagacucacaauuauggaccugcaccccggggccggaaagacgaaacgguaccuuccugcuaucgugagagaagccauuaagcgcggccugcggacccucauccuggcgccgacaagaguuguggcugccgagauggaagaggcccuccgcgggcugcccauucgguaucagaccccugcuaucagagccgagcauaccggacgcgaaaucgucgaccuuaugugucacgcuacauucacgaugcggcugcugagccccgugagaguuccuaacuacaaucucauuaucauggaugaggcccauuucaccgaccccgcgucuauugccgcucgcggcuauaucuccacacggguggaaaugggggaggccgcuggcauuuuuaugaccgccacaccgccuggaagcagagaucccuucccccaguccaacgccccuaucaucgacgaggaacgggagauucccgaacgcucuuggaauaccggccacgagugggucacggauuuuaaagggaagacagugugguucguuccuagcaucaaggcuggaaacgacauugcggccugccugcgcaaaaauggcaagaaagugauccaacuuucccggaagaccuuugauagcgaauacgucaaaacccgcacaaacgacugggauuucguggugaccacagacauuucugagaugggggcuaauuuuaaggccgagagagucaucgauccgcggagauguaugaaacccguuauccugaccgacggagaggaacgcgugauucucgccggcccuaugcccgugacgcauuccagcgcugcccagcggagagggcgcaucggccggaacccuaagaaugaaaacgaccaguacauuuauaugggagagccccuggaaaaugaugaggacugcgcgcacuggaaggaggcuaaaaugcugcucgauaacaucaauacaccggaaggcauuaucccuucuauguucgagcccgaaagagagaaggucgacgccauugauggggaauaccgccuucggggagaggccagaaaaaccuuuguggaccugaugcgcagaggcgaucugccuguuuggcucgcuuauaagguggccgcggaggggaucaacuacgccgaccggcgcugguguuucgauggaaucaaaaacaaucagauucuggaagagaacgucgaaguggagaucuggacaaaggagggcgaaagaaagaaacuuaagccccgguggcuggacgcucgcauuuauagcgauccucucgcccugaaagaguuuaaggaguucgcugccgggagaaaaucccugacccucaaucuuaucacggagaugggccggcugcccaccuucaugacacaaaagaccagagacgcucuggauaaccucgccguucugcacacagcggaagccggaggccgcgcuuacaaucaugcccuuucugagcugccggagacccucgaaacacugcugcuccuuacccugcuggcuacggugacagggggaauuuuucucuuccugaugagcggccgggggaucggaaagaugacccuuggcaugugcugcaucauuaccgccuccauccugcucugguaugcccagauucagccucacuggaucgcugcgucuauuauccuggaguuuuuccugaucguccuccuuauucccgaacccgagaaacagagaacaccucaagacaaccagcugaccuacguggucaucgccauucugacagugguugcugccacgauggccaaugaaaugggcuuucucgagaagaccaaaaaggaccuggggcuuggaagcaucgcuacacagcagccggaguccaacauucuggauaucgaccuccgccccgccagcgcguggacccuguacgccguggcuacaaccuucgugacgccuaugcugcggcauucuauugaaaauuccagcgucaacguuucccucaccgccaucgcuaaucaagccacagugcuuaugggccuggggaaaggauggccccugucuaagauggauaucggcgugccucuccuggcgauuggguguuauagccaggucaaccccaucacccuuacagccgcucugcuccugcugguggcccacuacgcuauuaucggaccuggccuccaggccaaggcuaccagagaggcccagaaacgggcggccgcuggcauuaugaagaauccgacgguugacgggaucacagugaucgaucuugaccccauuccuuaugaucccaaauuugaaaagcaacugggacaggucaugcugcucauccugugcgugacccagguccuuaugaugcgcacaaccugggcccugugugaggcucucacccuggccacaggcccuauuuccacgcugugggaagggaaccccggaagauucuggaauaccacaaucgccgugucuauggcgaacauuuuucggggcagcuaccucgcuggggccggacuucuguucuccaucaugaaaaauaccacaaacacccgcagaggcacgggcaacaucggggagacacugggagagaaguggaaaagccggcucaaugcucugggcaagucugaauuucaaauuuauaagaaauccgggauccaggagguugaccgcacccuugccaaggaaggaauuaaaagaggcgagaccgaucaccaugccgugagccgggggucugcuaagcugcgcugguucgucgagagaaacauggugacaccggaaggaaaaguuguggaccucggcugcggcagagggggaugguccuacuauuguggcgggcugaagaauguccgggaggugaagggacugaccaaaggcgggccuggacacgaagaacccauccccaugagcacauacggcuggaaccucgugcgccuucagucuggcguugaugucuuuuucauuccucccgaaaagugcgacacgcugcugugugauaucggggagagcuccccuaauccgaccguggaggccggacggacacucagagugcugaaccuugucgaaaauuggcugaacaauaacacccaguucugcaucaaaguucucaaucccuacaugccuucugugauugagaagauggaagcgcugcaacgcaaauauggcggggcccuggugcggaacccccucagcagaaauuccacacaugagauguacugggucagcaacgcuuccggaaauaucgugucuagcguuaacaugauuucccgcaugcuuaucaaccgguuuaccaugagacacaagaaggccacguaugaaccugacguggaccugggcucugggacccgcaauauuggaaucgagagcgagauucccaaccuggauaucaucggcaaacggauugaaaagaucaaacaggagcaugaaacauccuggcacuacgaccaggaucacccguauaagaccugggcuuaccauggcucuuaugagacaaaacagaccgggagcgccuccagcauggucaauggagugguuagacuccugacaaagccuugggacgugcuucccaccgucacgcaaauggcgaugacagauaccaccccuuucggccagcagcgcguguuuaaggaaaaaguggacacacggacgcaggagcccaaggaggggaccaaaaagcugaugaaaauuacagccgaauggcucuggaaggagcugggcaaaaagaagaccccuagaauguguacacgcgaagaguucaccagaaaaguccggucuaacgcugcccugggcgcuaucuuuacagaugagaauaaguggaaauccgcccgcgaagcuguugaggacagcagauucugggaacucguggauaaggagcggaaccugcaccuugaagggaaaugcgagaccuguguguacaauaugaugggaaagagagagaagaaacugggcgaauuuggcaaggccaaagggucucgggcgauuugguacauguggcucggagcccgcuuccuggaguuugaagcucuuggcuuccugaacgaggaccauugguuuuccagagaaaauagccucucuggggucgagggagagggccugcacaagcugggguauauccuccgggauguguccaaaaaggaaggcggagccauguacgcugacgacacggccggcugggauacccgcaucacacuggaggaccuuaagaacgaagagaugguuaccaaucacauggaaggggagcauaaaaagcuggccgaggcgauuuucaaacucacauaucaaaacaagguggucagagugcagcggcccaccccgcgcggaacgguuauggauaucauuagcagacgggaccagcgcggcuccgggcaagugggaacauacggccugaauaccuuuacaaacauggaagcucagcuuaucagacagauggagggggaaggcgucuucaaaaauauucagcaccugaccgugacggaggagguugccgugcaaaacuggcucgcccgggucggacgcgaaagacugagccggauggcuaucucuggcgaugacugcguggucaagccucuggaugaccgcuucgccaacgcucucaccgcccugaaugauauggggaagaucagaaaagacauucagcagugggagcccagcaagggauggaacgauuggacacaggugcccuuuugcucccaucacuuccaugaacuuaucaugaaagacggccggguucugguggucccuuguagaaaucaagaugagcucauugggcgcgcgcggaucucucagggagccggcuggagccugagagaaaccgcuugccuugggaaguccuaugcccagauguggucucugauguacuuucaccgccgggaccucagacuggcugccaacgcgauuuguagcgccgugccgucccacugggugcccacaucucgcaccacauggagcauccaugcuaaacacgaguggaugaccacggaggacaugcugacaguuuggaaucggguguggauuagagaaaacccuuggauggaggauaagacccccgucgaauccugggaggaaaucccuuaucucggcaagcgcgaggaccaguggugcggaagccugaucggccuuaccucucgggccacaugggcuaaaaauauucaagccgcuaucaaccaggugagaucccugauugggaaugaggaauacaccgauuacaugcccagcaugaagcgcuuccggagagaggaagaggaagccggaguucucugguga

SEQ ID NO: 20035 - RNA, 9876 nt, Artificial Sequence
  derived and/or modified CDS sequence (opt5) from DENV-2__EU482446__SS-prME
agcgccggaaugaucauuaugcugauccccaccgucauggcuuuccaccugaccacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccacagagugccccaauaccaacagagcguggaacucucucgaagucgaggauuacggguuuggaguguucacaaccaacauuuggcugaaacuuaaagaaaagcaggacgccuuuugugacuccaagcugaugagcgcugccaucaaagauaaucgcgcuguucaugccgacaugggcuauuggaucgagucugcgcucaacgauacauggaagauugagaaagccuccuucaucgaagugaagaauugccacuggccuaaaagccauacccuguggucuaacggcguccuggagagcgaaaugauuauccccaagaaccuugcugggccggugucccaacacaauuaccggccuggauaccacacgcagauugccggccccuggcaucucgggaagcuggagauggacuucgauuuuugugacggaacaaccgugaucgucaccgaagauugcggcaacagagggcccagccugcgcacaaccacggcuucuggaaaacucauuacagaguggugcugucgguccugcacccugccuccgcuuagauaucggggcgaggacggcuguugguacgggauggaaauccgcccccugaaggagaaagaagagaaucucguuaacagccuggugacagccggacacggccagguggauaauuucucccuggggguccuuggaauggcccucuuucuggaagagaugcugagaacccgggugggcacaaagcaugcuauccuccugguugcggugucuuucgucacccuuauuacggggaacaugagcuuuaaagaccugggaagagugguugugauggucggcgccaccauggcugaugacaucggcaugggggugacauaucucgcccugcuggccgcuuucaagguucgcccuaccuuugccgcgggacuucugcuccggaagcugacauccaaagagcucaugaugaccacgauuggcaucgugcugcuuucucaaagcacaauucccgaaaccguccuggagcucacagaugcucuggcccuggggaugauggugcuuaagaucgugagaaauauggaaaaauaccagcuggccgucaccaucauggcuauucucugcguuccuaacgccgugauccugcagaaugcguggaagguguccuguaccauucucgcugucgugucuguuagcccccugcuucugacauccagccagcagaagacggacuggaucccucucgcccugaccauuaagggacugaaccccacagccaucuuccuuaccacacugucucgcaccaauaaaaagagauccuggccgcucaacgaggcuaucauggccgugggcauggucagcauucuggcuucuucccuccugaagaaugacaucccuaugacggggccccuuguggccggaggccugcugacaguuugcuaugugcucaccggccggagcgcggaucuggaacuugagcgcgccaccgacgucaaaugggaggaucaggcugaaauuucuggguccagcccuauccuguccauuacaaucagcgaggacggaucuaugagcauuaagaacgaagaggaggaacagacccucacaauccugaucagaacgggccuccuggugauuuccgggcuuuuucccaucucuauuccgaucaccgccgcugccugguaccugugggaggucaaaaagcagcgggccggagugcugugggauguuccuucucccccucccaugggcaaagcugaacucgaggacggggcguaucgcauuaagcaaaagggaauccugggcuacucccagaucggcgccgggguguacaaagaaggaacauuccacaccauguggcaugucacaagaggcgcugugcuuaugcacaaggggaaacggauugagcccuccugggccgauguuaagaaagaccugaucagcuauggaggcggguggaagcucgagggagaauggaaggagggcgaagaggugcagguccuggcccucgaaccuggcaaaaauccgcgcgcugugcagaccaagcccgggcuguuuaaaacgaacaccggaacaauuggcgccgugucccuugauuucucuccugggaccagcggaucccccaucauugacaagaaaggcaagguugucgggcuguacggaaacggcguggugacaagaagcggcgcguaugucucugcuaucgcccaaaccgagaaguccaucgaggauaauccugaaauugaggacgauaucuuucggaaacgcagacugacaauuauggaccuccaccccggggccggaaagacgaaacgguaccugccugcuaucgugagagaagccauuaagcgcggccuucggacccugauccucgcgccgacaagaguuguggcugccgagauggaagaggcccugcgcgggcuccccauucgguaucagaccccugcuaucagagccgagcauaccggacgcgaaaucgucgaccugaugugucacgcuacauucacgaugcggcuucugagccccgugagaguuccuaacuacaaucugauuaucauggaugaggcccauuucaccgaccccgcgucuauugccgcucgcggcuauaucuccacacggguggaaaugggggaggccgcuggcauuuuuaugaccgccacaccgccuggaagcagagaucccuucccccaguccaacgccccuaucaucgacgaggaacgggagauucccgaacgcucuuggaauaccggccacgagugggucacggauuuuaaagggaagacagugugguucguuccuagcaucaaggcuggaaacgacauugcggccugccuccgcaaaaauggcaagaaagugauccaacugucccggaagaccuuugauagcgaauacgucaaaacccgcacaaacgacugggauuucguggugaccacagacauuucugagaugggggcuaauuuuaaggccgagagagucaucgauccgcggagauguaugaaacccguuauccuuaccgacggagaggaacgcgugauucuggccggcccuaugcccgugacgcauuccagcgcugcccagcggagagggcgcaucggccggaacccuaagaaugaaaacgaccaguacauuuauaugggagagccccucgaaaaugaugaggacugcgcgcacuggaaggaggcuaaaaugcugcuggauaacaucaauacaccggaaggcauuaucccuucuauguucgagcccgaaagagagaaggucgacgccauugauggggaauaccgccuccggggagaggccagaaaaaccuuuguggaccuuaugcgcagaggcgaucugccuguuuggcuggcuuauaagguggccgcggaggggaucaacuacgccgaccggcgcugguguuucgauggaaucaaaaacaaucagauucucgaagagaacgucgaaguggagaucuggacaaaggagggcgaaagaaagaaacugaagccccgguggcuugacgcucgcauuuauagcgauccucuggcccucaaagaguuuaaggaguucgcugccgggagaaaaucccugacccugaaucucaucacggagaugggccggcuucccaccuucaugacacaaaagaccagagacgcucuggauaaccuggccguucuccacacagcggaagccggaggccgcgcuuacaaucaugcccugucugagcuuccggagacccuggaaacacuccugcugcucacccuucuggcuacggugacagggggaauuuuucuguuccucaugagcggccgggggaucggaaagaugacccugggcaugugcugcaucauuaccgccuccauccuucugugguaugcccagauucagccucacuggaucgcugcgucuauuauccucgaguuuuuccugaucguccugcucauucccgaacccgagaaacagagaacaccucaagacaaccagcuuaccuacguggucaucgccauucugacagugguugcugccacgauggccaaugaaaugggcuuucuggagaagaccaaaaaggaccucgggcugggaagcaucgcuacacagcagccggaguccaacauucuugauaucgaccugcgccccgccagcgcguggacccucuacgccguggcuacaaccuucgugacgccuaugcugcggcauucuauugaaaauuccagcgucaacguuucccugaccgccaucgcuaaucaagccacagugcucaugggccuugggaaaggauggccccugucuaagauggauaucggcgugccucugcucgcgauuggguguuauagccaggucaaccccaucacccugacagccgcccuucugcuccugguggcccacuacgcuauuaucggaccuggccugcaggccaaggcuaccagagaggcccagaaacgggcggccgcuggcauuaugaagaauccgacgguugacgggaucacagugaucgaucucgaccccauuccuuaugaucccaaauuugaaaagcaacuuggacaggucaugcugcugauccucugcgugacccagguccugaugaugcgcacaaccugggcccuuugugaggcucugacccucgccacaggcccuauuuccacgcugugggaagggaaccccggaagauucuggaauaccacaaucgccgugucuauggcgaacauuuuucggggcagcuaccuggcuggggccggacuccuuuucuccaucaugaaaaauaccacaaacacccgcagaggcacgggcaacaucggggagacacugggagagaaguggaaaagccggcugaaugcucucggcaagucugaauuucaaauuuauaagaaauccgggauccaggagguugaccgcacccuggccaaggaaggaauuaaaagaggcgagaccgaucaccaugccgugagccgggggucugcuaaacuucgcugguucgucgagagaaacauggugacaccggaaggaaaaguuguggaccugggcugcggcagagggggaugguccuacuauuguggcgggcucaagaauguccgggaggugaagggacugaccaaaggcgggccuggacacgaagaacccauccccaugagcacauacggcuggaaccuggugcgccuccagucuggcguugaugucuuuuucauuccucccgaaaagugcgacacgcuucugugugauaucggggagagcuccccuaauccgaccguggaggccggacggacacugagagugcucaaccuggucgaaaauuggcuuaacaauaacacccaguucugcaucaaaguucugaaucccuacaugccuucugugauugagaagauggaagcgcuccaacgcaaauauggcggggcccuggugcggaacccccugagcagaaauuccacacaugagauguacugggucagcaacgcuuccggaaauaucgugucuagcguuaacaugauuucccgcaugcucaucaaccgguuuaccaugagacacaagaaggccacguaugaaccugacguggaccuuggcucugggacccgcaauauuggaaucgagagcgagauucccaaccuggauaucaucggcaaacggauugaaaagaucaaacaggagcaugaaacauccuggcacuacgaccaggaucacccguauaagaccugggcuuaccauggcucuuaugagacaaaacagaccgggagcgccuccagcauggucaauggagugguuagacugcucacaaagccuugggacgugcugcccaccgucacgcaaauggcgaugacagauaccaccccuuucggccagcagcgcguguuuaaggaaaaaguggacacacggacgcaggagcccaaggaggggaccaagaaacuuaugaaaauuacagccgaauggcuguggaaagagcucggcaagaagaagaccccuagaauguguacacgcgaagaguucaccagaaaaguccggucuaacgcugcccugggcgcuaucuuuacagaugagaauaaguggaaauccgcccgcgaagcuguugaggacagcagauucugggaacugguggauaaggagcggaaccuccaccuggaagggaaaugcgagaccuguguguacaauaugaugggaaagagagagaagaaacuuggcgaauuuggcaaggccaaagggucucgggcgauuugguacauguggcugggagcccgcuuccucgaguuugaagcucugggcuuccuuaacgaggaccauugguuuuccagagaaaauagccugucuggggucgagggagagggccuccacaagcugggguauauccugcgggauguguccaaaaaggaaggcggagccauguacgcugacgacacggccggcugggauacccgcaucacacucgaggaccugaagaacgaagagaugguuaccaaucacauggaaggggagcauaagaaacuugccgaggcgauuuucaaacugacauaucaaaacaaaguggucagagugcagcggcccaccccgcgcggaacgguuauggauaucauuagcagacgggaccagcgcggcuccgggcaagugggaacauacggccucaauaccuuuacaaacauggaagcucagcugaucagacagauggagggggaaggcgucuucaaaaauauucagcaccuuaccgugacggaggagguugccgugcaaaacuggcuggcccgggucggacgcgaaagacucagccggauggcuaucucuggcgaugacugcguggucaagccucuggaugaccgcuucgccaacgcucugaccgcccucaaugauauggggaagaucagaaaagacauucagcagugggagcccagcaagggauggaacgauuggacacaggugcccuuuugcucccaucacuuccaugaacugaucaugaaagacggccggguucuuguggucccuuguagaaaucaagaugagcugauugggcgcgcgcggaucucucagggagccggcuggagccucagagaaaccgcuugccuggggaaguccuaugcccagauguggucucuuauguacuuucaccgccgggaccugagacucgcugccaacgcgauuuguagcgccgugccgucccacugggugcccacaucucgcaccacauggagcauccaugcuaaacacgaguggaugaccacggaggacaugcugacaguuuggaaucggguguggauuagagaaaacccuuggauggaggauaagacccccgucgaauccugggaggaaaucccuuaucugggcaagcgcgaggaccaguggugcggaagccucaucggccugaccucucgggccacaugggcuaaaaauauucaagccgcuaucaaccaggugagaucccuuauugggaaugaggaauacaccgauuacaugcccagcaugaagcgcuuccggagagaggaagaggaagccggaguucugugguga

SEQ ID NO: 20036 - RNA, 9876 nt, Artificial Sequence
  derived and/or modified CDS sequence (opt5) from DENV-2__EU482448__SS-prME
agcgccggaaugaucauuaugcugauccccaccgucauggcuuuccaccugaccacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccacagagugccccaauaccaacagagcguggaacucucucgaagucgaggauuacggguuuggaguguucacaaccaacauuuggcugaaacuuaaagaaaagcaggacgccuuuugugacuccaagcugaugagcgcugccaucaaagauaaucgcgcuguucaugccgacaugggcuauuggaucgagucugcgcucaacgauacauggaagauugagaaagccuccuucaucgaagugaagaauugccacuggccuaaaagccauacccuguggucuaacggcguccuggagagcgaaaugauuauccccaagaaccuugcugggccggugucccaacacaauuaccggccuggauaccacacgcagauugccggccccuggcaucucgggaagcuggagauggacuucgauuuuugugacggaacaaccgugaucgucaccgaagauugcggcaacagagggcccagccugcgcacaaccacggcuucuggaaaacucauuacagaguggugcugucgguccugcacccugccuccgcuuagauaucggggcgaggacggcuguugguacgggauggaaauccgcccccugaaggagaaagaagagaaucucguuaacagccuggugacagccggacacggccagguggauaauuucucccuggggguccuuggaauggcccucuuucuggaagagaugcugagaacccgggugggcacaaagcaugcuauccuccugguugcggugucuuucgucacccuuauuacggggaacaugagcuuuaaagaccugggaagagugguugugauggucggcgccaccauggcugaugacaucggcaugggggugacauaucucgcccugcuggccgcuuucaagguucgcccuaccuuugccgcgggacuucugcuccggaagcugacauccaaagagcucaugaugaccacgauuggcaucgugcugcuuucucaaagcacaauucccgaaaccguccuggagcucacagaugcucuggcccuggggaugauggugcuuaagaucgugagaaauauggaaaaauaccagcuggccgucaccaucauggcuauucucugcguuccuaacgccgugauccugcagaaugcguggaagguguccuguaccauucucgcugucgugucuguuagcccccugcuucugacauccagccagcagaagacggacuggaucccucucgcccugaccauuaagggacugaaccccacagccaucuuccuuaccacacugucucgcaccaauaaaaagagauccuggccgcucaacgaggcuaucauggccgugggcauggucagcauucuggcuucuucccuccugaagaaugacaucccuaugacggggccccuuguggccggaggccugcugacaguuugcuaugugcucaccggccggagcgcggaucuggaacuugagcgcgccaccgacgucaaaugggaggaucaggcugaaauuucuggguccagcccuauccuguccauuacaaucagcgaggacggaucuaugagcauuaagaacgaagaggaggaacagacccucacaauccugaucagaacgggccuccuggugauuuccgggcuuuuucccaucucuauuccgaucaccgccgcugccugguaccugugggaggucaaaaagcagcgggccggagugcugugggauguuccuucucccccucccaugggcaaagcugaacucgaggacggggcguaucgcauuaagcaaaagggaauccugggcuacucccagaucggcgccgggguguacaaagaaggaacauuccacaccauguggcaugucacaagaggcgcugugcuuaugcacaaggggaaacggauugagcccuccugggccgauguuaagaaagaccugaucagcuauggaggcggguggaagcucgagggagaauggaaggagggcgaagaggugcagguccuggcccucgaaccuggcaaaaauccgcgcgcugugcagaccaagcccgggcuguuuaaaacgaacaccggaacaauuggcgccgugucccuugauuucucuccugggaccagcggaucccccaucauugacaagaaaggcaagguugucgggcuguacggaaacggcguggugacaagaagcggcgcguaugucucugcuaucgcccaaaccgagaaguccaucgaggauaauccugaaauugaggacgauaucuuucggaaacgcagacugacaauuauggaccuccaccccggggccggaaagacgaaacgguaccugccugcuaucgugagagaagccauuaagcgcggccuucggacccugauccucgcgccgacaagaguuguggcugccgagauggaagaggcccugcgcgggcuccccauucgguaucagaccccugcuaucagagccgagcauaccggacgcgaaaucgucgaccugaugugucacgcuacauucacgaugcggcuucugagccccgugagaguuccuaacuacaaucugauuaucauggaugaggcccauuucaccgaccccgcgucuauugccgcucgcggcuauaucuccacacggguggaaaugggggaggccgcuggcauuuuuaugaccgccacaccgccuggaagcagagaucccuucccccaguccaacgccccuaucaucgacgaggaacgggagauucccgaacgcucuuggaauaccggccacgagugggucacggauuuuaaagggaagacagugugguucguuccuagcaucaaggcuggaaacgacauugcggccugccuccgcaaaaauggcaagaaagugauccaacugucccggaagaccuuugauagcgaauacgucaaaacccgcacaaacgacugggauuucguggugaccacagacauuucugagaugggggcuaauuuuaaggccgagagagucaucgauccgcggagauguaugaaacccguuauccuuaccgacggagaggaacgcgugauucuggccggcccuaugcccgugacgcauuccagcgcugcccagcggagagggcgcaucggccggaacccuaagaaugaaaacgaccaguacauuuauaugggagagccccucgaaaaugaugaggacugcgcgcacuggaaggaggcuaaaaugcugcuggauaacaucaauacaccggaaggcauuaucccuucuauguucgagcccgaaagagagaaggucgacgccauugauggggaauaccgccuccggggagaggccagaaaaaccuuuguggaccuuaugcgcagaggcgaucugccuguuuggcuggcuuauaagguggccgcggaggggaucaacuacgccgaccggcgcugguguuucgauggaaucaaaaacaaucagauucucgaagagaacgucgaaguggagaucuggacaaaggagggcgaaagaaagaaacugaagccccgguggcuugacgcucgcauuuauagcgauccucuggcccucaaagaguuuaaggaguucgcugccgggagaaaaucccugacccugaaucucaucacggagaugggccggcuucccaccuucaugacacaaaagaccagagacgcucuggauaaccuggccguucuccacacagcggaagccggaggccgcgcuuacaaucaugcccugucugagcuuccggagacccuggaaacacuccugcugcucacccuucuggcuacggugacagggggaauuuuucuguuccucaugagcggccgggggaucggaaagaugacccugggcaugugcugcaucauuaccgccuccauccuucugugguaugcccagauucagccucacuggaucgcugcgucuauuauccucgaguuuuuccugaucguccugcucauucccgaacccgagaaacagagaacaccucaagacaaccagcuuaccuacguggucaucgccauucugacagugguugcugccacgauggccaaugaaaugggcuuucuggagaagaccaaaaaggaccucgggcugggaagcaucgcuacacagcagccggaguccaacauucuugauaucgaccugcgccccgccagcgcguggacccucuacgccguggcuacaaccuucgugacgccuaugcugcggcauucuauugaaaauuccagcgucaacguuucccugaccgccaucgcuaaucaagccacagugcucaugggccuugggaaaggauggccccugucuaagauggauaucggcgugccucugcucgcgauuggguguuauagccaggucaaccccaucacccugacagccgcccuucugcuccugguggcccacuacgcuauuaucggaccuggccugcaggccaaggcuaccagagaggcccagaaacgggcggccgcuggcauuaugaagaauccgacgguugacgggaucacagugaucgaucucgaccccauuccuuaugaucccaaauuugaaaagcaacuuggacaggucaugcugcugauccucugcgugacccagguccugaugaugcgcacaaccugggcccuuugugaggcucugacccucgccacaggcccuauuuccacgcugugggaagggaaccccggaagauucuggaauaccacaaucgccgugucuauggcgaacauuuuucggggcagcuaccuggcuggggccggacuccuuuucuccaucaugaaaaauaccacaaacacccgcagaggcacgggcaacaucggggagacacugggagagaaguggaaaagccggcugaaugcucucggcaagucugaauuucaaauuuauaagaaauccgggauccaggagguugaccgcacccuggccaaggaaggaauuaaaagaggcgagaccgaucaccaugccgugagccgggggucugcuaaacuucgcugguucgucgagagaaacauggugacaccggaaggaaaaguuguggaccugggcugcggcagagggggaugguccuacuauuguggcgggcucaagaauguccgggaggugaagggacugaccaaaggcgggccuggacacgaagaacccauccccaugagcacauacggcuggaaccuggugcgccuccagucuggcguugaugucuuuuucauuccucccgaaaagugcgacacgcuucugugugauaucggggagagcuccccuaauccgaccguggaggccggacggacacugagagugcucaaccuggucgaaaauuggcuuaacaauaacacccaguucugcaucaaaguucugaaucccuacaugccuucugugauugagaagauggaagcgcuccaacgcaaauauggcggggcccuggugcggaacccccugagcagaaauuccacacaugagauguacugggucagcaacgcuuccggaaauaucgugucuagcguuaacaugauuucccgcaugcucaucaaccgguuuaccaugagacacaagaaggccacguaugaaccugacguggaccuuggcucugggacccgcaauauuggaaucgagagcgagauucccaaccuggauaucaucggcaaacggauugaaaagaucaaacaggagcaugaaauuuccuggcacuacgaccaggaucacccguauaagacaugggcuuaccauggcucuuaugagaccaaacagacagggagcgccuccagcauggucaauggagugguuagacugcucaccaagccuugggacgugcugcccacagucacccaaauggcgaugacggauacaaccccuuucggccagcagcgcguguuuaaggaaaaaguggacacccggacacaggagcccaaggaggggacgaagaaacuuaugaaaaucaccgccgaauggcuguggaaagagcucggcaagaagaagacaccuagaauguguacccgcgaagaguucacaagaaaaguccggucuaacgcugcccugggcgcuauuuuuaccgaugagaauaaguggaaauccgcccgcgaagcuguugaggacagcagauucugggaacugguggauaaggagcggaaccuccaccuggaagggaaaugcgagacauguguguacaauaugaugggaaagagagagaagaaacuuggcgaauuuggcaaggccaaagggucucgggcgaucugguacauguggcugggagcccgcuuccucgaguuugaagcucugggcuuccuuaacgaggaccauugguuuuccagagaaaauagccugucuggggucgagggagagggccuccacaagcugggguauauccugcgggauguguccaaaaaggaaggcggagccauguacgcugacgacaccgccggcugggauacgcgcauuacccucgaggaccugaagaacgaagagaugguuacaaaucacauggaaggggagcauaagaaacuugccgaggcgaucuucaaacugaccuaucaaaacaaaguggucagagugcagcggcccacaccgcgcggaaccguuauggauauuaucagcagacgggaccagcgcggcuccgggcaagugggaacguacggccucaauacauuuaccaacauggaagcucagcugauuagacagauggagggggaaggcgucuucaaaaauauccagcaccuuacagugaccgaggagguugccgugcaaaacuggcuggcccgggucggacgcgaaagacucagccggauggcuaucucuggcgaugacugcguggucaagccucuggaugaccgcuucgccaacgcucugacggcccucaaugauauggggaagauuagaaaagacauccagcagugggagcccagcaagggauggaacgauuggacccaggugcccuuuugcucccaucacuuccaugaacugauuaugaaagacggccggguucuuguggucccuuguagaaaucaagaugagcugaucgggcgcgcgcggauuucucagggagccggcuggagccucagagaaacagcuugccuggggaaguccuaugcccagauguggucucuuauguacuuucaccgccgggaccugagacucgcugccaacgcgaucuguagcgccgugccgucccacugggugcccaccucucgcacaaccuggagcauucaugcuaaacacgaguggaugacaaccgaggacaugcugacgguuuggaaucggguguggaucagagaaaacccuuggauggaggauaagacacccgucgaauccugggaggaaaucccuuaucugggcaagcgcgaggaccaguggugcggaagccucauuggccugaccucucgggccaccugggcuaaaaauauccaagccgcuauuaaccaggugagaucccuuaucgggaaugaggaauacacagauuacaugcccagcaugaagcgcuuccggagagaggaagaggaagccggaguucugugguga

SEQ ID NO: 20037 - RNA, 9876 nt, Artificial Sequence
  derived and/or modified CDS sequence (opt5) from DENV-2__EU482449__SS-prME
accgccggcgugaucauuaugcugauccccacagcuauggccuuccaccucacgacccggaacggggagccucauaugauugucggacggcaggaaaagggcaagagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuugucugcaagcauuccaugguggauagaggcuggggcaacggguguggacuguucggcaaagggggaauugugacaugcgcgauguuuacgugcaaaaagaauauggaaggcaaaaucguccagccugagaaccucgaauacaccauuguuaucacaccccacagcggggaggagcaugccgugggaaaugacaccggcaagcacggcaaagaaaucaagauuacaccucagucuuccaacaccgaggcugaacugacgggguauggaaccgugacaauggaguguagcccccggaccggccuugauuucaaugaaaugguccugcuccaaauggaggacaaagccuggcuggugcaccgccagugguuucuugaucugccgcucccuuggcugcccggggcugacacacagggaucuaacuggauccagaaggagacccugguuacguucaagaauccucaugccaaaaagcaagacguggucgugcucggcucccaggaaggggccaugcacacagcucugaccggcgcgacagagauucagaugagcuccggaaaccuucuguuuaccggccaucucaaaugcagacugcggauggauaaacuucaacugaaagggaugucuuacagcauguguaccggaaaguucaagaucguuaaagaaauugccgagacacagcacggcacgaucgugaucagaguccaguaugagggggacggaucccccugcaagauucccuucgaaaucauggaucucgagaaacgccaugugcugggccggcugauuaccgucaacccuaucgugacagaaaaggacagcccgguuaauauugaggcugaacccccuuuuggggauucuuacaucauuaucggcguggagcccggacagcucaaacugaacugguucaagaagggcuccagcaucgggcaaauguuugagaccacaaugagaggagccaaacgcauggccauucuuggcgacaccgcuugggauuucgggucucugggaggcgucuuuacgagcaucgggaaggcccuccaccagguguucggcgcgauuuacggagcugccuuuuccggcguuucuuggacaaugaaaauccugauuggggccaucaucaccuggauuggaaugaauagccgguccaccagccugucugugucccuuguccucgugggcgugaucacacuguaucugggggcuaugguucaggccgacagcggaugugucgugucuuggaagaacaaagaacucaagugcggcuccgggauuuucaucaccgauaaugugcacacauggacggagcaguacaaguuucaaccugaaagccccuccaaacuggcuucugccauucagaaggcgcaugaggaaggcaucuguggaaucagaagcgucacccgccuugagaaccugauguggaaacagauuacaccggagcucaaucacauccuguccgaaaacgaggugaagcugaccauuaugacaggcgacaucaaagggauuaugcaggccggaaagcggucucuuagaccucaacccaccgaacucaaauauagcuggaagacguggggcaaggcuaaaaugcuguccaccgagagccauaaucagacauuccugaucgaugggccugaaaccgccgagugccccaacacaaaucgcgcuuggaacucucucgagguugaagacuacggauuuggcguguucaccacaaauaucuggcugaaacuucgggagaaacaggacgucuuuugugauuccaagcugaugagcgccgcgauuaaagacaacagagccgugcacgcugauaugggcuauuggaucgaaucugcccucaaugacaccuggaagauggagaaggcuuccuucauugagguuaaaagcugccacuggccuaagucucauacgcuguggagcaacggggugcuggaauccgagaugaucauucccaagagcuucgccggaccggucucucagcacaacuaccgcccuggcuauuacacacaaaccgccgggcccuggcaucuuggaaagcucgaaauggauuuugacuucugugagggcaccacagugguugugaccgaagauugcgggaaucggggacccucccugagaacgacaaccgcuagcggcaaacugaucacagaguggugcugucgguccugcacccucccuccgcugcgcuacagaggcgaggacggguguugguauggaauggaaauucggccccuuaaggagaaggaagagaaccuggucaauucucucgugacagcgggccacgggcagaucgauaacuuuagccugggagugcugggcauggcccuuuuccucgaagagaugcugagaacccgcgucgggacgaaacaugcuauccugcucguugccguguccuuuaugacccugauuacaggaaauaugucuuuccgggaccuuggcagagugauggucauggugggcgccaccaugacagaugacaucgggaugggaguuaccuaccuggcucuccuggccgcguuuaaggugcgcccuacguucgcugccggccugcuucugagaaaacucacaagcaaggagcugaugauggccaccauugggaucgcucuccugucccagucuacaauucccgaaaccauccuugagcugaccgaugcccucgcgcugggaaugaugguccugaaaaucgugcggaacauggaaaaguaucaacuugcuguuacaauuauggccaucagcugcgugccuaaugccgucauucugcagaacgcuuggaagguguccuguacgauccucgccgcuguuagcgugucuccccugcuccugaccuccagccagcagaaagccgacuggauuccucuugcgcugacaaucaagggccucaaucccaccgccaucuuucugacaacccugucucgcacguccaaaaagagaagcuggccgcuuaacgaggcuauuauggccgucgggauggugucuauccuggcuuccagccuccugaaaaaugacauuccuaugacaggaccccucguggccggcggccugcuuaccgucugcuacguucugaccgggcgguccgccgaucuggaacucgagcgcgcuacagacgugaagugggaggaucaagcggaaaucagcggaucuagcccuauucuguccaucaccauuucugaggacggcagcauguccaucaaaaacgaagaggaggaacagacacuuacgauccugauuagaaccgggcuccuggugaucucuggacucuuccccgucagcauuccgaucacagccgcugccugguaucugugggaggugaagaagcagcgggccggcguucuuugggaugugccuucucccccucccgucgggaaagcugaacuggaggacggagccuaccgcauuaagcagaaaggcauccugggcuauagccaaaucggggcgggaguguacaaggaaggcaccuuucacacaauguggcacguuaccagaggggcugugcucaugcaucggggaaaacgcauugagcccagcugggccgaugucaagaaggaccugaucuccuacggcgggggauggaaacuugagggcgaauggaaggagggcgaagaggugcagguccuggcccucgaaccugggaaaaauccgagagcugugcagacgaagcccggacuguucaaaaccaacacaggcaccauuggggccguuagccucgauuuuucuccuggaacauccggcagccccaucguggaccggaaggggaaggucgugggacuguauggcaauggcguugugaccagaucuggggcguacgucuccgcuauugcccagacagagaaaagcaucgaggauaacccugaaaucgaggacgauauuuuccgcaagaaacggcuuacgaucauggaccugcaccccggagccggcaagaccaaaagauaucugccugcuauugugcgcgaagccaucaagcgggggcucagaacacugauucuugcuccgacccgcgugguugccgcggagauggaagaggcccugcggggacuccccaucagauaccaaaccccugcuauucgcgccgagcauacaggccgggaaaucgucgaccugaugugucacgcuacguucaccaugagacuccugucccccgugcgggugccuaacuauaaucuuaucauuauggaugaggcccauuuuacagaccccgccucuaucgcugcgcgcggguacauuagcaccagagucgaaaugggcgaggccgcuggaaucuucaugacagccaccccgccuggcucccgggaucccuuuccccagagcaacgccccuauuaucgacgaggaacgcgagauccccgaaagaucuugguccagcgggcacgagugggugacggauuucaagggaaaaacaguuugguuugugccuucuauuaaggcuggcaaugacaucgccgcgugccugcggaaaaacgggaagaaagucauucagcugagcagaaagaccuucgauuccgaauaugugaagacccgcacaaaugacugggauuuuguugugaccacagacaucucugagaugggagcuaacuucaaagccgagcgggucauugauccgagacgcuguaugaagcccgugauccucaccgacggcgaagaacggguuauccuggccgggccuaugcccgugacgcacagcuccgcugcccaaagacgcggccggauuggaagaaauccuaaaaacgaaaaugaccaguacaucuacaugggcgagccccuugaaaacgaugaggacugcgcgcauuggaaggaggccaaaaugcugcucgauaauauuaacacaccggaagggaucauuccuucuauguuugagcccgaacgcgagaaggucgacgcuaucgauggagaauauagacugcggggcgaggcccgcaaaaccuucguggaccugaugagaagaggggaucucccuguguggcuugcuuaccgcgucgccgcugagggaauuaauuaugccgacagacggugguguuuugauggcguuaagaacaaucagauccuggaagagaacguggaaguggagaucuggacaaaggagggggaacgcaagaagcugaaaccccgcuggcucgacgcgcggauuuacagcgauccucuggcccuuaaggaguucaaagaguucgcugccggcagaaagucccugacccucaaccugaucacggagaugggacgccugcccaccuuuaugacacagaaggcucgggacgcccucgauaaucuugccguccugcacaccgcugaagcgggcgggagagccuauaaccaugcucugagcgagcucccggagacacuggaaacccuucugcuccugacacugcucgccaccgugacgggaggcauuuuccuuuuucugaugucugggaaaggaguuggcaagaugacacugggcauguucugcaucauuaccgccuccauccuccugugguacgcucaaauccagccucacuggauugccgcgagcaucauucuugaguuuuuccugaucgugcuccugauucccgaacccgagaaacagcggaccccucaggacaaucaacugacauaugucgugaucgccauccucaccguuguggcugccacaauggcuaacgaaaugggguuucuugagaagacgaaaaaggaccugggacugggcuccauugccacccaggagccggaaucuaauauccucgauauugaccugcgccccgcgagcgccuggacacuuuacgcugucgccaccacauucgugaccccuaugcugagacacuccaucgagaacucuagcgucaaugugucccucacggcuauugccaaccaggcuaccguucugauggggcugggaaagggcuggccccucagcaaaauggauaucggggugccucuucuggccauuggaugcuacucucaggugaaucccaucacacugaccgcggcccuccugcuucugaucgcucauuaugccauuaucggcccuggccuccaagcuaaggccacacgggaagcccagaaacgcgcggcugccgggauuaugaagaacccgaccgucgacggaaucacgguuauugaucuggaccccaucccuuacgaucccaaauuugagaagcagcugggccaggugaugcuccuuauccugugugugacacaaguccugaugaugagaaccacaugggcucucugcgaagcccugacccuugccaccgggccuauuuccacacugugggagggaaaucccggccgguucuggaacacgaccaucgcugugagcauggccaauauuuuucgcgggucuuaucucgcgggagccggccugcuguucuccaucaugaagaacacaaccaauacaagacggggcaccgggaacauuggagagacgcucggcgaaaaauggaagucccgccuuaaugcucuggggaaaucugaguuucagaucuacaagaaaagcggaauccaggaaguugacagaacacuggccaaggagggcauuaaaagaggggagaccgaucaccaugcuguguccagaggaucugccaagcuccgcugguucgucgaacggaacauggugaccccggagggcaaggucguggaccugggcugugggagaggaggcuggagcuauuacugcgggggacuuaaaaacguucgcgaagugaagggccugacaaaagggggaccuggccacgaggaacccauccccauguccaccuauggcuggaaucucguccggcugcaaagcgggguggauguuuucuuuacaccucccgagaagugugacacgcugcucugcgauauuggagaguccucuccuaacccgaccaucgaagcgggcagaacacuucgcgugcugagccuggucgagaauuggcucaacaaugacacccaguucuguauuaaagugcugaaccccuacaugccuuccgugaucgaaaagauggagacacuucagcggaaguacgggggagcccugguuagaaauccccucucucgcaacagcacccaugaaauguauugggucuccaaugcuacgggcaacaucgugucuagcgugaauaugauuucccggaugcugaucaacagauuuaccaugaaacacaagaaagccacauacgagccugacgucgaucuggggagcggaacccgcaauauuggcaucgagucugaaauucccaaccucgacaucauuggcaagcggaucgagaaaaucaagcaggaacacgagacauccuggcauuaugaucaagaccacccguacaagaccugggcuuaucaugggagcuacgaaacaaaacagaccggaucugccuccagcaugguuaauggcguggugagacuucugacgaagccuugggaugucgugcccaugguuacacagauggcuaugaccgacaccacaccuuucgggcagcaacgcguguuuaaagagaaggucgauacgagaacccaggagcccaaagaaggaacaaagaagcugaugaaaauuaccgccgaguggcucuggaaggaacugggcaaaaagaaaacaccucggaugugcacccgcgaggaguucacaagaaaggugcggucuaacgcggcccuuggggcuaucuuuaccgacgaaaacaaauggaaguccgccagagaggcuguugaagauagccgguucugggagcugguggacaaggaacgcaaucuccaccuggagggaaaaugugagacgugcgucuauaacaugaugggcaagagagagaagaagcugggcgaguuugggaaagccaagggaucccgggccauuugguacauguggcucggcgcgcgcuuccuggaauuugaggcucuuggguuccugaaugaagaucacugguuuagcagagagaacucucucagcggaguggagggcgaagggcugcauaaacuuggcuacauccugcgggacguguccaaaaaggagggaggcgccauguaugccgacgauaccgcugggugggacacacgcauuacccucgaagaucugaaaaaugaggaaauggucacaaaccacauggagggagagcauaagagacuggccgaagcuaucuucaaacucaccuaccagaauaagguugugcgggugcagcgccccacgccgagaggcacagucauggacaucauuucucggcgcgaucaaagagggagcggacaggugggcaccuaugggcugaacacauucaccaauauggaggcccagcuuauccggcaaauggaaggcgagggaauuuuuaaguccauccagcaccugacgguuaccgaggaaauugcggugcagaacuggcucgcccgcgucggcagagagcggcugucuagaauggcuaucagcggggacgauugugugguuaaaccucuugacgaucgcuucgccuccgcucugacagcccucaaugacaugggaaaggugcggaaagauauccagcaaugggaacccucuaagggcuggaacgacuggacccagguccccuuuugcagccaucacuuccacgagcugauuaugaaagaugggagagugcugguugugccuugccgcaaucaggacgaacucaucggacgggcgagaauuucccagggcgccggguggagccugaaggagacagcuugucuuggcaagucuuacgcccaaauguggucccugauguauuuucaucgccgggaccucagacuggcugccaacgcuaucugcagcgccgucccgucucacugggugcccaccucccgcacaaccuggagcauucaugcgaaacacgaguggaugacgacagaagauaugcuuaccgucuggaaucggguguggauccaggagaacccuuggauggaagacaagacccccguugaguccugggaagaggugccuuaccugggaaaaagagaggaucagugguguggcucucucauugggcugacaagccgcgccaccugggcuaagaacauccagacagccaucaaucaaguccggucccugauuggaaacgaagaguauacggacuacaugcccagcaugaaaagauuccggagagaagaggaagaggccggcgugcucugguga

SEQ ID NO: 20038 - RNA, 9876 nt, Artificial Sequence
  derived and/or modified CDS sequence (opt5) from DENV-2__EU482450__SS-prME
agcgccggaaugaucauuaugcugauccccaccgucauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacaguggucguuaccgaagauugcggcaacagagggcccagccugcgcaccacaaccgccucuggaaagcucaucacggaguggugcugucgguccugcacacugccuccgcuuagauaucggggcgaggacggcuguugguacgggauggaaauucgcccccugaaagagaaggaagagaaucucgugaacagccuggugaccgccggacacggccaagucgauaauuucucccugggggugcuuggaauggcucucuuucuggaagagaugcugagaacacggguuggcaccaaacaugcgauccuccugguggccgucucuuucgugacacuuaucaccgggaacaugagcuuuaaggaccugggaagaguuguggucauggugggcgcuacgaugaccgaugacauuggcauggggguuacauaucucgcccugcuggccgcuuucaaagugcgcccuaccuuugccgcgggacuucugcuccggaagcugacauccaaggagcucaugaugaccacgaucggcauuguccugcuuucucagagcgcuauccccgaaacagugcuggagcucaccgaugcccuggcccuggggaugauggugcuuaaaauugucagaaauauggaaaaguaccagcuggcuguuacaaucauggccauccucugcgugccuaacgcggugauucugcagaaugcuuggaaagucuccuguaccauccucgccgugguuucugugagcccccugcuucugaccuccagccaacagaagacagacuggauuccucucgcccugacgaucaaaggacugaaccccaccgcuauuuuccuuacaacccugucucgcacaaauaagaaaagauccuggccgcucaacgaggccaucauggcugucggcauggugagcauccuggccucuucccuccugaagaaugacauuccuaugaccgggccccuuguugcgggaggccugcugacggugugcuauguccucacaggccggagcgccgaucuggaacuugagcgcgcuaccgacgugaagugggaggaucaggccgaaaucucuggguccagcccuauucuguccaucaccauuagcgaggacggaucuaugagcaucaaaaacgaagaggaggaacagacacucaccauucugaucagaacaggccuccuggucaucuccgggcuuuuucccauuucuaucccgauuacggcugccgccugguaccugugggaggugaagaaacaacgggcuggaguucugugggaugugccuucucccccucccaugggcaaggcggaacucgaggacggggccuaucgcaucaaacagaagggcauucugggcuacucccagaucggcgcuggggucuacaaggaaggaaccuuccacacaauguggcaugugaccagaggcgccguucuuaugcacaaagggaagcggaucgagcccuccugggccgaugugaaaaaggaccugauuagcuauggaggcggguggaaacucgagggagaauggaaggagggcgaagagguccaggugcuggcucucgaaccuggcaagaauccgcgcgccgugcaaacaaaacccgggcuguuuaagaccaacacgggaaccaucggcgcgguuucccuugauuucucuccugggacaagcggaucccccauuaucgacaaaaagggcaaagucguggggcuguacggaaacggcguggucaccagaagcggcgcuuaugugucugccauugcccagacagagaaguccaucgaggauaauccugaaaucgaggacgauauuuuucggaagcgcagacugaccaucauggaccuccaccccggggcuggaaaaacaaagcgguaccugccugccauuguuagagaagcgaucaaacgcggccuucggacgcugauucucgcuccgaccagaguggucgccgccgagauggaagaggcucugcgcgggcuccccauccgguaucagaccccugccauuagagcugagcauaccggacgcgaaaucguggaccugaugugucacgccaccuucacaaugcggcuucugagccccguuagagugccuaacuacaaucugaucauuauggaugaggcgcauuucacggaccccgccucuaucgcugcccgcggcuauauuuccacccgggucgaaaugggggaggcugccggcaucuuuaugacagccaccccgccuggaagcagagaucccuucccccaauccaacgcuccuauuaucgacgaggaacgggagauccccgaacgcucuuggaauagcggccacgagugggugacagauuuuaaggggaaaaccguuugguucgugccuuccauuaaggcgggaaacgacaucgccgcuugccucagaaagaauggcaaaaaggucauucagcugagccggaaaacguuugauucugaauacgugaagacacgcaccaacgacugggauuucguggucaccacagacaucuccgagaugggggccaauuuuaaagccgagagaguuauugauccgcggagauguaugaagcccgugauccuuaccgacggagaggaacgcgugauccuggcuggcccuaugcccgucacacauagcucugccgcgcagcggagagggcgcauuggccggaacccuaaaaaugaaaacgaccaguacaucuauaugggagagccccucgaaaaugaugaggacugcgcucacuggaaggaggccaagaugcugcuggauaacauuaauaccccggaaggcaucauuccuagcauguucgagcccgaaagagagaaaguggacgccaucgauggggaauaccgccuccggggagaggcuagaaagacguuuguugaccuuaugcgcagaggcgaucugccuguguggcuggccuauaaagucgcggccgaggggauuaacuacgcugaccggcgcugguguuucgauggaaucaagaacaaucaaauccucgaagagaacguggaaguugagauuuggacaaaagagggcgaaagaaagaagcugaaaccccgguggcuugacgcccgcaucuauuccgauccucuggcucucaaggaguuuaaagaguucgccgcugggagaaagucucugacccugaaucucauuacagagaugggccggcuucccaccuucaugacgcagaaaaccagagacgcccuggauaaccuggcggugcuccacacagccgaagcuggaggccgcgccuacaaucaugcucugagcgagcuuccggagacccuggaaacacuccugcugcucacccuucuggccacagucaccgggggaaucuuucuguuccucauguccggccgggggauuggaaagaugacgcugggcaugugcugcaucaucacagccucuauucuucugugguaugcucagauccagccucacuggauugcggccagcaucauucucgaguuuuuccugaucgugcugcucauccccgaacccgagaagcaaagaaccccucaggacaaccagcuuaccuacgucgugauugcuauccugacaguuguggccgccaccauggcuaaugaaaugggcuuucuggagaaaacaaagaaagaccucgggcugggauccauugccacgcagcaaccggagagcaacauccuugauauugaccugcgccccgcgucugccuggacccucuacgcuguggccacaaccuucgucacaccuaugcugcggcauuccaucgaaaauagcuccguuaacgugucucugaccgcuauugccaaucaggcgacggugcucaugggccuugggaagggauggccccugagcaaaauggauaucggcgucccucugcucgccaucggguguuauucccaggugaaccccauuacccugacagcugcccuucugcuccugguugcucacuacgccaucauuggaccuggccugcaggcuaaggccaccagagaggcgcaaaagcgggccgcugccggcaucaugaaaaauccgacaguggacgggauuaccgucaucgaucucgaccccaucccuuaugaucccaaguuugaaaaacagcuuggacaggugaugcugcugauucucugcgucacgcaagugcugaugaugcgcacaaccugggcucuuugugaggcccugacacucgccaccggcccuaucucuacccugugggaagggaaccccggaagauucuggaauacaacgauugcgguuagcauggcuaacaucuuucggggcuccuaccuggccggggcuggacuccuuuucagcauuaugaagaauaccacaaacacccgcagaggcacaggcaacaugggggagacccugggagagaaauggaagucucggcugaaugcccucggcaaauccgaauuucagaucuauaaaaagagcgggauccaggagguggaccgcacgcuggccaaagaaggaauuaagagaggcgagacagaucaccaugcugucucucggggguccgccaaacuucgcugguucguggagagaaacaugguuaccccggaaggaaagguggucgaccugggcugcggcagagggggauggagcuacuauuguggcgggcucaaaaaugugcgggaggugaagggacugaccaagggcgggccuggacacgaagaacccauccccaugucuacauacggcuggaaccugguucgccuccagagcggcgucgauguguuuuucauuccucccgaaaaaugcgacacccuucugugugauaucggggaguccucuccuaauccgacaguggaggcgggacggacgcugagaguccucaaccugguugaaaauuggcuuaacaauaacacccaauucugcauuaaggugcugaaucccuacaugccuagcgugaucgagaaaauggaagcccuccagcgcaaguauggcggggcucugguccggaacccccuguccagaaauagcacacaugagauguacuggguguccaacgccucuggaaauaucguuagcuccgugaacaugauuucucgcaugcucaucaaccgguuuaccaugagacacaaaaaggcuacauaugaaccugacgucgaccuuggcagcgggacccgcaauauuggaaucgaguccgagauucccaaccuggauaucauuggcaagcggaucgagaagaucaagcaggagcaugaaacgucuuggcacuacgaccaggaucacccguauaaaaccugggccuaccauggcagcuaugagacaaagcaaaccggguccgcgagcucuauggugaauggaguugugagacugcucacaaaaccuugggacguccugcccaccgugacacagauggccaugaccgauacgacaccuuucggccagcagcgcguguuuaaggaaaaggucgacacccggacccaagagcccaaagaggggacaaagaaacuuaugaagauuacggcugaauggcuguggaaagagcucggaaagaaaaagaccccuagaauguguacacgcgaagaguucaccagaaagguucgguccaacgccgcucugggcgccaucuuuacagaugagaauaaauggaaaagcgcucgcgaagccguggaggacucuagauucugggaacugguggauaaagagcggaaccuccaccuggaagggaagugcgagaccugugucuacaauaugaugggaaaaagagagaagaaacuuggcgaauuuggcaaagcgaaggggucccgggccauuugguacauguggcugggagcucgcuuccucgaguuugaagcccugggcuuccuuaacgaggaccauugguuuagcagagaaaauucucuguccgggguggagggagagggccuccacaaacugggguauauccugcgggauguuagcaagaaagaaggcggagcuauguacgccgacgacacagccggcugggauacccgcauuacgcucgaggaccugaagaacgaagagauggugaccaaucacauggaaggggagcauaagaaacuugcggaggcuaucuucaagcugacauaucagaacaaagucgugagaguucagcggcccaccccgcgcggaacagugauggauaucauuuccagacgggaccaacgcggcagcgggcaggucggaaccuacggccucaauacguuuacaaacauggaagcccagcugaucagacagauggagggggaaggcguguucaagaauauucaacaccuuaccguuacagaggagguggccgucaaaaacuggcuggcucgggugggacgcgaaagacucucucggauggccaucagcggcgaugacugcgucgugaagccucuggaugaccgcuucgcuaacgcccugaccgcgcucaaugauauggggaagauuagaaaagacauccagcagugggagcccuccaagggauggaacgauuggacgcagguucccuuuugcucucaucacuuccaugaacugaucaugaaagacggccgggugcuugucgugccuuguagaaaucaagaugagcugauugggcgcgcccggaucagccagggagcuggcuggucccucagagaaaccgccugccuggggaagucuuaugcucagauguggagccuuauguacuuucaccgccgggaccugagacucgccgcgaacgccauuuguuccgcugugccgucucacuggguucccacaagccgcaccacaugguccauccaugccaaacacgaguggaugaccacagaggacaugcugaccguguggaaucgggucuggauuagagaaaacccuuggauggaggauaagacgcccguggaaagcugggaggaaaucccuuaucugggcaagcgcgaggaccaguggugcggaucucucauuggccugacaucccgggcuaccugggccaaaaauauccaagcugccaucaaccagguuagaagccuuauugggaaugaggaauacgcggauuacaugcccucuaugaagcgcuuccggagagaggaagaggaagccggagugcugugguga

SEQ ID NO: 20039 - RNA, 9876 nt, Artificial Sequence
  derived and/or modified CDS sequence (opt5) from DENV-2__EU569721__SS-prME
agcgccggaaugaucaucaugcugauccccaccgugauggcuuuccaccugaccacgagaaauggggagccucauaugauugucggaauccaggaaaagggcaaaucccugcuuuuuaagaccgaggacgggguuaauaugugcacccugauggccauggaucucggagaacugugugaggacaccauuaccuacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucggcggggucuuuacauccaucgggaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucagagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccaacagaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacaacgggcuggagugcugugggauguuccuagcccccucccuaugggcaaggcggaacuggaggacggggccuaucgcauuaaacagaagggaauccuuggcuacucccagaucggcgcugggguguacaaggaaggaaccuuccacacaauguggcaugucaccagaggcgccgugcugaugcacaaagggaagcggauugagcccucuugggccgauguuaaaaaggaccucaucagcuauggaggcggguggaaacuggagggagaauggaaggagggcgaagaggugcagguccucgcucuggaacccggcaagaauccucgcgccgugcaaacaaaaccggggcuuuuuaagaccaacacgggaaccauuggcgcggugucccuggauuucucucccgggacaagcggauccccuaucauugacaaaaagggcaaaguugucgggcuguacggaaacggcguggugaccagaagcggcgcuuaugucucugccaucgcccagacagagaaguccaucgaggauaaucccgaaauugaggacgauaucuuucggaagaaacgccucaccauuauggaccugcacccuggggcuggaaagacaaaaagauaccuucccgccaucgugcgggaagcgauuaagagaggccugcgcacgcucauccuggcuccuacccggguuguggccgccgagauggaagaggcucucagagggcugccgauucgcuaucagacacccgccauccgggcugagcauaccggaagagaaaucgucgaccuuaugugucacgccaccuucacaaugcgccugcugagcccugugcggguucccaacuacaaucucauuaucauggaugaggcgcauuucacggacccugccucuauugcugccagaggcuauaucuccacccgcguggaaaugggggaggcugccggcauuuuuaugacagccacacccccgggaagccgggauccuuucccccaauccaacgcucccaucaucgacgaggaaagagagauuccugaacggucuuggaauagcggccacgagugggucacagauuuuaaagggaagaccgugugguucguucccuccaucaaggcgggaaacgacauugccgcuugccugcgcaaaaauggcaagaaagugauccagcuuagcagaaagacguuugauucugaauacgucaaaacacggaccaacgacugggauuucguggugaccacagacauuuccgagaugggggccaauuuuaaggccgagcgcgucaucgauccuagacgguguaugaaaccgguuauccugaccgacggagaagagagagugauucucgcuggccccaugccugugacacauagcucugccgcgcagcgccgggggagaaucggccgcaaccccaagaaugaaaacgaccaguacauuuauaugggagagccucuggaaaaugaugaggacugcgcucacuggaaggaggccaaaaugcugcucgauaacaucaauacccccgaaggcauuaucccgagcauguucgagccugaacgggagaaggucgacgccauugauggggaauacagacuucgcggagaggcucggaaaacguuuguggaccugaugagacgcggcgaucugcccguuuggcucgccuauaagguggcggccgaggggaucaacuacgcugacagacggugguguuucgauggaaucaaaaacaaucaaauucuggaagagaacgucgaaguggagaucuggacaaaggagggcgaacgcaagaaacuuaagccuagauggcuggacgcccggauuuauuccgauccccucgcucugaaagaguuuaaggaguucgccgcugggcgcaaaucucugacccucaaucuuaucacagagaugggcagacugccuaccuucaugacgcagaagacccgggacgcccuggauaaccucgcgguucugcacacagccgaagcuggaggcagagccuacaaucaugcucuuagcgagcugcccgagacccucgaaacacugcugcuccuuacccugcuggccacagugaccgggggaauuuuucucuuccugauguccggccgcgggaucggaaagaugacgcuuggcaugugcugcaucauuacagccucuauccugcucugguaugcucagauucagccgcacuggaucgcggccagcauuauccuggaguuuuuccugaucguccuccuuauuccugaacccgagaaacaacggacaccccaggacaaccagcugaccuacguggucaucgcuauucugacagugguugccgccaccauggcuaaugaaaugggcuuucucgagaagaccaaaaaggaccuggggcuuggauccaucgccacgcagcaaccugagagcaacauucuggauaucgaccucagaccggcgucugccuggacccuguacgcuguggccacaaccuucgugacacccaugcugcgccauuccauugaaaauagcuccgucaacguuucucucaccgcuaucgccaaucaggcgacggugcuuaugggccuggggaaaggauggccucugagcaagauggauaucggcgugccccuccuggccauuggguguuauucccaggucaacccuaucacccuuacagcugcccugcuccugcugguggcucacuacgccauuaucggacccggccuccaggcuaaggccacccgggaggcgcagaaacgggccgcugccggcauuaugaagaauccuacaguugacgggaucaccgugaucgaucuugacccgauucccuaugauccuaaauuugaaaagcagcugggacaggucaugcugcucauccugugcgugacgcaaguccuuaugaugcggacaaccugggcucugugugaggcccucacacuggccaccggccccauuucuacccugugggaagggaacccuggacgcuucuggaauacaacgaucgcggugagcauggcuaacauuuuuagaggcuccuaccucgccggggcuggacuucuguucagcaucaugaaaaauaccacaaacacccggcgcggcacaggcaacaugggggagacccugggagagaaguggaaaucuagacucaaugcccugggcaaguccgaauuucagaucuauaagaaaagcgggauucaggagguugaccggacgcuugccaaggaaggaaucaaacgcggcgagacagaucaccaugcugugucuagaggguccgccaagcugcggugguucgucgagcgcaacauggugacccccgaaggaaaaguuguggaccucggcugcggcagagggggauggagcuacuauuguggcgggcugaagaauguccgggaggugaagggacugaccaaaggcgggccgggacacgaggaaccuauucccaugucuacauacggcuggaaccucgugagacuucagagcggcguugaugucuuuuucauucccccugaaaagugcgacacccugcugugugauauuggggaguccucucccaauccuacaguggaggcgggacgcacgcuccgggugcugaaccuugucgaaaauuggcugaacaauaacacccaauucugcaucaaaguucucaauccguacaugcccagcgugaucgagaagauggaagcccugcagagaaaauauggcggggcucuggugcgcaacccucucucccggaauagcacacaugagauguacugggucuccaacgccucuggaaauauugugagcuccguuaacaugaucucuagaaugcuuauuaaccgcuuuaccaugcggcacaagaaggcuacauaugaacccgacguggaccugggcagcgggaccagaaauaucggaauugaguccgagacgccuaaccuggauaucauuggcaaacgcaucgaaaagaucaaacaggagcaugaaaccucuuggcacuacgaccaggaucaccccuauaagacaugggccuaccauggcagcuaugagaccaaacaaacaggguccgcgagcucuauggucaauggagugguucggcuccugaccaagccgugggacgugcuuccuacagucacccagauggccaugacggauacaacccccuucggccagcagagaguguuuaaggaaaaaguggacacccgcacacaagagccuaaggaggggacgaaaaagcugaugaaaauuaccgcugaauggcucuggaaggagcugggcaaaaagaagacaccccggauguguaccagagaagaguucacacgcaaagucagauccaacgccgcucugggcgccaucuuuaccgaugagaauaaguggaaaagcgcucgggaagccguugaggacucucgcuucugggaacucguggauaaggagagaaaccugcaccuugaagggaaaugcgagacauguguguacaauaugaugggaaagcgggagaagaaacugggcgaauuuggcaaggcgaaaggguccagagccauuugguacauguggcucggagcucgguuccuggaguuugaagcccuuggcuuccugaacgaggaccauugguuuagccgcgaaaauucucucuccggggucgagggagagggccugcacaagcugggguauauccucagagaugugagcaaaaaggaaggcggagcuauguacgccgacgacaccgccggcugggauacgcggauuacccuggaggaccuuaagaacgaagagaugguuacaaaucacauggaaggggagcauaaaaagcuggcggaggcuaucuucaaacucaccuaucagaacaaggugguccgcgugcagagaccuacaccccggggaaccguuauggauaucauuucccgcagagaccaacggggcagcggacaggugggaacguacggccugaauacauuuaccaacauggaagcccagcuuauccgccagauggagggggaaggcgucuucaaaaauauucaacaccugacagugaccgaggagguugccgugcagaacuggcucgcuagagucggacgggaacgccugucuagaauggccaucagcggcgaugacugcguggucaagccgcuggaugaccgguucgcuaacgcccucacggcgcugaaugauauggggaagauucgcaaagacauccagcagugggagccuuccaagggauggaacgauuggacccaagugcccuuuugcucucaucacuuccaugaacuuaucaugaaagacggcagaguucuggugguccccugucggaaucaggaugagcucauugggagagcccgcaucagccagggagcuggcuggucccugcgggaaacagccugccuugggaagucuuaugcucagauguggagccugauguacuuucacagacgcgaccuccggcuggccgcgaacgccauuuguuccgcugugccuucucacugggugccgaccagcagaacaaccugguccauccaugccaaacacgaguggaugacaaccgaggacaugcugacgguuuggaaucgcguguggauucgggaaaaccccuggauggaggauaagacaccugucgaaagcugggaggaaauccccuaucucggcaagagagaggaccaauggugcggaucucugauuggccuuaccucccgcgcuaccugggccaaaaauauccaggcugccaucaaccaggugcggagccugauugggaaugaggaauacacagauuacaugccuucuaugaagagauuccgccgggaggaagaggaagcgggaguucucugguga

SEQ ID NO: 20040 - RNA, 9876 nt, Artificial Sequence
  derived and/or modified CDS sequence (opt5) from DENV-2__EU482451__SS-prME
agcgccggaaugaucauuaugcugauccccaccgugauggcuuuccaccucacaacgagaaacggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacaggggcggagcugaccggauauggcacgguuaccauggaauguucucccagaacagggcuugauuucaaugagauggugcugcuccaaauggaaaacaaggccuggcugguccaccggcagugguuucuugaccugccgcucccuuggcugcccggagcugauaagcaggaguccaauuggauucagaaagagacccuggugacauucaagaacccucaugccaaaaagcaagacguugugguccucggcagccaggaaggggcuaugcacaccgcccugacgggcgccacagagauccagauguccucuggaaaucuucuguuuaccggccaucucaaaugccgccugagaauggacaaacuucaacugaaggggaugagcuacuccauguguacaggaaaauucaagguggucaaagaaauugcugagacccagcacggcaccaucgugauucggguucaguaugagggggauggaagccccugcaagauccccuucgaaaucauggaccucgagaaaagauacgugcugggccgccugauuacagucaacccuaucgugacggaaaaggauucuccgguuaacauugaggcggaacccccuuuuggggacuccuacaucauuaucggcguggagcccggacagcucaagcugaauugguucaaaaagggcagcucuauugggcaaauguuugagaccacaaugcggggagccaaaagaauggcuauccuuggcgauaccgccugggacuucgggagccugggaggcgucuuuacauccaucgggaaggcccuccaucagguguucggcgcuauuuauggagccgcguuuucuggcgugagcuggaccaugaaaauccugauugggguuaucauuacguggaucggaaugaacucccgcagcacaucucuguccgucagccuugugcucgugggcaucgucacccuguaccugggggugaugguucaggcugauucuggauguguggucuccuggaagaauaaggaacucaaaugcggcagcgggauuuucgugaccgacaacguucacacauggaccgagcaguauaaguuucaaccugaaucccccucuaaacuggccagcgccauccagaaggcucaggaggaaggcauuuguggaauccgguccgugacaagacuugagaaucugauguggaaacagauuacgccggagcucaaccacauccuggccgaaaaugaggucaagcugaccaucaugacaggcgauauuaaagggaucaugcaagcuggaaagcgcucucuucggccucagcccaccgaacucaaguacagcuggaaaacauggggcaaggccaaaaugcuguccaccgagagcuauaaccagacguuccugauugacgggccugaaaccgcggagugccccaauacaaacagagccuggaacucucucgagguggaagauuacggauuuggcguuuucaccacaaacaucuggcugaaacuuaaagagaagcaggacgcuuuuugugacuccaagcugaugagcgccgcuauuaaagauaaucgcgccgugcaugcggacaugggcuauuggaucgaaucugcccucaacgauaccuggaagaucgagaaggcuagcuucauugaggucaagaauugccacuggccuaaaagccauacacuguggucuaacggggugcuggaaagcgagaugaucauucccaagaaccuugccggaccggugucccaacacaauuaccggccuggcuaccacacccagaucgcugggcccuggcaucucggaaagcuggaaauggacuucgauuuuugugacggcacgacagucauuguuaccgaggauugcgggaacagaggacccagccugcgcaccacaaccgccucuggcaaacucaucacggaauggugcugucgguccugcacacugccuccgcuuagauaucggggcgaggacggguguugguacggaauggagauucgcccccugaaggaaaaagaggaaaaucucgugaacagccuggugaccgccggccacgggcaggucgauaauuucucccugggagugcuuggcauggcucucuuucuggaggaaaugcugagaacacggguugggaccaagcaugcgauccuccugguggccgucucuuucgugacacuuaucaccggaaacaugagcuuuaaagaccugggcagaguuguggucauggugggcgcuacgauggccgaugacauugggaugggaguuaccuaucucgcccugcuggcugccuucaaggugcgcccuacauuugcggcuggccuucugcuccggaagcugaccuccaaagagcucaugaugacaaccaucgggauuguccugcuuucucaaagcacgauccccgagacagugcuggaacucaccgaugcccuggcccugggaaugauggugcuuaagauugucagaaauauggagaaauaccagcuggcuguuacaaucauggccauccucugcgugccuaacgcggugauucugcagaaugcuuggaaggucuccuguaccauccucgccgugguuucugugagcccccugcuucugaccuccagccagcagaagaccgacuggauuccucucgcccugacgaucaagggccugaaccccaccgcuauuuuccuuacaacccugucucgcacaaauaaaaagagauccuggccgcucaacgaagccaucauggcugucgggauggugagcauccuggccucuucccuccugaagaaugacauuccuaugaccggaccccuuguugcgggcggccugcugacggugugcuauguccucacagggcggagcgccgaucuggagcuugaacgcgcuaccgacgugaaaugggaggaucaggccgagaucucuggauccagcccuauucuguccaucaccauuagcgaagacggcucuaugagcaucaagaacgaggaagaggagcagacacucaccauucugaucagaacagggcuccuggucaucuccggacuuuuucccauuucuaucccgauuacggcugccgccugguaccugugggaagugaaaaagcagcgggcuggcguucugugggaugugccuucucccccucccauggggaaagcggagcucgaagacggagccuaucgcaucaagcaaaagggcauucugggcuacucccagaucggggcuggagucuacaaagagggcaccuuccacacaauguggcaugugaccagaggggccguucuuaugcacaagggaaaacggaucgaacccuccugggccgaugugaagaaagaccugauuagcuauggcgggggauggaagcucgagggcgaguggaaggaaggcgaggaaguccaggugcuggcucucgagccugggaaaaauccgcgcgccgugcagacaaagcccggacuguuuaaaaccuccacgggcaccaucggggcgguuucucuugauuucagcccuggaacauccggcagccccauuaucgacaagaaagggaaggucgugggacuguacggcaacggcguggucaccagaucuggggcuuauguguccgccauugcccaaacagaaaagagcaucgaggauaacccugagaucgaagacgauauuuuucggaaacgcagacugaccaucauggaccuccaccccggagcuggcaagacaaaacgguaccugccugccauuguuagagaggcgaucaagcgcgggcuucggacgcugauucucgcuccgaccagaguggucgccgccgaaauggaggaagcucugcgcggacuccccauccgguaucagaccccugccauuagagcugagcauaccggccgcgagaucguggaccugaugugucacgccaccuucacaaugcggcuucugucucccguuagagugccuaauuacaaccugaucauuauggaugaagcgcauuucacggaccccgccuccaucgcugcccgcggguauauuagcacccgggucgagaugggcgaagcugccggaaucuuuaugacagccaccccgccuggcuccagagaucccuucccccagucuaaugcuccuauuaucgacgaggagcgggaaauccccgagcgcagcuggaacuccgggcacgaaugggugacagauuuuaaaggaaagaccguuugguucgugccuagcauuaaggcgggcaaugacaucgccgcuugccuccgcaagaaugggaagaaagucauucaacugucucggaagacguuugauuccgaguacgugaaaacaaagaccaaugacugggauuucguggucaccacagacaucagcgaaaugggagccaacuuuaaagccgagcgcguuauugauccgagacgguguaugaagcccgugauccuuaccgacggcgaggaaagagugauccuggcugggccuaugcccgucacacauucuagcgccgcgcagcgccggggcagaauuggacgcaauccuaagaacgagaaugaccaguacaucuauaugggcgaaccccucgagaacgaugaagacugcgcucacuggaaagaggccaagaugcugcuggauaauauuaacaccccggaggggaucauuccuuccauguucgaacccgagcgggaaaaaguggacgccaucgauggagaguacagacuccgcggcgaagcucggaagacguuuguugaccuuaugagacgcggggaucugccuguguggcuggccuauaaagucgcggccgagggaauuaauuacgcugacagacggugguguuucgauggcaucaagaacaaccagauccucgaggaaaauguggagguugaaauuuggacaaaggagggggagcgcaaaaagcugaaacccagauggcuugacgcccggaucuauucugauccucuggcucucaaggaauuuaaagaguucgccgcuggccgcaagagccugacccugaaccucauuacagaaaugggaagacuucccaccuucaugacgcaaaagacccgggacgcccuggauaaucuggcggugcuccacacagccgaggcuggcgggagagccuacaaccaugcucuguccgaacuuccggagacccuggagacacuccugcugcucacccuucuggccacagucaccggaggcaucuuucuguuccucaugucugggcgcggaauuggcaaaaugacgcugggcaugugcugcaucaucacagccagcauucuucugugguaugcucagauccagccucacuggauugcggccuccaucauucucgaauuuuuccugaucgugcugcucauccccgagcccgaaaagcagcggaccccucaagacaaucagcuuaccuacgucgugauugcuauccugacaguuguggccgccaccauggcuaacgagaugggguuucuggagaagacaaagaaagaccucggacugggcagcauugccacgcagcagccggagucuaauauccuugauauugaccugagacccgcguccgccuggacccucuacgcuguggccacaaccuucgucacaccuaugcugcgccauagcaucgagaacuccucuguuaaugugagccugaccgcuauugccaaccaagcgacggugcucauggggcuuggaaagggcuggccccuguccaagauggauaucggggucccucugcucgccaucggauguuauucucaggugaaucccauuacccugacagcugcccuucugcuccugguugcucacuacgccaucauuggcccuggccugcaggcuaaagccacccgggaagcgcagaagagagccgcugccgggaucaugaaaaacccgacaguggacggaauuaccgucaucgaucucgaccccaucccuuaugaucccaaguuugagaaacaacuuggccaggugaugcugcugauucucugcgucacgcagguccugaugaugcggacaaccugggcucuuugugaagcccugacacucgccaccgggccuaucagcacccugugggagggaaaucccggccgcuucuggaacacaacgauugcgguuuccauggcuaauaucuuuagagggagcuaccuggccggagcuggccuccuuuucucuauuaugaagaacaccacaaauacccggcgcggcacagggaacaucggagaaacccugggcgagaaauggaaguccagacugaacgcccucggaaagagcgaguuucaaacguauaaaaagucuggaauccaggaaguggaccggacacuggccaaagagggcauuaagcgcggggaaaccgaucaccaugcugucuccagaggaagcgccaaacuucggugguucguggagcgcaauaugguuaccccggagggcaagguggucgaccugggcugcgggagaggaggcuggucuuacuauugugggggacucaagaacgugcgggaagugaaaggccugacaaaaggcgggccugggcacgaggaacccauccccaugagcaccuacggcuggaaucugguuagacuccaguccggggucgauguguuuuucauuccucccgagaaaugcgacacacuucugugugauaucggagaaucuagcccuaacccgacgguggaggcgggccgcacccugcggguccucaaucugguugagaacuggcuuaauaacaauacacaguucugcauuaaggugcugaaccccuacaugccuuccgugaucgagaaaauggaggcccuccaaagaaaguaugggggagcucugguccgcaauccccugagccggaacuccacccaugaaauguacugggugucuaaugccagcggcaacaucguuuccucugugaauaugauuagcagaaugcucaucaaccgcuuuacaaugcggcacaagaaagcuaccuaugagccugacgucgaccuuggguccggaacgagaaacauuggcaaugaaucugagauccccaaccuggauauuaucggcaagcgcauugagaaaaucaagcaggaacaugagaccagcuggcacuacgaccaggaucacccguauaaaacaugggccuaccauggguccuaugaaaccaagcagacaggaagcgcgucuuccauggugaauggcguugugcggcugcucaccaagccuugggacguccugcccacagugacccaaauggccaugacggauacaaccccuuucgggcagcagagaguguuuaaagagaaggucgacacccgcacacaggaacccaaagagggaacgaagaaacuuaugaagaucaccgcugaguggcuguggaaagaacucggcaagaagaaaacaccucggauguguaccagagaggaguucacacgcaagguuagaagcaacgccgcucugggggccauuuuuaccgaugagaauaaauggaagucugcucgggaggccguggaagacucccgcuucugggagcugguggauaaagaaagaaaccuccaccuggagggaaagugcgaaacaugugucuacaauaugaugggcaagcgggagaagaaacuuggcgaguuugggaaagcgaaaggaagcagagccaucugguacauguggcugggcgcucgguuccucgaauuugaggcccugggguuccuuaacgaagaccauugguuuucucgcgaaaauucccugagcggaguggaaggcgaggggcuccacaaacugggcuauauucugagagauguuuccaagaaggagggaggcgcuauguacgccgacgacaccgccgggugggauacgcggaucacccucgaagaccugaaaaacgaggaaauggugacaaaucacauggagggagaacauaagaaacuugcggaggcuauuuucaagcugaccuaucaaaacaaagucgugcgcguucagagacccacaccgcggggcaccgugauggauaucaucagccgcagagaccagcgggggucuggacaagucggcacguacgggcucaauacauuuaccaacauggaggcccagcugauucgccagauggaaggcgagggaguguucaagaauauccagcaccuuacaguuaccgaagagguggccguccaaaacuggcuggcuagagugggccgggagcgccucagcagaauggccauuuccggggaugacugcgucgugaagccucuggaugaccgguucgcuaacgcccugacggcgcucaaugauaugggaaaaauccgcaaggacauucagcagugggaacccucuaaaggcuggaacgauuggacccagguucccuuuugcagccaucacuuccaugagcugaucaugaaggacgggagagugcuugucgugccuugucggaaucaagaugaacugaucggcagagcccgcauuucccagggcgcuggguggucucuccgggagacagccugccugggcaaaagcuaugcucagauguggucccuuauguacuuucacagacgcgaccugcggcucgccgcgaacgccaucuguucugcugugccgagccacuggguucccaccuccagaacaaccuggagcauucaugccaagcacgaauggaugacaaccgaggacaugcugacgguguggaaucgcgucuggauccgggagaacccuuggauggaagauaagacacccguggagucuugggaagagauuccuuaucugggaaaaagagaagaccaguggugcggcucccucaucgggcugaccagccgcgcuaccugggccaagaauauucaaguugcuaucaaccaggugcggucucuuaucggaaaugaggaguacacagauuacaugcccuccaugaaaagauuccgccgggaagaggaagaggccggcguccugugguga

SEQ ID NO: 20041 - RNA, 9876 nt, Artificial Sequence
  derived and/or modified CDS sequence (opt5) from DENV-2__EU660413__SS-prME
agcgccggaaugaucauuaugcugauccccaccgucauggcuuuccaccucaccacgcggaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggcuucgauuuuaaugaaauggugcuucugcaaauggagaacaaggccuggcucguccaccggcagugguuccuggaccuuccgcugccuuggcuccccggggcugauaagcaggaguccaauuggauucagaaagaaacccuggugacauuuaagaacccucaugccaaaaagcaagacguugugauccugggaagccaggagggcgcuaugcacaccgcccucacgggggccacagaaauucagauguccucuggcaaucugcuuuucaccggacaucugaaaugccgccucagaauggacaagcugcaacuuaagggcaugagcuacuccauguguacagggaaauucaaggucgugaaagagaucgcugagacccagcacggaaccauugucauccgggugcaguaugaaggcgaugggagccccugcaagauccccuuugagauuauggaccuggagaagcgguacguucucggacgccugaucacagugaacccuauugucacggagaaggauucuccggugaacaucgaagcggagcccccuuucggcgacuccuacauuaucauugggguugagcccggccagcugaagcucaauugguuuaaaaagggaagcucuaucggccaaauguucgaaaccacaaugagaggggccaaaagaauggcuauccugggagauaccgccugggacuuuggcagccuugggggaguguucacauccauuggcaaggcccugcaucaggucuuuggggcuaucuauggcgccgcguucucuggagugagcuggaccaugaaaauucucaucggcgugauuaucacguggaucgggaugaacucccgcagcacaucucuguccguuagccugguccuugugggaauugugacccucuaccugggcgucauggugcaggcugauucuggguguguuguguccuggaagaauaaggagcugaaaugcggaagcggcaucuuuauuaccgacaacguccacacauggaccgaacaguauaaguuccaaccugagucccccucuaaacucgccagcgccauccagaaggcucaggaagaggggauuuguggcauccgguccgugacaagacuggagaaucuuauguggaaacagaucacgccggaacugaaccacauucucgccgagaaugaaguuaagcugaccaucaugacaggagauauucgcggcaucaugcaagcugggaaacggucucugagaccucagcccaccgagcuuaaguacagcuggaagacauggggaaaagccaagaugcucuccaccgaaagcuauaaccagacguuucugauugacggcccugagaccgcggagugccccaauacaaaccgcgccuggaacucucuggaaguggaggauuacggguucggagucuuuaccacaaacaucuggcucaaacugaaggaaaaacaggacgcuuucugugacuccaaacuuaugagcgccgcuaucaaggauaaucgggccgugcaugcggacaugggcuauuggauugagucugcccugaacgauaccuggaaaaucgagaaggcuuccuucauugaaguuaaaaauugccacuggccuaagagccauacacucuggucuaacggcgugcuggagagcgaaaugaucauucccaaaaaccuggccgggccggucucccaacacaauuacagaccuggauaccacacccagaucgcuggccccuggcaucuugggaagcucgagauggacuuugauuucugugacggaacgacagugauugugaccgaagauugcggcaaccgcgggcccagccugcggaccacaaccgccucuggaaagcugaucacggaguggugcuguagauccugcacacucccuccgcugcgguaucgcggcgaggacggcuguugguacgggauggaaaucagaccccuuaaagagaaggaagagaaucuggucaacagccucguuaccgccggacacggccagguggauaauuuuucccugggggugcugggaauggcucuuuuccucgaagagaugcugcggacaagagucggcaccaaacaugcgauucugcucguggccguuucuuuugugacacugaucaccgggaacaugagcuucaaggaccuuggacgcgucgugguuauggugggcgcuacgauggccgaugacauuggcaugggggucaccuaucuggcccuccuggcugccuuuaaagugcggccuacauucgcggcuggacugcuucugagaaagcucaccuccaaggagcugaugaugacaaccaucggcauuguucuccugucucaaagcacgauccccgaaacagugcuugagcugaccgaugcccucgcccuggggaugaugguccugaaaaucgugcgcaauauggaaaaguaccagcuugcugugacaauuauggccauccugugcgucccuaacgcgguuauucuccagaaugcuuggaaaguguccuguaccauccuggccguggucucugugagcccccuccugcuuaccuccagccagcaaaagacagacuggauuccucuggcccucacgaucaaaggacugucucccaccgcuaucuuucugacaacccuuuccagaagcaacaagaaacggucuuggccgcugaaugaggccauuauggcuguuggcaugguguccauccucgccagcucucugcucaagaacgacauuccuaugacagggccccuggucgcgggaggccuucugaccgugugcuauguucugacgggccgcuccgccgaucucgaacuggagagagcuacagacgugaagugggaggaucaggccgaaaucagcggguccagcccuauucuuucuaucaccauuagcgaggacggauccaugucuaucaaaaaugaagaggaggaacagacccugacaauccucauucggaccggccugcucgucaucagcgggcuguuccccauuuccaucccgauuacagcugccgccugguaccuuugggaggugaagaaacagcgcgcuggaguccugugggaugugccuucucccccucccaugggcaaggcggaacuggaggacggggccuauagaaucaaacaaaagggaauccucggcuacagccagauuggcgcugggguuuacaaggaaggaacguuucacaccauguggcaugugacacggggcgccguccugaugcacaaagggaagcgcaucgagcccuccugggccgaugugaaaaaggaccuuauuucuuauggaggcggguggaaacuggagggagaauggaaggagggcgaagagguucaggugcucgcucuggaaccuggcaagaacccgagagccguccagaccaaacccggacucuucaagacaaauaccggaacgaucggcgcggugagccuggauuuuuccccugggaccagcggaucucccauuaucgacaaaaagggcaaagugguugggcuuuacggaaacggcgucgugacacgguccggcgcuuaugugagcgccaucgcccaaaccgagaagucuauugaggauaacccugaaaucgaggacgauauuuuccgcaagagacggcugacaaucauggaccugcaccccggggcuggaaaaaccaagagauaccucccugccauuguccgcgaagcgaucaaacggggccugagaacacuuauucuggcuccgacgcgcgugguugccgccgagauggaagaggcucuccgggggcugcccaucagauaucagaccccugccauccgcgcugagcauacaggacgggaaauuguggaccucaugugucacgccaccuucaccaugagacugcuuucccccguccgcgugccuaauuacaaccugaucauuauggaugaggcgcauuuuacagaccccgccagcaucgcugcccggggcuauauuuccacgagaguugaaaugggggaggcugccggcaucuucaugaccgccacaccgccuggaucucgggaucccuuuccccagagcaaugcuccuaucauugacgaggaacgcgagauccccgaaagauccuggaacagcggccacgagugggugaccgauuucaaggggaaaacagucugguuugugccuucuauuaaggcgggaaaugacaucgccgcuugccugcggaagaacggcaaaaagguuauucaacucucccgcaaaaccuucgauagcgaauacgugaagacgagaacaaaugacugggauuuugucgugaccaccgacaucucugagaugggggccaacuucaaagccgagcgggugaucgauccgagacgcuguaugaagcccgucauucugacagacggagaagaacggguuauccuugcuggcccuaugcccgugacccauagcuccgccgcgcagagacgcgggcggauuggcagaaauccuaaaaacgaaaaugaccaguacaucuauaugggagagccccuggaaaacgaugaggacugcgcucacuggaaggaggccaagaugcuccuggauaauauuaacacaccggaaggcaucauuccuucuauguuugagcccgaacgcgagaaaguggacgccaucgauggggaauaccggcugagaggagaggcucgcaagaccuucgucgaccucaugagacggggcgaucuuccuguguggcuggccuauaaaguugcggccgaggggaucaauuacgcugaccgcagaugguguuuugauggaauuaagaacaaccagauccuggaagagaauguggaagucgagauuuggacgaaagagggcgaacggaagaagcucaaaccccgcuggcuggacgccagaaucuauagcgauccucuugcucugaaggaguucaaagaguucgccgcugggcggaagucccucacacugaaccugauuaccgagaugggcagacuccccacauuuaugacccagaagacgcgcgacgcccuugauaaucuggcggugcugcacaccgccgaagcuggaggccgggccuacaaccaugcucucucugagcugccggagacacuugaaacccugcuccugcugacacuccuugccaccguuacagggggaaucuuccuguuucugaugagcggcagagggaucggaaagaugacccucggcaugugcugcauuaucacggccuccauucugcuuugguaugcucagauccagccucacuggauugcggccagcaucauccuggaguucuuucucauugugcugcugauccccgaacccgagaagcagcgcacaccucaagacaaucagcucaccuacgucgugauugcuauccuuaccgucguggccgccacaauggcuaacgaaaugggcuuccuggagaaaaccaagaaagaccuggggcucggaggcauugccacacagcagccggagucuaauauccuggauauugaccuucggcccgcguccgccuggacgcuguacgcuguugccaccacauuugugaccccuaugcucagacauagcaucgaaaacuccucugugaaugucagccugacagcuaucgccaaccaagcgaccguucugauggggcucggaaagggcuggccccuuuccaaaauggauauuggggugccucugcuggccaucggauguuauucucaggugaaucccauuacgcucaccgcugcccugcuucugcucgucgcucacuacgccaucauuggcccuggccugcaggcuaaggccacacgggaggcgcagaagcgcgccgcugccgggaucaugaaaaacccgaccguggacggaaucacaguuauugaucuggaccccaucccuuaugaucccaaguucgaaaaacaacucggccaggugaugcuucugauucugugcgucacccaggugcucaugaugagaacgacaugggcucugugugaggcccuuacccuggccacagggccuaucagcacccucugggaaggaaaucccggccgguuuuggaacaccacaauugcggucuccauggcuaauaucuuccgcgggagcuaccuggccggagcuggccugcucuuuucuaucaugaagaacacgaccaauacaagacggggcaccgggaacauuggagagacacuuggcgagaaauggaagucccgccugaacgcccuggggaaaagcgaguuccaaaucuauaagaagucuggcauucaggagguggacagaacccucgccaaagaaggcaucaagagaggggaaacggaucaccaugcuguuucccgcggaagcgccaaacugagaugguuuguggagcggaauauggucacaccggaaggcaaggugguugaccuuggcugcgggagaggaggcuggucuuacuauugugggggacugaaaaacgugcgcgaggucaagggccucaccaaaggcgggccugggcacgaagaacccauucccaugagcaccuacggcuggaaucuggugcggcugcaguccgggguggauguuuucuucaucccucccgaaaaaugcgacacacuccuuugugauaucggagagucuagcccuaacccgaccgucgaggcgggcagaacacugcgcgugcugaaucucguggaaaacuggcugaauaacaauacgcaguuuugcauuaagguccuuaaccccuacaugccuuccguuaucgagaaaauggaagcccugcaacggaaguaugggggagcucucgugagaaauccccugagccgcaacuccacccaugagauguacugggugucuaaugccagcggcaacauugucuccucugugaauaugaucagccggaugcugauuaacagauucacaaugcgccacaaaaaggcuaccuaugaaccugacguugaccucggguccggaacacggaacaucggcauugagucugagaagcccaaucuugauaucaucggcaaaagaauugaaaagaucaaacaggagcaugaaaccagcuggcacuacgaccaggaucacccguauaagacgugggccuaccauggguccuaugagaccaaacagacaggaagcgcgucuuccauggugaacggcgucgugcgccugcugaccaagccuugggacguucuccccacagugacccaaauggccaugacagauaccacgccuuuugggcagcagcgggucuucaaggaaaaaguggacacaagaacccaggagcccaaggagggaaccaaaaagcugaugaaaauuacagcugaauggcuuuggaaggagcugggcaaaaagaagacgccucgcauguguaccagagaagaguuuacacggaaagugcgcagcaaugccgcucucggggccaucuucaccgaugagaacaaguggaaaucugcuagagaagccgucgaggacucccgguuuugggaacugguugauaaggagagaaaucugcaccucgaaggaaaaugcgagacauguguguacaacaugaugggcaagcgggagaagaaacugggcgaguucgggaaggcgaaaggaagccgcgccauuugguacauguggcuuggcgcuagauuucuggaguucgaagcccucggguuucugaaugaggaccauugguucucucgggaaaacucccuuagcggaguggagggcgaggggcugcacaagcucggcuauauccugcgcgaugucuccaaaaaggaaggaggcgcuauguacgccgacgacaccgccgggugggauacaagaaucacccuggaggaccucaagaaugaagagauggugacgaaccacauggaaggagagcauaaaaagcuggcggaggcuauuuuuaaacuuaccuaucaaaauaagguugugcggguccagcgccccacaccgagaggcaccgugauggauaucauuagccggcgcgaccagagagggucuggacaaguuggcacauacgggcugaacaccuucacgaauauggaagcccagcucauccggcagauggagggcgaaggaguguucaaaaacauucagcaccugacagucaccgaggagguggccguucauaauuggcuugcucgcgugggcagagaacggcugagccgcauggccaucuccggggaugacugcgucgugaagccucucgaugacagauuugcuaacgcccugacagcgcugaacgauaugggaaagauccggaaagacauucaacagugggagcccucuaagggcuggaaugauuggacccagguccccuucugcagccaccauuuucacgaacucaucaugaaagacgggagagugcugguugugccuugucgcaaccaggaugagcuuauuggacgggccagaaucucccaaggcgcuggguggucucugcgcgaaacggccugccucggcaagagcuaugcucagauguggucccugauguacuuccaccggagagaccuucgccuggccgcgaaugccauuuguucugcugucccgagccauugggugcccaccucccggacaaccuggagcauccacgccaaacaugaguggaugacaaccgaggacaugcucacaguguggaacagaguuuggauucgcgaaaauccuuggauggaggauaagacccccguggaaucuugggaggaaaucccuuaucugggaaagcgggaggaccaguggugcggcucccugaucgggcucacgagcagagcuacaugggccaaaaacauucaggcugccaucaaucaaguccgcucucugauuggaaacgaggaauacaccgauuacaugcccuccaugaagcgguuuagacgggaggaagaggaagcgggcgugcuuugguga

SEQ ID NO: 20042 - RNA, 9876 nt, Artificial Sequence
  derived and/or modified CDS sequence (opt5) from DENV-2__EU660414__SS-prME
agcgccggaaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggguucugcggcaucccggguucaccauuauggccgcuauccucgccuacacaauuggaaccacccacuuucagcgcgugcugaucuucauucuucugacagcugucgccccuuccaugacgaugagaugcaucggcauuucuaaccgggauuuuguggaagggguuagcggaggcuccuggguggacaucguccucgagcacgggagcugugugaccacaauggcgaagaauaagcccacccuggauuucgaacuuaucaaaacagaggccaagcagccugcuacccugcgcaaauauugcauugaagccaagcucacgaacacaaccaccgagucuagauguccgacacaaggagagcccucccugaaagaagaacaggacaagcgguuugugugcaagcauagcauggucgaucgcggcuggggcaauggguguggacuguucggcaaagggggaaucguuaccugcgcuauguuuacaugcaagaaaaacauggaaggcaagauugugcagccugagaaucucgaauacacgaucguggucacaccccacucuggggaggagcaugccgugggaaacgacacaggcaaacacggccaggaaauuaagguuaccccucaauccagcaucacagaggcggaacugaccggguauggaacggugaccauggaguguucucccagaacaggccuugauuucaaugaaaugguccugcuccagauggagaacaaagccuggcuggugcaccggcagugguuucuugaccugccgcucccuuggcugcccggggcugauaagcaggaguccaauuggauccaaaaggaaacccugguuacauucaaaaacccucaugccaagaaacaggacguggucgugcucggaagccaggagggcgcuaugcacaccgcccugacgggggccacagaaauucaaauguccucuggcaaucuucuguuuaccggacaucucaagugccgccugagaauggacaaacuucagcugaagggcaugagcuacuccauguguacagggaaguucaaagucgugaaggagaucgcugagacccagcacggaaccauuguuauccgggugcaguaugaaggcgaugggagccccugcaaaauucccuucgagaucauggaccucgaaaagagauacguccugggacgccugaucacagugaacccuauuguuacggagaaagauucuccggugaacaucgaagcggagcccccuuuuggcgacuccuacauuaucauuggggucgagcccggccaacucaagcugaauugguucaagaaaggaagcucuaucggccagauguuugaaaccacaaugagaggggccaagagaauggcuauucuuggagauaccgccugggacuucggcagccucgggggaguguuuacauccaucggcaaagcccuccaucagguguucggggcuaucuauggcgccgcguuuucuggaguuagcuggaccaugaagauucugaucggcgucauuaucacguggauugggaugaacucccgcagcacaucucuguccgugagccuugugcucgucggaaucgugacccuguaccugggcguuauggugcaggcugauucugggugugucguguccuggaaaaauaaggagcucaagugcggaagcggcaucuucauuaccgacaacguucacacauggaccgaacaauauaaauuucagccugagucccccucuaagcuggccagcgccauccagaaagcucaggaagaggggauuuguggcauccgguccgugacaagacuugagaaucugauguggaagcaaauuacgccggaacucaaccacauccuggccgagaaugaagucaaacugaccaucaugacaggagauauuaagggcaucaugcaggcugggaaacgcucucuucggccucagcccaccgagcucaaguacagcuggaagacauggggaaaagccaagaugcuguccaccgaaagcuauaaccagacguuccugauugacggcccugagaccgcggagugccccaauacaaacagagccuggaacucucucgaaguggaggauuacggguuuggaguuuucaccacaaacaucuggcugaaacuuaaggaaaaacaagacgcuuuuugugacuccaagcugaugagcgccgcuauuaaggauaaucgcgccgugcaugcggacaugggcuauuggaucgagucugcccucaacgauaccuggaaaaucgagaaggcuuccuucauugaagucaaaaauugccacuggccuaagagccauacacuguggucuaacggcgugcuggagagcgaaaugaucauucccaaaaaccuugccgggccggugucccagcacaauuaccggccuggauaccacacccagaucgcuggccccuggcaucucgggaagcuggagauggacuucgauuuuugugacggaacgacagucauuguuaccgaagauugcggcaacagagggcccagccugcgcaccacaaccgccucuggaaagcucaucacggaguggugcugucgguccugcacacugccuccgcuuagauaucggggcgaggacggcuguugguacgggauggaaauucgcccccugaaagagaaggaagagaaucucgugaacagccuggugaccgccggacacggccaagucgauaauuucucccugggggugcuuggaauggcucucuuucuggaagagaugcugagaacacggguuggcaccaaacaugcgauccuccugguggccgucucuuucgugacacuuaucaccgggaacaugagcuuuaaggaccugggaagaguuguggucauggugggcgcuacgauggccgaugacauuggcauggggguuaccuaucucgcccugcuggcugccuucaaagugcgcccuacauuugcggcuggacuucugcuccggaagcugaccuccaaggagcucaugaugacaaccaucggcauuguccugcuuucucagagcacgauccccgaaacagugcuggagcucaccgaugcccuggcccuggggaugauggugcuuaaaauugucagaaauauggaaaaguaccagcuggcuguuacaaucauggccauccucugcgugccuaacgcggugauucugcagaaugcuuggaaagucuccuguaccauccucgccgugguuucugugagcccccugcuucugaccuccagccaacagaagacagacuggauuccucucgcccugacgaucaaaggacugaaccccaccgcuauuuuccuuacaacccugucucgcacaaauaagaaaagauccuggccgcucaacgaggccaucauggcugucggcauggugagcauccuggccucuucccuccugaagaaugacauuccuaugaccgggccccuuguugcgggaggccugcugacggugugcuauguccucacaggccggagcgccgaucuggaacuugagcgcgcuaccgacgugaagugggaggaucaggccgaaaucucuggguccagcccuauucuguccaucaccauuagcgaggacggaucuaugagcaucaaaaacgaagaggaggaacagacacucaccauucugaucagaacaggccuccuggucaucuccgggcuuuuucccauuucuaucccgauuacggcugccgccugguaccugugggaggugaagaaacaacgggcuggaguucugugggaugugccuucucccccucccaugggcaaggcggaacucgaggacggggccuaucgcaucaaacagaagggcauucugggcuacucccagaucggcgcuggggucuacaaggaaggaaccuuccacacaauguggcaugugaccagaggcgccguucuuaugcacaaagggaagcggaucgagcccuccugggccgaugugaaaaaggaccugauuagcuauggaggcggguggaaacucgagggagaauggaaggagggcgaagagguccaggugcuggcucucgaaccuggcaagaauccgcgcgccgugcaaacaaaacccgggcuguuuaagaccaacacgggaaccaucggcgcgguuucccuugauuucucuccugggacaagcggaucccccauuaucgacaaaaagggcaaagucguggggcuguacggaaacggcguggucaccagaagcggcgcuuaugugucugccauugcccagacagagaaguccaucgaggauaauccugaaaucgaggacgauauuuuucggaagcgcagacugaccaucauggaccuccaccccggggcuggaaaaacaaagcgguaccugccugccauuguuagagaagcgaucaaacgcggccuucggacgcugauucucgcuccgaccagaguggucgccgccgagauggaagaggcucugcgcgggcuccccauccgguaucagaccccugccauuagagcugagcauaccggacgcgaaaucguggaccugaugugucacgccaccuucacaaugcggcuucugagccccguuagagugccuaacuacaaucugaucauuauggaugaggcgcauuucacggaccccgccucuaucgcugcccgcggcuauauuuccacccgggucgaaaugggggaggcugccggcaucuuuaugacagccaccccgccuggaaacagagaucccuucccccaaagcaaugcuccuauuaucgacgaggaacgggagauccccgaacgcuccuggaacucuggccacgagugggugacagauuuuaaggggaaaaccguuugguucgugccuagcauuaaggcgggaaaugacaucgccgcuugccucagaaagaacggcaaaaaggucauucagcugucccggaaaacguuugauagcgaauacgugaagacacgcaucaaugacugggauuucguggucaccaccgacauuucugagaugggggccaacuuuaaagccgagagaguuaucgauccgcggagauguaugaagcccgugauccuuacagacggagaggaacgcgugauucuggcuggcccuaugcccgucacccauuccagcgccgcgcagcggagagggcgcaucggccggaauccuaaaaacgaaaaugaccaguacauuuauaugggagagccccucgaaaacgaugaggacugcgcucacuggaaggaggccaagaugcugcuggauaauaucaacacaccggaaggcauuaucccuucuauguucgagcccgaaagagagaaaguggacgccauugauggggaauaccgccuccggggagaggcuagaaagaccuuuguugaccuuaugcgcagaggcgaucugccuguguggcuggccuauaaagucgcggccgaggggaucaacuacgcugaccggcgcugguguuucgauggaaucaagaauaaccaaauucucgaagagaauguggaaguugagaucuggacgaaagagggcgaaagaaagaagcugaaaccccgguggcuugacgcccgcauuuauagcgauccucuggcucucaaggaguuuaaagaguucgccgcugggagaaagucccugacacugaaccucaucaccgagaugggccggcuucccacauucaugacccagaaaacgagagacgcccuggauaaucuggcggugcuccacaccgccgaagcuggaggccgcgccuacaaccaugcucugucugagcuuccggagacacuggaaacccuccugcugcucacacuucuggccaccgucacagggggaauuuuucuguuccucaugagcggccgggggaucggaaagaugacccugggcaugugcugcaucauuacggccuccauccuucugugguaugcucagauucagccucacuggaucgcggccucuauuauccucgaguuuuuccugaucgugcugcucauucccgaacccgagaagcaaagaacaccucaggacaaucagcuuaccuacgucgugaucgcuauucugaccguuguggccgccacaauggcuaacgaaaugggcuuucuggagaaaaccaagaaagaccucgggcugggaagcaucgccacacagcaaccggaguccaauauucuugauaucgaccugcgccccgcgagcgccuggacgcucuacgcuguggccaccacauucgucaccccuaugcugcggcauucuauugaaaacuccagcguuaaugugucccugacagcuaucgccaaccaggcgaccgugcucaugggccuugggaagggauggccccugucuaaaauggauaucggcgucccucugcucgccauuggguguuauagccaggugaaucccaucacgcugaccgcugcccuucugcuccugguugcucacuacgccauuaucggaccuggccugcaggcuaaggccacaagagaggcgcaaaagcgggccgcugccggcauuaugaaaaacccgaccguggacgggaucacagucaucgaucucgaccccauuccuuaugaucccaaguuugaaaaacagcuuggacaggugaugcugcugauccucugcgucacccaagugcugaugaugcgcacgacaugggcucuuugugaggcccugacccucgccacaggcccuauuuccacccugugggaagggucucccggaagauucuggaauaccacaaucgcgguuagcauggcuaacauuuuucggggcuccuaccuggccggggcuggacuccuuuucagcaucaugaagaauacgaccaacacacgcagaggcaccggcaacaugggggagacacugggagagaaauggaagucucggcugaaugcccucggcaaauccgaauuucagaucuauaaaaagagcgggauucaggagguggaccgcacccuggccaaagaaggaaucaagagaggcgagacggaucaccaugcugucucucggggguccgccaaacuucgcugguucguggagagaaacaugguuacaccggaaggaaagguggucgaccugggcugcggcagagggggauggagcuacuauuguggcgggcucaaaaaugugcgggaggugaagggacugaccaagggcgggccuggacacgaagaacccauucccaugucuaccuacggcuggaaccugguucgccuccagagcggcgucgauguguuuuucaucccucccgaaaaaugcgacacacuucugugugauauuggggaguccucuccuaauccgaccguggaggcgggacggacacugagaguccucaaccugguugaaaauuggcuuaacaauaacacgcaauucugcaucaaggugcugaaucccuacaugccuagcgugaucgagaaaauggaagcccuccagcgcaaguauggcggggcucugguccggaacccccuguccagaaauagcacccaugagauguacuggguguccaacgccucuggaaauauuguuagcuccgugaacaugaucucucgcaugcucauuaaccgguuuacaaugagacacaaaaaggcuaccuaugaaccugacgucgaccuuggcagcgggacacgcaauaucggaauugaguccgagacccccaaccuggauaucauuggcaagcggaucgagaagaucaagcaggagcaugaaacgucuuggcacuacgaccaggaucacccguauaaaaccugggccuaccauggcagcuaugagacaaagcaaaccggguccgcgagcucuauggugaauggaguugugagacugcucacaaaaccuugggacguccugcccaccgugacacagauggccaugaccgauacgacaccuuucggccagcagcgcguguuuaaggaaaaggucgacacccggacccaagagcccaaagaggggacaaagaaacuuaugaagauuacggcugaauggcuguggaaagagcucggaaagaaaaagaccccuagaauguguacacgcgaagaguucaccagaaagguucgguccaacgccgcucugggcgccaucuuuacagaugagaauaaauggaaaagcgcucgcgaagccguggaggacucuagauucugggaacugguggauaaagagcggaaccuccaccuggaagggaagugcgagaccugugucuacaauaugaugggaaaaagagagaagaaacuuggcgaauuuggcaaagcgaaggggucccgggccauuugguacauguggcugggagcucgcuuccucgaguuugaagcccugggcuuccuuaacgaggaccauugguuuagcagagaaaauucucuguccgggguggagggagagggccuccacaaacugggguauauccugcgggauguuagcaagaaagaaggcggagcuauguacgccgacgacacagccggcugggauacccgcauuacgcucgaggaccugaagaacgaagagauggugaccaaucacauggaaggggagcauaagaaacuugcggaggcuaucuucaagcugacauaucagaacaaagucgugagaguucagcggcccaccccgcgcggaacagugauggauaucauuuccagacgggaccaacgcggcagcgggcaggucggaaccuacggccucaauacguuuacaaacauggaagcccagcugaucagacagauggagggggaaggcguguucaagaauauucaacaccuuaccguuacagaggagguggccguccagaacuggcuggcucgggugggacgcgaaagacucucucggauggccaucagcggcgaugacugcgucgugaaaccucuggaugaccgcuucgcuaacgcccugaccgcgcucaaugauauggggaagauuagaaaggacauccagcagugggagcccuccaaaggauggaacgauuggacgcaaguucccuuuugcucucaucacuuccaugaacugaucaugaaggacggccgggugcuugucgugccuuguagaaaucaggaugagcugauugggcgcgcccggaucagccagggagcuggcuggucccucagagaaaccgccugccuggggaaaucuuaugcucagauguggagccuuauguacuuucaccgccgggaccugagacucgccgcgaacgccauuuguuccgcugugccgucucacuggguucccacaagccgcaccacaugguccauccaugccaagcacgaguggaugaccacagaggacaugcugaccguguggaaucgggucuggauuagagaaaacccuuggauggaggauaaaacgcccguggaaagcugggaggaaaucccuuaucugggcaagcgcgaggaccaauggugcggaucucucauuggccugacaucccgggcuaccugggccaagaauauccagguugcuaucaaccaggugagaagccuuauugggaaugaggaauacaccgauuacaugcccucuaugaaacgcuuccggagagaggaagaggaagccggaguccugugguga

SEQ ID NO: 20043 - RNA, 9876 nt, Artificial Sequence
  derived and/or modified CDS sequence (opt5) from DENV-2__EU660415__SS-prME
agcgccggaaugaucauuaugcugauccccaccgugauggcuuuccaccuuaccacgagaaauggggaaccucauaugauugucgggauccaggaaaagggcaaaucccugcuuuuuaagaccgaggacgggguuaauaugugcacacugauggccauggaucucggagaacugugugaggacaccauuacauacaaaugcccgcuucugcggcaaaaugaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucggggugggccccggacagcucaagcugaauugguucaaaaagggcagcucuauugggcaaauguuugagaccacaaugcggggagccaaaagaauggcuauccuuggcgauaccgccugggacuucgggagccugggaggcgucuuuacauccaucgggaaggcccuccaucagguguucggcgcuauuuauggagccgcguuuucuggcgugagcuggaccaugaaaauccugauugggguuaucauuacguggaucggaaugaacucccgcagcacaucucuguccgucagccuugugcucgugggcaucgucacccuguaccugggggugaugguucaggcugauucuggauguguggucuccuggaagaauaaggaacucaaaugcggcagcgggauuuucaucaccgacaacgugcacacauggaccgagcaguauaaguuucaaccugaaucccccucuaaacuggccagcgccauucagaaggcucaggaggaaggcaucuguggcauucgguccguuacaagacuugagaaucugauguggaaacagaucacgccggagcucaaccacauccuggccgaaaaugaggugaagcugaccauuaugacaggcgauaucaaagggauuaugcaagcuggaaagcgcucucuucggccucagcccaccgaacucaaguacagcuggaaaacauggggcaaggccaaaaugcuguccaccgagagcuauaaccagacguuccugaucgacgggccugaaaccgcggagugccccaauacaaacagagccuggaacucucucgaggucgaagauuacggauuuggcguguucaccacaaacauuuggcugaaacuuaaagagaagcaggacgcuuuuugugacuccaagcugaugagcgccgcuaucaaagauaaucgcgccguucaugcggacaugggcuauuggaucgaaucugcccucaacgauaccuggaagauugagaaggcuuccuucaucgaggugaagaauugccacuggccuaaaagccauacacuguggucuaacgggguccuggaaagcgagaugauuauccccaagaaccuugccggaccggugucccaacacaauuaccggcucggcuaccacacccagauugcugggccuuggcaucugggaaagcuggaaauggacuucgauuuuugugacggcacgacagugaucgucaccgaggauugcgggaacagaggacccagccuccgcaccacaaccgccucuggcaaacugauuacggaauggugcugucgguccugcacacuucccccucugagauaucggggcgaggacggguguugguacggaauggagauccgcccgcucaaggaaaaagaggaaaaucugguuaacagccuggugaccgccggccacggacagguggauaauuucucccuuggaguccucggcauggcucuguuucuggaggaaaugcucagaacacggguggggaccaagcaugcgauccugcuuguugccgugucuuucgucacacugauuaccggaaacaugagcuuuaaagaccucggcagagugguugugauggucggcgcuacgauggccgaugacaucgggaugggagugaccuaucuggcccugcuugcugccuucaagguucgccccacauuugcggcuggccugcuccugcggaagcucaccuccaaagagcugaugaugacaaccauugggaucgugcuucugucucaaagcacgauuccugagacaguccucgaacugaccgaugcccuggcccuuggaaugauggugcugaagaucgugagaaauauggagaaauaccagcucgcugucacaaucauggccauucugugcguucccaacgcggugauccuccagaaugcuuggaagguguccuguaccauucuggccgucgugucuguuagcccucuucugcucaccuccagccagcagaagaccgacuggaucccccuggcccugacgauuaagggccuuaacccuaccgcuaucuuccugacaacccucucucgcacaaauaaaaagagauccuggccccugaacgaagccaucauggcuguggggauggucagcauucucgccucuucccugcuuaagaaugacaucccgaugaccggaccucugguggcgggcggccugcucacgguuugcuaugugcugacagggcggagcgccgaucuugagcuggaacgcgcuaccgacgucaaaugggaggaucaggccgagauuucuggauccagccccauccucuccauuaccaucagcgaagacggcucuaugagcauuaagaacgaggaagaggagcagacacugaccauccucaucagaacagggcugcuugugauuuccggacuguuuccuaucucuauucccaucacggcugccgccugguaccugugggaagucaaaaagcagcgggcuggcgugcucugggauguuccgagcccucccccuauggggaaagcggagcuggaagacggagccuaucgcauuaagcaaaagggcauccuuggcuacucccagaucggggcuggaguguacaaagagggcaccuuccacacaauguggcaugucaccagaggggccgugcugaugcacaagggaaaacggauugaacccucuugggccgauguuaagaaagaccucaucagcuauggcgggggauggaagcuggagggcgaguggaaggaaggcgaggaagugcagguccucgcucuggagcccgggaaaaauccucgcgccgugcagacaaagccgggacuuuuuaaaaccaacacgggcaccauuggggcggugucccuggauuucucucccggaacaagcggcuccccuaucauugacaagaaagggaagguugucggacuguacggcaacggcguggugaccagaagcggggcuuaugucucugccaucgcccaaacagaaaagggaaucgaggauaaucccgagauugaagacgauaucuuucggaaacgcagacucaccauuauggaccugcacccuggcgcugggaagacaaaacgguaccuucccgccaucgugagagaggcgauuaagcgcggacugcggacgcucauccuggcuccuaccagaguuguggccgccgaaauggaggaagcucuccgcggccugccgauucgguaucagacacccgccaucagagcugagcauaccgggcgcgagaucgucgaccuuaugugucacgccaccuucacaaugcggcugcuguccccugugagaguucccaacuacaaucucauuaucauggaugaagcgcauuucacggacccugccagcauugcugcccgcggcuauaucucuacccggguggagaugggagaagcugccggcauuuuuaugacagccacacccccgggguccagagauccuuucccccagagcaacgcucccaucaucgacgaggagcgggaaauuccugagcgcuccuggaacucuggacacgaaugggucacagauuuuaaaggcaagaccgugugguucguucccagcaucaaggcggggaacgacauugccgcuugccugcgcaagaauggaaagaaagugauccaacuuucccggaagacguuugauagcgaguacgucaaaacacgcaccaacgacugggauuucguggugaccacagacauuucugaaaugggcgccaauuuuaaggccgagagagucaucgauccucggagauguaugaaaccgguuauccugaccgacggggaggaacgcgugauucucgcuggccccaugccugugacacauuccagcgccgcgcagcggagaggacgcaucggccggaaccccaagaaugagaacgaccaguacauuuauaugggggaaccucuggagaaugaugaagacugcgcucacuggaaggaggccaaaaugcugcucgauaacaucaauacccccgagggaauuaucccgucuauguucgaaccugagagagaaaaggucgacgccauugauggcgaguaccgccuuagaggggaagcuagaaaaacguuuguggaccugaugcgcagaggagaucugcccguuuggcucgccuauaagguggcggccgagggcaucaacuacgcugaccggcgcugguguuucgaugggaucaaaaacaaucagauucuggaggaaaacgucgagguggaaaucuggacaaaggagggcgagagaaagaaacuuaagccucgguggcuggacgcccgcauuuauagcgauccccucgcucugaaagaauuuaaggaguucgccgcuggaagaaaaucccugacccucaaucuuaucacagaaaugggccggcugccuaccuucaugacgcaaaagaccagagacgcccuggauaaccucgcgguucugcacacagccgaggcugggggacgcgccuacaaucaugcucuuucugaacugcccgagacccucgagacacugcugcuccuuacccugcuggccacagugaccggcgggauuuuucucuuccugaugagcggacggggcaucggcaagaugacgcuugggaugugcugcaucauuacagccuccauccugcucugguaugcucagauucagccgcacuggaucgcggccucuauuauccuggaauuuuuccugaucguccuccuuauuccugagcccgaaaaacagagaacaccccaagacaaccagcugaccuacguggucaucgcuauucugacagugguugccgccaccauggcuaaugagaugggauuucucgaaaagaccaagaaggacuucggccuggggagcaucgccacgcagcagccugaguccaacauucuugauaucgaccugcgcccggcgagcgccuggacccucuacgcuguggccacaaccuuugugacacccaugcugcggcauucuauugaaaauuccagcgucaacguuucccugaccgcuaucgccaaucaagcgacggugcucaugggacuuggcaaaggguggccucugucuaagauggauaucggagugccccugcucgccauuggcuguuauagccaggucaacccuaucacccugacagcugcccuucugcuccugguggcucacuacgccauuaucggccccgggcugcaggcuaaggccaccagagaagcgcagaaacgggccgcugccggaauuaugaagaauccuacaguugacggcaucaccgugaucgaucucgacccgauucccuaugauccuaaauucgagaagcaacuugggcaggucaugcugcugauccucugcgugacgcagguccugaugaugcgcacaaccugggcucuuugugaagcccugacacucgccaccggacccauuuccacccugugggagggcaacccugggagauuuuggaauacaacgaucgcggugucuauggcuaacauuuuccggggaagcuaccuggccggcgcuggccuccucuuuuccaucaugaaaaauaccacaaacacccgcagagggacaggaaacaucggcgaaacccugggggagaaguggaaaagccggcugaaugcccucggaaagucugaguuccaaauuuauaagaaauccggcauccaggaaguugaccgcacgcuggccaaggaggggauuaaaagaggagaaacagaucaccaugcugugagccggggcucugccaaacuucgcugguuugucgagagaaacauggugacccccgagggcaaaguuguggaccuggggugcggacggggcgggugguccuacuauuguggaggccucaagaaugucagagaagugaaggggcugaccaaaggaggcccgggccacgaggaaccuauccccaugagcacauacggguggaaccuggugcgccuccagucuggaguugaugucuucuucauucccccugagaagugcgacacccuucugugugauaucggcgaaagcucccccaauccuacaguggaggcggggcggacgcugagagugcucaaccuggucgagaauuggcuuaacaauaacacccaguuuugcaucaaaguucugaauccguacaugcccucugugauugaaaagauggaggcccuccaacgcaaauauggaggcgcucuggugcggaacccucugagcagaaauuccacacaugaaauguacugggucagcaacgccuccgggaauaucgugucuagcguuaacaugauuucccgcaugcucaucaaccgguucaccaugagacacaagaaggcuacauaugagcccgacguggaccuuggaucuggcacccgcaauauuggcaucgaaagcgagauuccuaaccuggauaucaucgggaaacggauugagaagaucaaacaggaacaugagacguccuggcacuacgaccaggaucaccccuauaagaccugggccuaccauggaucuuaugaaacaaaacagaccggcagcgcguccagcauggucaauggggugguuagacugcucacaaagccgugggacgugcugccuaccgucacacaaauggccaugaccgauacgacacccuuuggacagcagcgcguguucaaggagaaaguggacacccggacccaggaaccuaaggagggcaccaagaaacuuaugaaaauuacggcugaguggcuguggaaagaacucgggaaaaagaagacccccagaauguguacacgcgaggaauuuaccagaaaaguccggucuaacgccgcucugggagccaucuucacagaugagaauaaguggaaauccgcucgcgaggccguugaagacagcagauuuugggagcugguggauaaggaacggaaccuccaccuggagggcaaaugcgaaaccuguguguacaauaugaugggcaagagagagaagaaacuuggggaguucggaaaggcgaaaggcucucgggccauuugguacauguggcugggggcucgcuuucucgaguucgaggcccugggauuucuuaacgaagaccauugguucuccagagagaauagccugucuggcgucgaaggggagggccuccacaagcugggauauauccugcgggauguguccaaaaaggagggcggggcuauguacgccgacgacacagccggaugggauacccgcaucacgcucgaagaccugaagaacgaggaaaugguuaccaaucacauggagggcgaacauaagaaacuugcggaggcuauuuuuaaacugacauaucaaaacaaaguggucagagugcagcggccuacccccagagggacaguuauggauaucauuagcagacgggaccagcgcggauccggccaaguggggaccuacggccucaauacguucacaaacauggaggcccagcugaucagacagauggaaggagagggcgucuucaaaaauauucagcaccuuaccgugacagaagagguugccgugcaaaacuggcuggcucgggucgggcgcgagagacucagccggauggccaucucuggagaugacugcguggucaagccgcuggaugaccgcuuugcuaacgcccugaccgcgcucaaugauaugggcaagaucagaaaagacauucagcagugggaaccuagcaagggguggaacgauuggacgcagguccccuucugcucccaucacuuucaugagcugaucaugaaagacggacggguucuugugguccccuguagaaaucaagaugaacugauuggccgcgcccggaucucucagggggcuggcuggagccucagagagaccgccugccugggaaaguccuaugcucagauguggucucuuauguacuuccaccgccgggaccugagacucgccgcgaacgugauuuguagcgccgugccuucccacuggguuccgacaucucgcaccacauggagcauccaugcuaaacacgaauggaugaccacagaggacaugcugaccguguggaaucgggucuggauuagagagaaccccuggauggaagauaagacgccuguggaguccugggaagagauccccuaucugggcaagcgcgaagaccaguggugcgggagccucaucggacugacaucucgggccaccugggcuaaaaauauucaagccgcuaucaaccagguuagaucccuuauuggcaaugaggaguacaccgauuacaugccuagcaugaagcgcuuucggagagaagaggaagaggccggggugcugugguga

SEQ ID NO: 20044 - RNA, 9876 nt, Artificial Sequence
  derived and/or modified CDS sequence (opt5) from DENV-2__EU687249__SS-prME
agcgccggcaugaucauuaugcugauccccaccgugauggcuuuccaccugacaacgagaaauggggaaccucauaugauugucggaauccaggaaaagggcaagucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacauucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucgggaagaggggauuuguggcaucagauccgugacacgccuugagaaucugauguggaaacagaucacgccggaacucaaccacauucuggccgagaaugaaguuaagcugaccaucaugacaggagauauuaaaggcaucaugcaggcugggaagcggucucuuagaccucaacccaccgagcucaaguacagcuggaaaacauggggaaaggccaaaaugcuguccaccgaaagcuauaaccagacguuccugauugacggcccugagaccgcggagugccccaauacaaaccgcgccuggaacucucucgaaguggaggauuacggguuuggagucuucaccacaaacaucuggcugaaacuuaaagaaaagcaggacgcuuuuugugacuccaagcugaugagcgccgcuaucaaagauaaucgggccgugcaugcggacaugggcuauuggauugagucugcccucaacgauaccuggaagaucgagaaggcuagcuucauugaaguuaagaauugccacuggccuaaaagccauacacuguggucuaacggcgugcuggagagcgaaaugaucauucccaagaaccuugccgggccggucucccagcacaauuacagaccuggauaccacacccaaaucgcuggccccuggcaucucgggaagcuggagauggacuucgauuuuugugacggaacgacagugauugugaccgaagauugcggcaaccgcgggcccagccugcggaccacaaccgccucuggaaaacucaucacggaguggugcuguagauccugcacacugccuccgcuucgguaucgcggcgaggacggcuguugguacgggauggaaaucagaccccugaaggagaaagaagagaaucucgucaacagccugguuaccgccggacacggccagguggauaauuucucccugggggugcuuggaauggcucucuuucuggaagagaugcugcggacaagagucggcaccaagcaugcgauucuccugguggccguuucuuucaugacacuuaucaccgggaacaugagcuuuaaagaccugggacgcguggucgugaugguuggcgcuacgauggccgaugacauuggcaugggggugaccuaucucgcccugcuggcugccuucaagguccggccuacauuugcggcuggacuucugcucagaaagcugaccuccaaagagcucaugaugacaaccaucggcauugugcugcuuucucagagcacgauccccgaaacaguucuggagcucaccgaugcccuggcccuggggaugauggugcuuaagaucguccgcaauauggaaaaauaccaacuggcugugacaauuauggccauccucugcgugccuaacgcggucauucugcagaaugcuuggaagguuuccuguaccauccucgccguggugucugucagcccccugcuucugaccuccagccagcagaaaacagacuggauuccucucgcccugacgaucaagggacugaaccccaccgcuaucuuccuuacaacccugucuagaacaaauaaaaagcgguccuggccgcucaacgaggccauuauggcugugggcaugguuagcauccuggccucuucccuccugaagaaugacauuccuaugaccgggccccuuguggcgggaggccugcugacggucugcuaugugcucacaggccgcagcgccgaucuggaacuugagagagcuaccgacguuaaaugggaggaucaagccgaaaucucuggguccagcccuauucuguccaucaccauuagcgaggacggaucuaugagcaucaagaacgaagaggaggaacagacacucaccauccugauucggacaggccuccuggugaucuccgggcuuuuucccauuucuaucccgauuacggcugccgccugguaccugugggaggucaaaaagcagcgcgcuggagugcugugggaugucccuucucccccucccaugggcaaagcggaacucgaggacggggccuauagaaucaagcagaagggaauccugggcuacucccaaauuggcgcugggguguacaaagaaggaaccuuccacacaauguggcauguuacccggggcgccgugcuuaugcacaaggggaaacgcaucgagcccuccugggccgaugucaagaaagaccugauuagcuauggaggcggguggaagcucgagggagaauggaaggagggcgaagaggugcagguucuggcucucgaaccuggcaaaaauccgagagccgugcagacaaagcccgggcuguuuaaaaccaacacgggaaccaucggcgcggucucccuugauuucucuccugggacaagcggaucccccauuaucgacaagaaaggcaaggugguggggcuguacggaaacggcguugucacccggagcggcgcuuaugugucugccaucgcccagacagagaaguccauugaggauaauccugaaaucgaggacgauauuuuucgcaaaagacggcugaccaucauggaccuccaccccggggcuggaaagacaaaaagauaccugccugccauugugcgcgaagcgaucaagcggggccuuagaacgcugauucucgcuccgacccgcgucguggccgccgagauggaagaggcucugcgggggcuccccaucagauaucaaaccccugccauccgcgcugagcauaccggacgggaaauuguugaccugaugugucacgccaccuucacaaugagacuucugagccccgugcgcgucccuaacuacaaucugaucauuauggaugaggcgcauuucacggaccccgccucuaucgcugcccggggcuauauuuccaccagaguggaaaugggggaggcugccggcaucuuuaugacagccaccccgccuggaagccgggaucccuucccccaguccaacgcuccuaucauugacgaggaacgcgagauccccgaaagaucuuggaauagcggccacgaguggguuacagauuuuaaagggaagaccgugugguucgucccuuccauuaaggcgggaaacgacaucgccgcuugccuccggaaaaauggcaagaaagugauucagcugagccgcaagacguuugauucugaauacguuaaaacaagaaccaacgacugggauuucguggucaccacagacaucuccgagaugggggccaauuuuaaggccgagcgggugaucgauccgagacgcuguaugaaacccgugauucuuaccgacggagaggaacgggucauccuggcuggcccuaugcccguuacacauagcucugccgcgcaaagacgcgggcggauuggcagaaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaacgcgagaagguggacgccaucgauggggaauaccggcucagaggagaggcucgcaaaacguuuguggaccuuaugagacggggcgaucugccugucuggcuggccuauaagguggcggccgaggggaucaacuacgcugaccgcagaugguguuucgauggaauuaaaaacaaucagauccucgaagagaacguugaaguggagauuuggacaaaggagggcgaacggaagaaacugaagccccgcuggcuugacgccagaaucuauuccgauccucuggcucucaaagaguuuaaggaguucgccgcugggcggaaaucucugacccugaaucucauuacagagaugggcagacuucccaccuucaugacgcagaagacccgcgacgcccuggauaaccuggcgguccuccacacagccgaagcuggaggccgggccuacaaucaugcucugagcgagcuuccggagacccuggaaacacuccugcugcucacccuucuggccacagugaccgggggaaucuuucuguuccucauguccggcagagggaucggaaagaugacgcugggcaugugcugcauuaucacagccucuauucuucugugguaugcucaaauccagccucacuggauugcggccagcaucauccucgaguuuuuccugauuguucugcucauccccgaacccgagaaacagcgcaccccucaggacaaccaacuuaccuacguggucauugcuauccugacaguggucgccgccaccauggcuaaugaaaugggcuuucuggagaagaccaagaaggaccucgggcugggauccauugccacgcagcagccggagagcaacauccuugauauugaccugcggcccgcgucugccuggacccucuacgcuguggccacaaccuucguuacaccuaugcugagacauuccaucgaaaauagcuccgugaacgugucucugaccgcuaucgccaaucaggcgacgguccucaugggccuugggaaaggauggccccugagcaagauggauauuggcguuccucugcucgccaucggguguuauucccaagugaaccccauuacccugacagcugcccuucugcuccugguggcucacuacgccaucauuggaccuggccugcaggcuaaggccacccgggaggcgcagaaacgcgccgcugccggcaucaugaagaauccgacagucgacgggaucaccgugauugaucucgaccccaucccuuaugaucccaaauuugaaaagcagcuuggacaaguuaugcugcugauucucugcgugacgcagguccugaugaugagaacaaccugggcucuuugugaggcccugacacucgccaccggcccuaucucuacccugugggaagggaaccccggacgguucuggaauacaacgauugcggugagcauggcuaacaucuuucgcggcuccuaccuggccggggcuggacuccuuuucagcaucaugaaaaauaccacaaacaccagacggggcacaggcaacauuggggagacccugggagagaaguggaaaucucgccugaaugcccucggcaaguccgaauuucagaucuauaagaaaagcgggauucaagaggucgacagaacgcuggccaaggaaggaaucaaacggggcgagacagaucaccaugcugugucucgcggguccgccaaacuuagaugguucguugagcggaacauggugaccccggaaggaagagucguggaccugggcugcggccgcgggggauggagcuacuauuguggcgggcucaaaaauguucgggaggugaagggacugaccaagggcgggccuggacacgaagaacccauucccaugucuacauacggcuggaaccuggucagacuccagagcggcguggauguguuuuucaucccucccgaaaaaugcgacacccuucugugugauaucggggaguccucuccuaauccgacaguugaggcgggacgcacgcugcggguccucaaccugguggaaaauuggcuuaacaauaacacccaguucugcauuaaggugcugaaucccuacaugccuagcgucaucgagaaaauggaagcccuccagagaaaguauggcggggcucugguucgcaacccccugucccggaauagcacacaugagauguacuggguguccaacgccucuggaaauauugugagcuccgucaacaugaucucuagaaugcucauuaaccgcuuuaccaugcggcacaaaaaggcuacauaugaaccugacguggaccuuggcagcgggaccagaaauaucggaauugaguccgagguucccaaccuggauaucaucggcaagcgcauugagaagaucaagcaagagcaugaaacgucuuggcacuacgaccaggaucacccguauaaaaccugggccuaccauggcagcuaugagacaaagcagaccggguccgcgagcucuauggugaauggagucgugcggcugcucacaaaaccuugggacguucugcccaccgugacacagauggccaugaccgauacgacaccuuucggccaacagagagucuuuaaggaaaagguggacacccgcacccaggagcccaaagaggggacaaagaaacuuaugaagauuacggcugaauggcuguggaaagagcucggaaagaaaaagaccccuagaauguguacacgggaagaguucacccgcaaggugagauccaacgccgcucugggcgccaucuuuacagaugagaauaaauggaaaagcgcucgggaagccgucgaggacucuagauucugggaacugguugauaaagagcggaaccuccaccuggaagggaagugcgagaccuguguguacaauaugaugggaaaacgcgagaagaaacuuggcgaauuuggcaaagcgaagggguccagagccauuugguacauguggcugggagcucgguuccucgaguuugaagcccugggcuuccuuaacgaggaccauugguuuagccgcgaaaauucucuguccgggguggagggagagggccuccacaaacugggguauauccugagagaugucagcaagaaagaaggcggagcuauguacgccgacgacacagccggcugggauacccggaucacgcucgaggaccugaagaacgaagagauggugaccaaucacauggaaggggagcauaagaaacuugcggaggcuauuuucaagcugacauaucagaacaaaguugugcgcguccaaagacccaccccgcggggaacagugauggauaucauuucccgcagagaccagcggggcagcgggcagguuggaaccuacggccucaauacguuuacaaacauggaagcccaacugauccgccagauggagggggaaggcguguucaagaauauucagcaccuuaccgucacagaggagguggccguucagaacuggcuggcuagagugggacgggaacgccucucuagaauggccaucagcggcgaugacugcgucgugaaaccucuggaugaccgguucgcuaacgcccugaccgcgcucaaugauauggggaagaucagaaaggacauucaacagugggagcccuccaaaggauggucugauuggacgcagguccccuuuugcagccaucacuuccaugaacugaucaugaaggacggccgcgugcuuguugugccuugucggaaccaggaugagcugauugggagagcccgcaucucccaaggagcuggcuggucucuccgggaaaccgccugccuggggaaaagcuaugcucagauguggucccuuauguacuuucacagacgcgaccugcggcucgccgcgaaugccauuuguucugcugucccgagccacugggugcccacauccagaaccacauggagcauccaugccaagcacgaguggaugaccacagaggacaugcugaccguguggaaccgcguuuggauucgggaaaauccuuggauggaggauaaaacgcccguggaaucuugggaggaaaucccuuaucugggcaagagagaggaccaguggugcggaucccucaucggccugacaagccgcgcuaccugggccaagaacauucaggcugccaucaaucaaguccggucucuuauugggaacgaggaauacaccgauuacaugcccuccaugaaaagauuccggagagaggaagaggaagcgggagugcugugguga

SEQ ID NO: 20045 - RNA, 9876 nt, Artificial Sequence
  derived and/or modified CDS sequence (opt5) from DENV-2__EU660416__SS-prME
agcgcuggcaugaucauuaugcugauccccaccgugauggcuuuccaccugacgacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgaaagacgcuacgugcugggacggcugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagcgcauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccggagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauuagauccguuacacgccuugagaaucugauguggaagcagaucacgccggaacucaaccacauccuggccgagaaugaagugaaacugaccauuaugacaggagauaucaagggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuacagaccuggauaccacacccagauugcuggccccuggcaucucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaagagaaggaagagaaucucguuaacagccuggugaccgccggacacggccagguggauaauuucucccuggggguccuuggaauggcucucuuucuggaagagaugcugcggacaagagugggcaugaaacaugcgauccuccugguugccgugucuuucgucacccuuauuacagggaacaugagcuuuaaggaccugggacgcgugguugugauggucggcgcuaccauggccgaugacaucggcaugggggugacguaucucgcccugcuggcugccuucaaaguucggccuaccuuugcggcuggacuucugcucagaaagcugacauccaaggagcucaugaugaccacaauuggcaucgugcugcuuucucaaagcaccauucccgaaacgguccuggagcucacagaugcccuggcccuggggaugauggugcuuaaaaucgugcgcaauauggaaaaguaccagcuggcugucaccaucaugacaauucucugcguuccuaacgccgugauccugcagaaugcguggaaaguguccuguaccauucucgcugucgugucuguuagcccccugcuucugaccuccagcagacagaagacagacuggaucccucucgcccugacgauuaaaggacugaaccccaccgccaucuuccuuacaacccugucucggacaaauaagaaacgcuccuggccgcucaacgaggcuaucauggccgugggcauggucagcauucuggcuucuucccuccugaagaaugacaucccuaugaccgggccccuuguggccggaggccugcugacgguuugcuaugugcucacaggcagaagcgcggaucuggaacuugagcgggccaccgacgucaagugggaggaucaagcugaaauuucuggguccagcccuauccuguccauuaccaucagcgaggacggaucuaugagcauuaaaaacgaagaggaggaacagacacucaccauccugauccgcacaggccuccuggugauuuccgggcuuuuucccaucucuauuccgaucacggccgcugccugguaccugugggaggucaagaaacagagagccggagugcugugggauguuccuucucccccucccaugggcaaggcugaacucgaggacggggcguaucggauuaaacagaagggaauccugggcuacucccaaaucggcgccgggguguacaaggaaggaaccuuccacacaauguggcaugucacccgcggcgcugugcuuaugcacaaagggaagagaauugagcccuccugggccgauguuaaaaaggaccugaucagcuauggaggcggguggaaacucgagggagaauggaaggagggcgaagaggugcagguccuggcccucgaaccuggcaagaauccgcgggcugugcagacaaaacccgggcuguuuaagaccaacacgggaaccauuggcgccgugucccuugauuucucuccugggacaagcggaucccccaucauugacaaaaagggcaaaguugucgggcuguacggaaacggcguggugacccgcagcggcgcguaugucucugcuaucgcccagacagagaaguccaucgaggauaauccugaaauugaggacgauaucuuuagaaagcggagacugaccauuauggaccuccaccccggggccggaaaaacaaagcgcuaccugccugcuaucgugcgggaagccauuaaaagaggccuucgcacgcugauccucgcgccgacccggguuguggcugccgagauggaagaggcccugagagggcuccccauucgcuaucaaaccccugcuauccgggccgagcauaccggaagagaaaucgucgaccugaugugucacgcuaccuucacaaugcgccuucugagccccgugcggguuccuaacuacaaucugauuaucauggaugaggcccauuucacggaccccgcgucuauugccgcuagaggcuauaucuccacccggguggaaaugggggaggccgcuggcauuuuuaugacagccaccccgccuggaagccgcgaucccuucccccaguccaacgccccuaucaucgacgaggaaagagagauucccgaacggucuuggaauagcggccacgagugggucacagauuuuaaggggaaaaccgugugguucguuccuuccaucaaggcuggaaacgacauugcggccugccuccgcaagaauggcaaaaaggugauccagcugagcagaaaaacguuugauucugaauacgucaagacacggaccaacgacugggauuucguggugaccacagacauuuccgagaugggggcuaauuuuaaagccgagagagucaucgauccgcgccgguguaugaagcccguuauccuuaccgacggagaagagagagugauucuggccggcccuaugcccgugacacauagcucugcugcccaacgccgggggagaaucggccgcaacccuaaaaaugaaaacgaccaguacauuuauaugggagagccccucgaaaaugaugaggacugcgcgcacuggaaggaggcuaagaugcugcuggauaacaucaauaccccggaaggcauuaucccuagcauguucgagcccgaacgggagaaagucgacgccauugauggggaauacagacuccgcggagaggccagaaagacguuuguggaccuuaugcggcgcggcgaucugccuguuuggcuggcuuauaaaguggccgcggaggggaucaacuacgccgacagacggugguguuucgauggaaucaagaacaaucagauucucgaagagaacgucgaaguggagaucuggacaaaagagggcgaacgcaagaagcugaaacccagauggcuugacgcucggauuuauuccgauccucuggcccucaaggaguuuaaagaguucgcugccgggagaaagucucugacccugaaucucaucacagagaugggccgccuucccaccuucaugacgcagaaaacccgggacgcucuggauaaccuggccguucuccacacagcggaagccggaggcagagcuuacaaucaugcccugagcgagcuuccggagacccuggaaacacuccugcugcucacccuucuggcuacagugaccgggggaauuuuucuguuccucauguccggccgcgggaucggaaagaugacgcugggcaugugcugcaucauuacagccucuauccuucugugguaugcccaaauucagccucacuggaucgcugcgagcauuauccucgaguuuuuccugaucguccugcucauucccgaacccgagaagcagcggaccccucaggacaaccaacuuaccuacguggucaucgccauucugacagugguugcugccaccauggccaaugaaaugggcuuucuggagaaaacaaagaaagaccucgggcugggauccaucgcuacgcagcagccggagagcaacauucuugauaucgaccugagacccgccucugcguggacccucuacgccguggcuacaaccuucgugacaccuaugcugcggcauuccauugaaaauagcuccgucaacguuucucugaccgccaucgcuaaucaggccacggugcucaugggccuugggaagggauggccccugagcaaaauggauaucggcgugccucugcucgcgauuggguguuauucccaagucaaccccaucacccugacagccgcccuucugcuccugguggcccacuacgcuauuaucggaccuggccugcaggccaaggcuacccgcgaggcccagaagagagcggccgcuggcauuaugaaaaauccgacaguugacgggaucaccgugaucgaucucgaccccauuccuuaugaucccaaguuugaaaaacagcuuggacaagucaugcugcugauccucugcgugacgcagguccugaugaugcggacaaccugggcccuuugugaggcucugacacucgccaccggcccuauuucuacccugugggaagggaaccccggacgcuucuggaauacaacgaucgccgugagcauggcgaacauuuuuagaggcuccuaccuggcuggggccggacuccuuuucagcaucaugaagaauaccacaaacacccggcgcggcacaggcaacaugggggagacccugggagagaaauggaagucuagacugaaugcucucggcaaauccgaauuucagaucuauaaaaagagcgggauucaagagguugaccggacgcuggccaaagaaggaaucaagcgcggcgagacagaucaccaugccgugucuagaggguccgcuaaacuucggugguucgucgagagaaacauggugaccccggaaggaaagguuguggaccugggcugcggccgcgggggauggagcuacuauuguggcgggcucaaaaauguccgggaggugaagggacugaccaagggcgggccuggacacgaagaacccauucccaugucuacauacggcuggaaccuggugagacuccagagcggcguugaugucuuuuucaucccucccgaaaaaugcgacacccuucugugugauauuggggaguccucuccuaauccgacaguggaggccggacgcacgcugcgggugcucaaccuggucgaaaauuggcuuaacaauaacacccaguucugcaucaagguucugaaucccuacaugccuagcgugaucgagaaaauggaagcgcuccagagaaaguauggcggggcccuggugcgcaacccccugucccggaauagcacacaugagauguacugggucuccaacgcuucuggaaauauugugagcuccguuaacaugaucucuagaaugcucauuaaccgcuuuaccaugcggcacaaaaaggccacauaugaaccugacguggaccuuggcagcgggaccagaaauaucggaauugaguccgagauccccaaccuggauauuaucggcaagcgcaucgagaagauuaagcaagagcaugaaacgucuuggcacuacgaccaggaucacccguauaaaaccugggcuuaccauggcagcuaugagacaaagcagaccggguccgccagcucuauggucaauggagugguucggcugcucacaaaaccuugggacgugcugcccaccgucacacagauggcgaugaccgauacgacaccuuucggccaacagagaguguuuaaggaaaagguggacacccgcacccaggagcccaaagaggggacaaagaaacuuaugaagaucacggccgaauggcuguggaaagagcucggaaagaaaaagaccccuagaauguguacacgggaagaguucacccgcaaggucagauccaacgcugcccugggcgcuauuuuuacagaugagaauaaauggaaaagcgcccgggaagcuguugaggacucuagauucugggaacugguggauaaagagcggaaccuccaccuggaagggaagugcgagaccuguguguacaauaugaugggaaaacgcgagaagaaacuuggcgaauuuggcaaagccaagggguccagagcgaucugguacauguggcugggagcccgguuccucgaguuugaagcucugggcuuccuuaacgaggaccauugguuuagccgcgaaaauucucuguccggggucgagggagagggccuccacaaacugggguauauucugagagaugugagcaagaaagaaggcggagccauguacgcugacgacacagccggcugggauacccggaucacgcucgaggaccugaagaacgaagagaugguuaccaaucacauggaaggggagcauaagaaacuugccgaggcgaucuucaagcugacauaucagaacaaagugguccgcgugcaaagacccaccccgcggggaacaguuauggauauuaucucccgcagagaccagcggggcagcgggcaggucggaaccuacggccucaauacguuuacaaacauggaagcucaacugauucgccagauggagggggaaggcgucuucaagaauauccagcaccuuaccgugacagaggagguugccgugcagaacuggcuggccagagucggacgggaacgccucucuagaauggcuauuagcggcgaugacugcguggucaaaccucuggaugaccgguucgccaacgcucugaccgcccucaaugauauggggaagaucagaaaggacauccaacagugggagcccuccaaaggauggaacgauuggacacaggugcccuuuugcucucaucacuuccaugaacugauuaugaaggacggccgcguucuuguggucccuugucggaaucaggaugagcugaucgggagagcgcgcauuagccaaggagccggcuggucccuccgggaaaccgcuugccuggggaaaucuuaugcccagauguggagccuuauguacuuucacagacgcgaccugcggcucgcugccaacgcgaucuguuccgccgugccgucucacugggugcccacaagcagaaccacaugguccauucaugcuaagcacgaguggaugaccacagaggacaugcugaccguuuggaauaaaguguggauccgcgaaaacccuuggauggaggauaagacgcccgucgaaagcugggaggaaauuccuuaucugggcaagcgggaggaccaguggugcggaucucucaucggccugacauccagagccaccugggcuaaaaauauccaggccgcuauuaaccaagugcgcagccuuaucgggaaugaggaauacaccgauuacaugcccucuaugaagcgguucagacgggaggaagaggaagccggaguucugugguga

SEQ ID NO: 20046 - RNA, 9876 nt, Artificial Sequence
  derived and/or modified CDS sequence (opt5) from DENV-2__EU660417__SS-prME
agcgcuggcaugaucauuaugcugauccccaccgugauggcuuuccaccugaccacgagaaauggggagccucauaugauugucggaauccaggaaaagggcaagagccugcuuuuuaagaccgaggacgggguuaauaugugcacgcugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgaaagacgcuacgugcugggacggcugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagcgcauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccggagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauuagauccguuacacgccuugagaaucugauguggaagcagaucacgccggaacucaaccacauccuggccgagaaugaagugaaacugaccauuaugacaggagauaucaagggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuacagaccuggauaccacacccagauugcuggccccuggcaucucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuauuaccgggaacaugagcuuuaaggaccugggacgcgugguugugauggucggcgcuacgauggccgaugacaucggcaugggggugaccuaucucgcccugcuggcugccuucaaaguucggccuacauuugcggcuggacuucugcucagaaagcugaccuccaaggagcucaugaugacaaccauuggcaucgugcugcuuucucaaagcacgauucccgaaacaguccuggagcucaccgaugcccuggcccuggggaugauggugcuuaaaaucgugcgcaauauggaaaaguaccagcuggcugucacaaucaugaccauucucugcguuccuaacgccgugauccugcagaaugcguggaaaguguccuguaccauucucgcugucgugucuguuagcccccugcuucugacauccagcagacagaagacggacuggaucccucucgcccugaccauuaaaggacugaaccccacagccaucuuccuuaccacacugucucggaccaauaagaaacgcuccuggccgcucaacgaggcuaucauggccgugggcauggucagcauucuggcuucuucccuccugaagaaugacaucccuaugacggggccccuuguggccggaggccugcugacaguuugcuaugugcucaccggcagaagcgcggaucuggaacuugagcgggccaccgacgucaagugggaggaucaagcugaaauuucuggguccagcccuauccuguccauuacaaucagcgaggacggaucuaugagcauuaaaaacgaagaggaggaacagacccucacaauccugauccgcacgggccuccuggugauuuccgggcuuuuucccaucucuauuccgaucaccgccgcugccugguaccugugggaggucaagaaacagagagccggagugcugugggauguuccuucucccccucccaugggcaaggcugaacucgaggacggggcguaucggauuaaacagaagggaauccugggcuacucccaaaucggcgccgggguguacaaggaaggaacauuccacaccauguggcaugucacacgcggcgcugugcuuaugcacaaagggaagagaauugagcccuccugggccgauguuaaaaaggaccugaucagcuauggaggcggguggaaacucgagggagaauggaaggagggcgaagaggugcagguccuggcccucgaaccuggcaagaauccgcgggcugugcagaccaaacccgggcuguuuaagacgaacaccggaacaauuggcgccgugucccuugauuucucuccugggaccagcggaucccccaucauugacaaaaagggcaaaguugucgggcuguacggaaacggcguggugacacgcagcggcgcguaugucucugcuaucgcccagaccgagaaguccaucgaggauaauccugaaauugaggacgauaucuuuagaaagcggagacugacaauuauggaccuccaccccggggccggaaaaacgaagcgcuaccugccugcuaucgugcgggaagccauuaaaagaggccuucgcacccugauccucgcgccgacacggguuguggcugccgagauggaagaggcccugagagggcuccccauucgcuaucaaaccccugcuauccgggccgagcauaccggaagagaaaucgucgaccugaugugucacgcuacauucacgaugcgccuucugagccccgugcggguuccuaacuacaaucugauuaucauggaugaggcccauuucaccgaccccgcgucuauugccgcuagaggcuauaucuccacacggguggaaaugggggaggccgcuggcauuuuuaugaccgccacaccgccuggaagccgcgaucccuucccccaguccaacgccccuaucaucgacgaggaaagagagauucccgaacggucuuggaauagcggccacgagugggucaccgauuuuaaggggaaaacggugugguucguuccuuccaucaaggcuggaaacgacauugcggccugccuccgcaagaauggcaaaaaggugauccagcugagcagaaaaacauuugauucugaauacgucaagacccggaccaacgacugggauuucguggugacaaccgacauuuccgagaugggggcuaauuuuaaagccgagagagucaucgauccgcgccgguguaugaagcccguuauccuuacagacggagaagagagagugauucuggccggcccuaugcccgugacccauagcucugcugcccaacgccgggggagaaucggccgcaacccuaaaaaugaaaacgaccaguacauuuauaugggagagccccucgaaaaugaugaggacugcgcgcacuggaaggaggcuaagaugcugcuggauaacaucaauacgccggaaggcauuaucccuagcauguucgagcccgaacgggagaaagucgacgccauugauggggaauacagacuccgcggagaggccagaaagacauuuguggaccuuaugcggcgcggcgaucugccuguuuggcuggcuuauaaaguggccgcggaggggaucaacuacgccgacagacggugguguuucgauggaaucaagaacaaucagauucucgaagagaacgucgaaguggagaucuggaccaaagagggcgaacgcaagaagcugaaacccagauggcuugacgcucggauuuauuccgauccucuggcccucaaggaguuuaaagaguucgcugccgggagaaagucucugacacugaaucucaucaccgagaugggccgccuucccacguucaugacccagaaaacacgggacgcucuggauaaccuggccguucuccacaccgcggaagccggaggcagagcuuacaaucaugcccugagcgagcuuccggagacacuggaaacccuccugcugcucacacuucuggcuaccgugacagggggaauuuuucuguuccucauguccggccgcgggaucggaaagaugacacugggcaugugcugcaucauuaccgccucuauccuucugugguaugcccaaauucagccucacuggaucgcugcgagcauuauccucgaguuuuuccugaucguccugcucauucccgaacccgagaagcagcggaccccucaggacaaccaacuuacauacguggucaucgccauucugaccgugguugcugccacaauggccaaugaaaugggcuuucuggagaaaacgaagaaagaccucgggcugggauccaucgcuacccagcagccggagagcaacauucuugauaucgaccugagacccgccucugcguggacacucuacgccguggcuaccacauucgugaccccuaugcugcggcauuccauugaaaauagcuccgucaacguuucucugacggccaucgcuaaucaggccaccgugcucaugggccuugggaagggauggccccugagcaaaauggauaucggcgugccucugcucgcgauuggguguuauucccaagucaaccccaucacacugaccgccgcccuucugcuccugguggcccacuacgcuauuaucggaccuggccugcaggccaaggcuacacgcgaggcccagaagagagcggccgcuggcauuaugaaaaauccgaccguugacgggaucacggugaucgaucucgaccccauuccuuaugaucccaaguuugaaaaacagcuuggacaagucaugcugcugauccucugcgugacacagguccugaugaugcggaccacaugggcccuuugugaggcucugacccucgccaccggcccuauuucuacacugugggaagggagccccggacgcuucuggaacacgaccaucgccguguccauggcgaauauuuuuagaggcagcuaccuggcuggggccggacuccuuuucucuaucaugaagaacacaaccaauacacggcgcggcaccggcaacaugggggagacgcugggagagaaauggaaguccagacugaacgcucucggcaaaagcgaauuucagaucuauaagaagucugggauucaagagguugaccggacacuggccaaagaaggaaucaagcgcggcgagaccgaucaccaugccguguccagagggagcgcuaaacuucggugguucgucgagagaaauauggugaccccggaaggaaagguuguggaccugggcugcggccgcgggggauggucuuacuauuguggcgggcucaaaaacguccgggaggugaagggacugacaaagggcgggccuggacacgaagaacccauucccaugagcaccuacggcuggaaucuggugagacuccaguccggcguugaugucuuuuucaucccucccgaaaaaugcgacacacuucugugugauauuggggagucuagcccuaacccgacgguggaggccggacgcacccugcgggugcucaaucuggucgaaaacuggcuuaauaacaauacacaguucugcaucaagguucugaaccccuacaugccuuccgugaucgagaaaauggaagcgcuccagagaaaguauggcggggcccuggugcgcaauccccugagccggaacuccacccaugagauguacugggucucuaaugcuagcggaaacauuguguccucuguuaauaugaucagcagaaugcucauuaaccgcuuuacaaugcggcacaaaaaggccaccuaugaaccugacguggaccuuggcuccgggacgagaaacaucggaauugagucugagauccccaaucuggauauuaucggcaagcgcaucgagaagauuaagcaagagcaugaaaccagcuggcacuacgaccaggaucacccguauaaaacaugggcuuaccauggcuccuaugagaccaagcagacagggagcgccucuuccauggucaacggagugguucggcugcucaccaaaccuugggacgugcugcccacagucacccagauggcgaugacggauacaaccccuuucggccaacagagaguguuuaaggaaaagguggacacccgcacacaggagcccaaagaggggacgaagaaacuuaugaagaucaccgccgaauggcuguggaaagagcucggaaagaaaaagacaccuagaauguguacccgggaagaguucacacgcaaggucagaagcaaugcugcccugggcgcuauuuuuaccgaugagaacaaauggaagucugcccgggaagcuguugaggacuccagauucugggaacugguggauaaagagcggaaucuccaccuggaagggaagugcgagacauguguguacaacaugaugggaaaacgcgagaagaaacuuggcgaauuuggcaaagccaaggggagcagagcgaucugguacauguggcugggagcccgguuccucgaguuugaagcucugggcuuccuuaaugaggaccauugguuuucucgcgaaaacucccugagcggggucgagggagagggccuccacaaacugggguauauucugagagauguguccaagaaagaaggcggagccauguacgcugacgacaccgccggcugggauacgcggaucacccucgaggaccugaagaaugaagagaugguuacaaaccacauggaaggggagcauaagaaacuugccgaggcgaucuucaagcugaccuaucagaauaaagugguccgcgugcaaagacccacaccgcggggaaccguuauggauauuaucagccgcagagaccagcggggcucugggcaggucggaacguacggccucaacacauuuaccaauauggaagcucaacugauucgccagauggagggggaaggcgucuucaagaacauccagcaccuuacagugaccgaggagguugccgugcagaauuggcuggccagagucggacgggaacgccucagcagaauggcuauuuccggcgaugacugcguggucaaaccucuggaugaccgguucgccaacgcucugacggcccucaacgauauggggaagaucagaaaggacauccaacagugggagcccucuaaaggauggaaugauuggacccaggugcccuuuugcagccaucacuuccaugaacugauuaugaaggacggccgcguucuuguggucccuugucggaaccaggaugagcugaucgggagagcgcgcauuucccaaggagccggcuggucucuccgggaaacagcuugccuggggaaaagcuaugcccagauguggucccuuauguacuuucacagacgcgaccugcggcucgcugccaaugcgaucuguucugccgugccgagccacugggugcccaccuccagaacaaccuggagcauucaugcuaagcacgaguggaugacaaccgaggacaugcugacgguuuggaacaaaguguggauccgcgaaaauccuuggauggaggauaagacacccgucgaaucuugggaggaaauuccuuaucugggcaagcgggaggaccaguggugcggaucccucaucggccugaccagcagagccaccugggcuaaaaacauccaggccgcuauuaaucaagugcgcucucuuaucgggaacgaggaauacacagauuacaugcccuccaugaagcgguucagacgggaggaagaggaagccggaguucugugguga

SEQ ID NO: 20047 - RNA, 9876 nt, Artificial Sequence
  derived and/or modified CDS sequence (opt5) from DENV-2__EU677137__SS-prME
agcgccggcaugaucauuaugcugauccccaccgucauggcuuuccaccugaccacgcggaauggggagccucauaugauugucggaauccaggaaaagggcaaaucccugcuuuuuaagaccgaggacgggguuaauaugugcacgcugauggccauggaucucggagaacugugugaggacaccauuacauacaaaugcccgcuucugcggcaaaacgaacccgaggauaucgacuguuggugcaauucuaccuccacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaccgucaccgaagauugcggcagcagagggcccucucugcgcacaaccacggccuccggaaagcucaucacagaguggugcugucggagcugcacccugccuccgcuuagauaucggggcgaggacggcuguugguacgggauggaaauucgcccccugaaagagaaggaagagaaccucguuaauucccuggugacagccggacacggccaaguggauaacuucucucuggggguccuuggaauggcucucuuucuggaagagaugcugagaacccgggugggcacaaaacaugcgauccuccugguugccgugagcuucgucacccuuaucacggggaauauguccuuuaaggaccugggaagagugguugugauggucggcgcuaccauggccgaugacauuggcaugggggugacauaucucgcccugcuggcugccuucaaaguucgcccuaccuuugcggcuggacuucugcuccggaagcugacaucuaaggagcucaugaugaccacgaucggcauugugcugcuuagccaguccacaauccccgaaaccguccuggagcucacagaugcccuggcccuggggaugauggugcuuaaaauugugagaaacauggaaaaguaccagcuggcugucaccaucauggccauccucugcguuccuaaugcggugauucugcagaacgcuuggaaagugucuuguaccauccucgccgucgugagcguuagcccccugcuucugacaagcucucaacagaagacggacuggauuccucucgcccugaccgugaaaggacugaaucccacagcuaucuuccuuaccacacugucccgcaccaacaagaaaagaagcuggccgcucaaugaggccauuauggcugucggcauggugucuauccuggccuccagccuccugaagaacgacaucccuaugacggggccccuuguugcgggaggccugcugacagugugcuauguccucaccggccggucugccgaucuggaacuugagcgcgcuaccgacgugaagugggaggaucaggccgaaauuuccgggagcuccccuauccugagcauuacaaucucugaggacggaagcauguccauuaaaaaugaagaggaggaacagacccucacaauccugauuagaacgggccuccuggucaucucugggcuuuuucccaucagcauuccgaucaccgcugccgccugguaccugugggaggugaagaaacaacgggcuggaguucugugggaugugccuucucccccucccaugggcaaggcggaacucgaggacggggccuaucgcauuaaacagaagggaauccugggcuacagccagauuggcgcuggggucuacaaggaaggaacauuccacaccauguggcaugugacaagaggcgccguucuuaugcacaaagggaagcggaucgagcccagcugggccgaugugaaaaaggaccugaucuccuauggaggcggguggaaacucgagggagaauggaaggagggcgaagagguccaggugcuggcucucgaaccuggcaagaacccgcgcgccgugcaaaccaaacccgggcuguuuaagacgaauaccggaacaauuggcgcgguuucucuugauuucagcccugggaccuccggaagccccaucauugacaaaaagggcaaagucguggggcuguacggaaacggcguggucacaagaucuggcgcuuauguguccgccaucgcccagaccgaaaaguccauugaggauaacccugaaaucgaggacgauaucuuucggaagcgcagacugacaauuauggaccuccaccccggggcuggaaaaacgaagcgguaccugccugccaucguuagagaagcgauuaaacgcggccuucggacccugauccucgcuccgacaagaguggucgccgccgagauggaagaggcucugcgcgggcuccccauucgguaucagaccccugccaucagagcugagcauaccggacgcgaaauuguggaccugaugugucacgccacauucacgaugcggcuucugucucccguuagagugccuaauuacaaccugaucaucauggaugaggcgcauuucaccgaccccgccuccauugcugcccgcggcuauaucagcacacgggucgaaaugggggaggcugccggcauuuuuaugaccgccacaccgccuggauccagagaucccuucccccaaucuaaugcuccuaucauugacgaggaacgggagauccccgaacgcagcuggaacuccggccacgagugggugaccgauuuuaaggggaaaacgguuugguucgugccuagcaucaaggcgggaaaugacauugccgcuugccucagaaagaacggcaaaaaggucauccagcugucucggaaaacauuugauuccgaauacgugaagacccgcaccaaugacugggauuucguggucacaaccgacauuagcgagaugggggccaacuuuaaagccgagagaguuaucgauccgcggagauguaugaagcccgugauucuuacagacggagaggaacgcgugauccuggcuggcccuaugcccgucacccauucuagcgccgcgcagcggagagggcgcaucggccggaauccuaaaaacgaaaaugaccaguacauuuauaugggagagccccucgaaaacgaugaggacugcgcucacuggaaggaggccaagaugcugcuggauaauaucaacacgccggaaggcauuaucccuuccauguucgagcccgaaagagagaaaguggacgccauugauggggaauaccgccuccggggagaggcuagaaagacauuuguugaccuuaugcgcagaggcgaucugccuguguggcuggccuauaaagucgcggccgaggggaucaauuacgcugaccggcgcugguguuucgauggaauuaagaacaaccaaauccucgaagagaauguggaaguugagaucuggaccaaagagggcgaaagaaagaagcugaaaccccgguggcuugacgcccgcauuuauucugauccucuggcucucaaggaguuuaaagaguucgccgcugggagaaagagccugacacugaaccucaucaccgagaugggccggcuucccacguucaugacccagaaaacaagagacgcccuggauaaucuggcggugcuccacaccgccgaagcuggaggccgcgccuacaaccaugcucuguccgagcuuccggagacacuggaaacccuccugcugcucacacuucuggccaccgucacagggggaauuuuucuguuccucaugucuggccgggggaucggaaagaugacacugggcaugugcugcauuaucaccgccagcauccuucugugguaugcucagauucagccucacuggaucgcggccuccauuauccucgaguuuuuccugauugugcugcucauccccgaacccgagaagcaaagaaccccucaggacaaucagcuuacauacgucgugaucgcuauucugaccguuguggccgccacaauggcuaacgaaaugggcuuucuggagaaaacgaagaaagaccucgggcugggaagcaucgccacccagcaaccggagucuaauauucuugauaucgaccugcgccccgcguccgccuggacacucuacgcuguggccaccacauucgucaccccuaugcugcggcauagcauugaaaacuccucuguuaaugugagccugacggcuaucgccaaccaggcgaccgugcucaugggccuugggaagggauggccccuguccaaaauggauauuggcgucccucugcucgccaucggguguuauucucaggugaaucccaucacacugaccgcugcccuucugcuccugguugcucacuacgccauuaucggaccuggccugcaggcuaaggccacaagagaggcgcaaaagcgggccgcugccggcauuaugaaaaacccgaccguggacgggaucacggucauugaucucgaccccaucccuuaugaucccaaguuugaaaaacagcuuggacaggugaugcugcugauccucugcgucacacaagugcugaugaugcgcaccacaugggcucuuugugaggcccugacccucgccaccggcccuauuagcacacugugggaagggaaucccggaagauucuggaacacgaccaucgcgguuuccauggcuaauauuuuucggggcagcuaccuggccggggcuggacuccuuuucucuaucaugaagaacacaaccaauacacgcagaggcaccggcaacaugggggagacgcugggagagaaauggaagucccggcugaacgcccucggcaaaagcgaauuucagauuuauaagaagucugggauccaggagguggaccgcacacuggccaaagaaggaaucaagagaggcgagaccgaucaccaugcugucucccgggggagcgccaaacuucgcugguucguggagagaaauaugguuaccccggaaggaaagguggucgaccugggcugcggcagagggggauggucuuacuauuguggcgggcucaaaaacgugcgggaggugaagggacugacaaagggcgggccuggacacgaggaacccauucccaugagcaccuacggcuggaaucugguucgccuccaguccggcgucgauguguuuuucaucccucccgaaaaaugcgacacacuucugugugauauuggggagucuagcccuaacccgacgguggaggcgggacggacccugagaguccucaaucugguugaaaacuggcuuaauaacaauacacaauucugcaucaaggugcugaaccccuacaugccuuccgugauugagaaaauggaagccaugcagcgcaaguauggcggggcucucguccggaauccccugagcagaaacuccacccaugagauguacugggugucuaaugccagcggaaacaucguuuccucugugaauaugaucagccgcaugcugauuaaccgguuuacaaugagacacaaaaaggcuaccuaugaaccugacgucgaccucggcuccgggacgcgcaacaucggaauugagucugagauccccaaucuugauauuaucggcaagcggauugagaagaucaagcaggagcaugaaaccagcuggcacuacgaccaggaucacccguauaaaacaugggccuaccauggcuccuaugagaccaagcaaacagggagcgcgucuuccauggugaacggaguugugagacugcugaccaaaccuugggacguccuccccacagugacccagauggccaugacggauacaaccccuuucggccagcagcgcguguuuaaggaaaaggucgacacccggacacaagagcccaaagaggggacgaagaaacugaugaagaucaccgcugaauggcuuuggaaagagcugggaaagaaaaagacaccuagaauguguacccgcgaagaguucacaagaaagguucggagcaaugccgcucucggcgccauuuuuaccgaugagaacaaauggaagucugcucgcgaagccguggaggacuccagauucugggaacugguggauaaagagcggaaucugcaccucgaagggaagugcgagacaugugucuacaacaugaugggaaaaagagagaagaagcugggcgaauuuggcaaagcgaaggggagccgggccaucugguacauguggcuuggagcucgcuuccuggaguuugaagcccucggcuuccugaaugaggaccauugguuuucuagagaaaacucccuuagcgggguggagggagagggccugcacaaacucggguauauucugcgggauguuuccaagaaagaaggcggagcuauguacgccgacgacaccgccggcugggauacgcgcaucacccuggaggaccucaagaaugaagagauggugacaaaccacauggaaggggagcauaagaaacuggcggaggcuauuuucaaacuuaccuaucagaauaaagucgugagaguucagcggcccacaccgcgcggaaccgugauggauaucaucagcagacgggaccaacgcggcucugggcaggucggaacguacggccugaacacauuuaccaauauggaagcccagcucauuagacagauggagggggaaggcguguucaagaacauccaacaccugacaguuaccgaggagguggccguccagaauuggcuugcucgggugggacgcgaaagacugagccggauggccauuuccggcgaugacugcgucgugaaaccucucgaugaccgcuucgcuaacgcccugacggcgcugaacgauauggggaagaucagaaaggacauucagcagugggagcccucuaaaggauggaaugauuggacccaaguucccuuuugcagccaucacuuccaugaacucaucaugaaggacggccgggugcuggucgugccuuguagaaaccaggaugagcuuaucgggcgcgcccggauuucccagggagcuggcuggucucugagagaaacagccugccucgggaaaagcuaugcucagauguggucccugauguacuuucaccgccgggaccuuagacuggccgcgaaugccaucuguucugcugugccgagccacuggguucccaccucccgcacaaccuggagcauucaugccaagcacgaguggaugacaaccgaggacaugcucacgguguggaaccgggucuggaucagagaaaauccuuggauggaggauaaaacacccguggaaucuugggaggaaauuccuuaucugggcaagcgcgaggaccaauggugcggaucccugaucggccucaccagccgggcuaccugggccaagaacauucaggcugccaucaaucagguuagaucucugaucgggaacgaggaauacacagauuacaugcccuccaugaaacgcuuccggagagaggaagaggaagcgggagugcuuugguga

SEQ ID NO: 20048 - RNA, 9876 nt, Artificial Sequence
  derived and/or modified CDS sequence (opt5) from DENV-2__EU677138__SS-prME
agcgccggaaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucggcggggucuuuacauccaucgggaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucagagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccaacagaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacaacgggcuggagugcugugggauguuccuucucccccucccaugggccgcgcggaacucgaggacggggccuauagaauuaagcagaaaggaauccugggcuacucccagaucggcgcugggguguacaaggaaggaaccuuccacacaauguggcaugucacccggggcgccgugcuuaugcacaaggggaaacgcauugagcccuccugggccgauguuaagaaagaccugaucagcuauggaggcggguggaagcucgagggagaauggaaagagggcgaagaggugcagguccuggcucucgaaccuggcaagaauccgagagccgugcaaacaaagcccgggcuguuuaaaaccaacacgggaaccauuggcgcggugucccuugauuucucuccugggacaagcggaucccccaucauugacaagaaaggcaagguugucgggcuguacggaaacggcguggugacccggagcggcgcuuaugucucugccaucgcccagacagagaaauccaucgaggauaauccugaaauugaggacgauaucuuucgcaagagacggcugaccauuauggaccuccaccccggggcuggaaagacaaaaagauaccugccugccaucgugcgcgaagcgauuaagcggggccuuagaacgcugauccucgcuccgacccgcguuguggccgccgagauggaagaggcucugcgggggcuccccauuagauaucagaccccugccauccgcgcugagcauaccggacgggaaaucgucgaccugaugugucacgccaccuucacaaugagacuucugagccccgugcgcguuccuaacuacaaucugauuaucauggaugaggcgcauuucacggaccccgccucuauugcugcccggggcuauaucuccaccagaguggaaaugggggaggcugccggcauuuuuaugacagccaccccgccuggaagccgggaucccuucccccaauccaacgcuccuaucaucgacgaggaacgcgagauucccgaaagaucuuggaauagcggccacgagugggucacagauuuuaaagggaagaccgugugguucguuccuuccaucaaagcgggaaacgacauugccgcuugccuccggaagaauggcaagaaagugauccagcugagccgcaagacguuugauucugaauacgucaaaacaagaaccaacgacugggauuucguggugaccacagacauuuccgagaugggggccaauuuuaaggccgagcgggucaucgauccgagacgcuguaugaaacccguuauccuuaccgacggagaggaacgggugauucuggcuggcccuaugcccgugacacauagcucugccgcgcagagacgcgggcggaucggcagaaacccuaagaaugaaaacgaccaguacauuuauaugggagagccccucgaaaaugaugaggacugcgcucacuggaaagaggccaagaugcugcuggauaacaucaauaccccggaaggcauuaucccuagcauguucgagcccgaacgcgagaaggucgacgccauugauggggaauaccggcucagaggagaggcucgcaaaacguuuguggaccuuaugagacggggcgaucugccuguuuggcuggccuauaagguggcggccgaggggaucaacuacgcugaccgcagaugguguuucgauggaaucaaaaacaaucaaauucucgaagagaacgucgaaguggagaucuggacaaaggagggcgaacggaaaaagcugaagccccgcuggcuugacgccagaauuuauuccgauccucuggcucucaaagaguuuaaggaguucgccgcugggcggaaaucucugacccugaaucucaucacagagaugggcagacuucccaccuucaugacgcagaagacccgcgacgcccuggauaaccuggcgguucuccacacagccgaagcuggaggccgggccuacaaucaugcucugagcgagcuuccggagacccuggaaacacuccugcugcucacccuucuggccacagugaccgggggaauuuuucuguuccucauguccggcagagggaucggaaaaaugacgcugggcaugugcugcaucauuacagccucuauccuucugugguaugcucagauucagccucacuggaucgcggccagcauuauccucgaguuuuuccugaucguccugcucauucccgaacccgagaagcaacgcaccccucaggacaaccagcuuaccuacguggucaucgcuauucugacagugguugccgccaccauggcuaaugaaaugggcuuucuggagaagaccaagaaggaccucgggcugggauccaucgccacgcagcaaccggagagcaacauucuugauaucgaccugcggcccgcgucugccuggacccucuacgcuguggccacaaccuucgugacaccuaugcugagacauuccauugaaaauagcuccgucaacguuucucugaccgcuaucgccaaucaggcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaagccacccgggaggcgcaaaagcgcgccgcugccggcauuaugaagaauccgacaguugacgggaucaccgugaucgaucucgaccccauuccuuaugaucccaaauuugaaaagcagcuuggacaggucaugcugcugauccucugcgugacgcaaguccugaugaugagaacaaccugggcucuuugugaggcccugacacucgccaccggcccuauuucuacccugugggaagggaaccccggacgguucuggaauacaacgaucgcggugagcauggcuaacauuuuucgcggcuccuaccuggccggggcuggacuccuuuucagcaucaugaaaaauaccacaaacaccagacggggcacaggcaacaugggggagacccugggagagaaguggaaaucucgccugaaugcccucggcaaguccgaauuucagaucuauaaaaagagcgggauucaggagguugacagaacgcuggccaaggaaggaaucaaacggggcgagacagaucaccaugcugugucucgcggguccgccaaacuuagaugguucgucgagcggaacauggugaccccggaaggaaaaguuguggaccugggcugcggcagagggggauggagcuacuauuguggcgggcucaagaauguccgcgaggugaaaggacugaccaagggcgggccuggacacgaggaacccauucccaugucuacauacggcuggaaccuggugcggcuccagagcggcguugaugucuuuuucaucccucccgaaaagugcgacacccuucugugugauauuggggaguccucuccuaauccgacaguggaggcgggaagaacgcugcgcgugcucaaccuggucgaaaauuggcuuaacaauaacacccaauucugcaucaaaguucugaaucccuacaugccuagcgugaucgagaagauggaagcccuccagcggaaauauggcggggcucuggugagaaacccccugucccgcaauagcacacaugagauguacugggucuccaacgccucuggaaauauugugagcuccguuaacaugaucucucggaugcucauuaacagauuuaccaugcgccacaagaaagcuacauaugaaccugacguggaccuuggcagcgggacccggaauaucggaauugaguccgagacgcccaaccuggauaucauuggcaagagaaucgaaaagaucaaacaggagcaugaaaccucuuggcacuacgaccaggaucacccguauaagacaugggccuaccauggcagcuaugagaccaaacaaacaggguccgcgagcucuauggucaauggagugguucgccugcucaccaagccuugggacgugcugcccacagucacccagauggccaugacggauacaaccccuuucggccagcagcggguguuuaaagaaaagguggacaccagaacacaagagcccaaggaggggacgaagaaacuuaugaaaauuaccgcugaauggcuguggaaagagcucggcaagaagaaaacaccucgcauguguaccagagaagaguucacacggaagguccgcuccaacgccgcucugggcgccaucuuuaccgaugagaauaaguggaaaagcgcuagagaagccguugaggacucucgguucugggaacugguggauaaggagagaaaccuccaccuggaagggaaaugcgagacauguguguacaauaugaugggaaagcgggagaagaaacuuggcgaauuuggcaaagcgaaagggucccgcgccauuugguacauguggcugggagcuagauuccucgaguuugaagcccugggcuuccuuaacgaggaccauugguuuagccgggaaaauucucuguccggggucgagggagagggccuccacaagcugggguauauccugcgcgaugugagcaaaaaggaaggcggagcuauguacgccgacgacaccgccggcugggauacgagaauuacccucgaggaccugaaaaacgaagagaugguuacaaaucacauggaaggggagcauaagaaacuugcggaggcuaucuucaaacugaccuaucagaacaaggugguccgggugcagcgccccacaccgagaggaaccguuauggauaucauuucccggcgcgaccaaagaggcagcggacaggugggaacguacggccucaauacauuuaccaacauggaagcccagcugauccggcagauggagggggaaggcgucuucaaaaauauucaacaccuuacagccaccgaggagguggcuguucagaacuggcuggcccgcgugggaagagaacggcucucucgcauggcuaucagcggcgaugacugcgucgugaagccucuggaugacagauucgccaacgcgcugacggcccucaaugauauggggaaaauucggaaggacauccagcagugggagcccuccaagggauggaacgauuggacccaaguccccuuuugcucucaucacuuccaugaacugaucaugaaagacggcagagugcuuguugugccuugucgcaaucaggaugagcugauugggcgggcuagaaucagccagggagccggcuggucccuccgcgaaacagcuugccuggggaagucuuaugcccagauguggagccuuauguacuuucaccggagagaccugcgccucgcggccaacgcuauuuguuccgccgucccgucucacugggugcccaccagccggacaaccugguccauccaugcuaaacacgaguggaugacaaccgaggacaugcugacgguguggaauagaguuuggauucgcgaaaacccuuggauggaggauaagacacccguggaaagcugggaggaaaucccuuaucugggcaaacgggaggaccaauggugcggaucucucauuggccugaccuccagagccaccugggcuaagaauauccaggucgccaucaaccaggugcgcagccuuauugggaaugaggaauacacagauuacaugcccucuaugaagcgguucagacgggaggaagaggaagcgggaguucugugguga

SEQ ID NO: 20049 - RNA, 9876 nt, Artificial Sequence
  derived and/or modified CDS sequence (opt5) from DENV-2__EU677149__SS-prME
agcgcuggcaugaucauuaugcugauccccaccgugauggcuuuccaccugaccacgagaaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgaaagacgcuacgugcugggacggcugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagcgcauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccggagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauuagauccguuacacgccuugagaaucugauguggaagcagaucacgccggaacucaaccacauccuggccgagaaugaagugaaacugaccauuaugacaggagauaucaagggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuacagaccuggauaccacacccagauugcuggccccuggcaucucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuauuaccgggaacaugagcuuuaaggaccugggacgcgugguugugauggucggcgcuacgauggccgaugacaucggcaugggggugaccuaucucgcccugcuggcugccuucaaaguucggccuacauuugcggcuggacuucugcucagaaagcugaccuccaaggagcucaugaugacaaccauuggcaucgugcugcuuucucaaagcacgauucccgaaacaguccuggagcucaccgaugcccuggcccuggggaugauggugcuuaaaaucgugcgcaauauggaaaaguaccagcuggcugucacaaucaugaccauucucugcguuccuaacgccgugauccugcagaaugcguggaaaguguccuguaccauucucgcugucgugucuguuagcccccugcuucugacauccagcagacagaagacggacuggaucccucucgcccugaccauuaaaggacugaaccccacagccaucuuccuuaccacacugucucggaccaauaagaaacgcuccuggccgcucaacgaggcuaucauggccgugggcauggucagcauucuggcuucuucccuccugaagaaugacaucccuaugacggggccccuuguggccggaggccugcugacaguuugcuaugugcucaccggcagaagcgcggaucuggaacuugagcgggccaccgacgucaagugggaggaucaagcugaaauuucuggguccagcccuauccuguccauuacaaucagcgaggacggaucuaugagcauuaaaaacgaagaggaggaacagacccucacaauccugauccgcacgggccuccuggugauuuccgggcuuuuucccaucucuauuccgaucaccgccgcugccugguaccugugggaggucaagaaacagagagccggagugcugugggauguuccuucucccccucccaugggcaaggcugaacucgaggacggggcguaucggauuaaacagaagggaauccugggcuacucccaaaucggcgccgggguguacaaggaaggaacauuccacaccauguggcaugucacacgcggcgcugugcuuaugcacaaagggaagagaauugagcccuccugggccgauguuaaaaaggaccugaucagcuauggaggcggguggaaacucgagggagaauggaaggagggcgaagaggugcagguccuggcccucgaaccuggcaagaauccgcgggcugugcagaccaaacccgggcuguuuaagacgaacaccggaacaauuggcgccgugucccuugauuucucuccugggaccagcggaucccccaucauugacaaaaagggcaaaguugucgggcuguacggaaacggcguggugacacgcagcggcgcguaugucucugcuaucgcccagaccgagaaguccaucgaggauaauccugaaauugaggacgauaucuuuagaaagcggagacugacaauuauggaccuccaccccggggccggaaaaacgaagcgcuaccugccugcuaucgugcgggaagccauuaaaagaggccuucgcacccugauccucgcgccgacacggguuguggcugccgagauggaagaggcccugagagggcuccccauucgcuaucaaaccccugcuauccgggccgagcauaccggaagagaaaucgucgaccugaugugucacgcuacauucacgaugcgccuucugagccccgugcggguuccuaacuacaaucugauuaucauggaugaggcccauuucaccgaccccgcgucuauugccgcuagaggcuauaucuccacacggguggaaaugggggaggccgcuggcauuuuuaugaccgccacaccgccuggaagccgcgaucccuucccccaguccaacgccccuaucaucgacgaggaaagagagauucccgaacggucuuggaauagcggccacgagugggucaccgauuuuaaggggaaaacggugugguucguuccuuccaucaaggcuggaaacgacauugcggccugccuccgcaagaauggcaaaaaggugauccagcugagcagaaaaacauuugauucugaauacgucaagacccggaccaacgacugggauuucguggugacaaccgacauuuccgagaugggggcuaauuuuaaagccgagagagucaucgauccgcgccgguguaugaagcccguuauccuuacagacggagaagagagagugauucuggccggcccuaugcccgugacccauagcucugcugcccaacgccgggggagaaucggccgcaacccuaaaaaugaaaacgaccaguacauuuauaugggagagccccucgaaaaugaugaggacugcgcgcacuggaaggaggcuaagaugcugcuggauaacaucaauacgccggaaggcauuaucccuagcauguucgagcccgaacgggagaaagucgacgccauugauggggaauacagacuccgcggagaggccagaaagacauuuguggaccuuaugcggcgcggcgaucugccuguuuggcuggcuuauaaaguggccgcggaggggaucaacuacgccgacagacggugguguuucgauggaaucaagaacaaucagauucucgaagagaacgucgaaguggagaucuggaccaaagagggcgaacgcaagaagcugaaacccagauggcuugacgcucggauuuauuccgauccucuggcccucaaggaguuuaaagaguucgcugccgggagaaagucucugacacugaaucucaucaccgagaugggccgccuucccacguucaugacccagaaaacacgggacgcucuggauaaccuggccguucuccacaccgcggaagccggaggcagagcuuacaaucaugcccugagcgagcuuccggagacacuggaaacccuccugcugcucacacuucuggcuaccgugacagggggaauuuuucuguuccucauguccggccgcgggaucggaaagaugacacugggcaugugcugcaucauuaccgccucuauccuucugugguaugcccaaauucagccucacuggaucgcugcgagcauuauccucgaguuuuuccugaucguccugcucauucccgaacccgagaagcagcggaccccucaggacaaccaacuuacauacguggucaucgccauucugaccgugguugcugccacaauggccaaugaaaugggcuuucuggagaaaacgaagaaagaccucgggcugggauccaucgcuacccagcagccggagagcaacauucuugauaucgaccugagacccgccucugcguggacacucuacgccguggcuaccacauucgugaccccuaugcugcggcauuccauugaaaauagcuccgucaacguuucucugacggccaucgcuaaucaggccaccgugcucaugggccuugggaagggauggccccugagcaaaauggauaucggcgugccucugcucgcgauuggguguuauucccaagucaaccccaucacacugaccgccgcccuucugcuccugguggcccacuacgcuauuaucggaccuggccugcaggccaaggcuacacgcgaggcccagaagagagcggccgcuggcauuaugaaaaauccgaccguugacgggaucacggugaucgaucucgaccccauuccuuaugaucccaaguuugaaaaacagcuuggacaagucaugcugcugauccucugcgugacacagguccugaugaugcggaccacaugggcccuuugugaggcucugacccucgccaccggcccuauuucuacacugugggaagggaaccccggacgcuucuggaauacgaccaucgccgugagcauggcgaacauuuuuagaggcuccuaccuggcuggggccggacuccuuuucagcaucaugaagaauacaaccaacacacggcgcggcaccggcaacaugggggagacgcugggagagaaauggaagucuagacugaaugcucucggcaaauccgaauuucagaucuauaaaaagagcgggauucaagagguugaccggacacuggccaaagaaggaaucaagcgcggcgagaccgaucaccaugccgugucuagaggguccgcuaaacuucggugguucgucgagagaaacauggugaccccggaaggaaagguuguggaccugggcugcggccgcgggggauggagcuacuauuguggcgggcucaaaaauguccgggaggugaagggacugacaaagggcgggccuggacacgaagaacccauucccaugucuaccuacggcuggaaccuggugagacuccagagcggcguugaugucuuuuucaucccucccgaaaaaugcgacacacuucugugugauauuggggaguccucuccuaauccgacgguggaggccggacgcacccugcgggugcucaaccuggucgaaaauuggcuuaacaauaacacacaguucugcaucaagguucugaaucccuacaugccuagcgugaucgagaaaauggaagcgcuccagagaaaguauggcggggcccuggugcgcaacccccugucccggaauagcacccaugagauguacugggucuccaacgcuucuggaaauauugugagcuccguuaacaugaucucuagaaugcucauuaaccgcuuuacaaugcggcacaaaaaggccaccuaugaaccugacguggaccuuggcagcgggacgagaaauaucggaauugaguccgagauccccaaccuggauauuaucggcaagcgcaucgagaagauuaagcaagagcaugaaaccucuuggcacuacgaccaggaucacccguauaaaacaugggcuuaccauggcagcuaugagaccaagcagacaggguccgccagcucuauggucaauggagugguucggcugcucaccaaaccuugggacgugcugcccacagucacccagauggcgaugacggauacaaccccuuucggccaacagagaguguuuaaggaaaagguggacacccgcacacaggagcccaaagaggggacgaagaaacuuaugaagaucaccgccgaauggcuguggaaagagcucggaaagaaaaagacaccuagaauguguacccgggaagaguucacacgcaaggucagauccaacgcugcccugggcgcuauuuuuaccgaugagaauaaauggaaaagcgcccgggaagcuguugaggacucuagauucugggaacugguggauaaagagcggaaccuccaccuggaagggaagugcgagacauguguguacaauaugaugggaaaacgcgagaagaaacuuggcgaauuuggcaaagccaagggguccagagcgaucugguacauguggcugggagcccgguuccucgaguuugaagcucugggcuuccuuaacgaggaccauugguuuagccgcgaaaauucucuguccggggucgagggagagggccuccacaaacugggguauauucugagagaugugagcaagaaagaaggcggagccauguacgcugacgacaccgccggcugggauacgcggaucacccucgaggaccugaagaacgaagagaugguuacaaaucacauggaaggggagcauaagaaacuugccgaggcgaucuucaagcugaccuaucagaacaaagugguccgcgugcaaagacccacaccgcggggaaccguuauggauauuaucucccgcagagaccagcggggcagcgggcaggucggaacguacggccucaauacauuuaccaacauggaagcucaacugauucgccagauggagggggaaggcgucuucaagaauauccagcaccuuacagugaccgaggagguugccgugcagaacuggcuggccagagucggacgggaacgccucucuagaauggcuauuagcggcgaugacugcguggucaaaccucuggaugaccgguucgccaacgcucugacggcccucaaugauauggggaagaucagaaaggacauccaacagugggagcccuccaaaggauggaacgauuggacccaggugcccuuuugcucucaucacuuccaugaacugauuaugaaggacggccgcguucuuguggucccuugucggaaucaggaugagcugaucgggagagcgcgcauuagccaaggagccggcuggucccuccgggaaacagcuugccuggggaaaucuuaugcccagauguggagccuuauguacuuucacagacgcgaccugcggcucgcugccaacgcgaucuguuccgccgugccgucucacugggugcccaccagcagaacaaccugguccauucaugcuaagcacgaguggaugacaaccgaggacaugcugacgguuuggaauaaaguguggauccgcgaaaacccuuggauggaggauaagacacccgucgaaagcugggaggaaauuccuuaucugggcaagcgggaggaccaguggugcggaucucucaucggccugaccuccagagccaccugggcuaaaaauauccaggccgcuauuaaccaagugcgcagccuuaucgggaaugaggaauacacagauuacaugcccucuaugaagcgguucagacgggaggaagaggaagccggaguucugugguga

SEQ ID NO: 20050 - RNA, 9876 nt, Artificial Sequence
  derived and/or modified CDS sequence (opt5) from DENV-2__FJ024452__SS-prME
agcgccggcaugaucauuaugcugauccccacagugauggcuuuccaccucacaacgcggaauggggagccucauaugauugucgggauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccgggggacacagaagagagaagcgguccguggcgcucguuccucaugugggcaugggccuggaaacacgcaccgagacguggaugucuagcgaaggggcuuggaaacacgcccagagaaucgagacauggauucugcggcaucccggauucaccaucauggccgcuauucucgccuacacaaucggcaccacccacuuucagcgcguucugauuuucauccuucugacagcuguggccccuuccaugacgaugagaugcauugggaucucuaaccgggauuuugucgagggagugagcggcggguccuggguugacaucgugcucgaacacggaagcugugucaccacaauggcgaagaauaagcccacccuggauuucgagcuuauuaaaacagaagccaagcagccugcuacccugcgcaaauauugcaucgaggccaagcucacgaacacaaccaccgaaucuagauguccgacacaaggcgagcccucccugaaagaggaacaggacaagcgguuuauuugcaagcauagcaugguggaucgcggcugggggaauggauguggccuguucgggaaaggaggcaucgugaccugcgcuauguuuacaugcaagaaaaacauggaggggaagauuguccagccugaaaaucucgaguacacgaucguugugacaccccacucuggagaagaacaugccgugggcaacgacacaggcaaacacgggaaggagaucaaagucaccccucaguccagcauuacagaagcggagcugaccggauauggcacggugaccauggaauguucucccagaacagggcuugauuucaaugagaugguucugcuccaaauggaaaacaaggccuggcuggugcaccggcagugguuucuugaccugccgcucccuuggcugcccggagcugauaagcaggaguccaauuggauccagaaagagacccuggucacauucaagaacccucaugccaaaaagcaagacgugguugugcucggcagccaggaaggggcuaugcacaccgcccugacgggcgccacagagauucagauguccucuggaaaucuucuguuuaccggccaucucaaaugccgccugagaauggacaaacuucaacugaaggggaugagcuacuccauguguacaggaaaauucaaggucgugaaagaaaucgcugagacccagcacggcaccauugucauccgggugcaguaugagggggauggaagccccugcaagauccccuucgaaauuauggaccucgagaaaagauacguucugggccgccugaucacagugaacccuauugucacggaaaaggauucuccggugaacaucgaggcggaacccccuuuuggggacuccuacauuaucauuggcguugagcccggacagcucaagcugaauugguucaaaaagggcagcucuaucgggcaaauguuugagaccacaaugcggggagccaaaagaauggcuauccuuggcgauaccgccugggacuucgggagccugggaggcguguuuacauccauugggaaggcccuccaucaggucuucggcgcuaucuauggagccgcguuuucuggcgugagcuggaccaugaaaauucugaucggggugauuaucacguggaucggaaugaacucccgcagcacaucucuguccguuagccuuguccucgugggcauugugacccuguaccugggggucauggugcaggcugauucuggauguguuguguccuggaagaauaaggaacucaaaugcggcagcgggaucuucauuaccgacaacguccacacauggaccgagcaguauaaguuucaaccugaaucccccucuaaacuggccagcgccauccagaaggcucaggaggaaggcauuuguggaauccgguccgugacaagacuugagaaucugauguggaaacagaucacgccggagcucaaccacauucuggccgaaaaugagguuaagcugaccaucaugacaggcgauauuaaagggaucaugcaagcuggaaagcgcucucuucggccucagcccaccgaacucaaguacagcuggaaaacauggggcaaggccaaaaugcuguccaccgagagcuauaaccagacguuccugauugacgggccugaaaccgcggagugccccaauacaaacagagccuggaacucucucgagguggaagauuacggauuuggcgucuucaccacaaacaucuggcugaaacuuaaagagaagcaggacgcuuuuugugacuccaagcugaugagcgccgcuaucaaagauaaucgcgccgugcaugcggacaugggcuauuggauugaaucugcccucaacgauaccuggaagaucgagaaggcuagcuucauugagguuaagaauugccacuggccuaaaagccauacacuguggucuaacggggugcuggaaagcgagaugaucauucccaagaaccuugccggaccggucucccaacacaauuaccggccuggcuaccacacccagaucgcugggcccuggcaucucggaaagcuggaaauggacuucgauuuuugugacggcacgacagugauugugaccgaggauugcgggaacagaggacccagccugcgcaccacaaccgccucuggcaaacucaucacggaauggugcugucgguccugcacacugccuccgcuuagauaucggggcgaggacggguguugguacggaauggagauccgcccccugaaggaaaaagaggaaaaucucgucaacagccugguuaccgccggccacgggcaaguggauaauuucucccugggagugcuuggcauggcucucuuucuggaggaaaugcugagaacacgggucgggaccaagcaugcgauucuccugguggccguuucuuucgugacacuuaucaccggaaacaugagcuuuaaagaccugggcagagucgugguuauggugggcgcuacgauggccgaugacauugggaugggagucaccuaucucgcccugcuggcugccuucaaggugcgcccuacauuugcggcuggccuucugcuccggaagcugaccuccaaagagcucaugaugacaaccaucgggauuguucugcuuucucaaagcacgauccccgagacagugcuggaacucaccgaugcccuggcccugggaaugaugguccuuaagaucgugagaaauauggagaaauaccagcuggcugugacaauuauggccauccucugcgucccuaacgcgguuauucugcagaaugcuuggaagguguccuguaccauccucgccguggucucugugagcccccugcuucugaccuccagccagcagaagaccgacuggauuccucucgcccugacgaucaagggccugaaccccaccgcuaucuuccuuacaacccugucucgcacaaauaaaaagagauccuggccgcucaacgaagccauuauggcuguugggauggugagcauccuggccucuucccuccugaagaaugacauuccuaugaccggaccccuugucgcgggcggccugcugacggugugcuauguucucacagggcggagcgccgaucuggagcuugaacgcgcuaccgacgugaaaugggaggaucaggccgagaucucuggauccagcccuauucuguccaucaccauuagcgaagacggcucuaugagcaucaagaacgaggaagaggagcagacacucaccauccugauuagaacagggcuccuggucaucuccggacuuuuucccauuucuaucccgauuacggcugccgccugguaccugugggaagugaaaaagcagcgggcuggcguccugugggaugugccuucucccccucccauggggaaagcggagcucgaagacggagccuaucgcaucaagcaaaagggcauccugggcuacucccagauuggggcuggaguuuacaaagagggcaccuuccacacaauguggcaugugaccagaggggccguccuuaugcacaagggaaaacggaucgaacccuccugggccgaugugaagaaagaccugauuagcuauggcgggggauggaagcucgagggcgaguggaaggaaggcgaggaaguucaggugcuggcucucgagccugggaaaaauccgcgcgccguccagacaaagcccggacuguuuaaaaccaacacgggcaccaucggggcggugucccuugauuucucuccuggaacaagcggcucccccauuaucgacaagaaagggaaggugguuggacuguacggcaacggcgucgugaccagaagcggggcuuaugugucugccaucgcccaaacaggaaaguccauugaagauaauccugagaucgaggacgauauuuuucggaaacgcagacugaccaucauggaccuccaccccggcgcugggaagacaaaacgguaccugccugccauugucagagaagcgaucaagcgcggacuucggacgcugauucucgcuccgaccagagugguugccgccgagauggaagaggcucugcgcggccuccccauccgguaucagaccccugccaucagagcugaacauaccgggcgcgagauuguggaccugaugugucacgccaccuucacaaugcggcuucugagccccgucagagugccuaacuacaaucugaucauuauggaugaggcgcauuucacggaccccgccucuaucgcugcccgcggcuauauuuccacccggguugaaaugggagaggcugccggcaucuuuaugacagccaccccgccugggagcagagaucccuucccccaguccaacgcuccuaucauugacgaggaacgggagauccccgaacgcucuuggaauagcggacacgagugggugacagauuuuaaaggcaagaccgucugguucgugccuuccauuaaggcggggaacgacaucgccgcuugccuccgcaagaauggaaagaaaguuauucaacugagccggaagacguuugauucugaauacgugaaaacacgcaucaacgacugggauuucgucgugaccaccgacaucuccgagaugggcgccaauuuuaaggccgaaagagugauugauccgcggagauguaugaaacccgucauccuuacagacggggaggagcgcguuauucuggcuggcccuaugcccgugacccauagcucugccgcgcagcggagaggacgcaucggccggaacccuaagaaugaaaacgaccaguacauuuauaugggggagccccucgaaaaugaugaggacugcgcucacuggaaggaagccaaaaugcugcuggauaacaucaauacaccggagggaauuaucccuagcauguucgagcccgaaagagagaagguggacgccaucgauggcgaauaccgccucagaggggaagcuagaaaaaccuuugucgaccuuaugcgcagaggagaucugccuguguggcuggccuauaagguugcggccgaaggcauuaacuacgcugaccggcgcugguguuucgaugggaucaaaaacaaucagauucucgaggagaacguggaagucgagaucuggacgaaggaaggcgagagaaagaaacugaagccccgguggcuugacgcccgcauuuauuccgauccucuggcucucaaagaguuuaaggaguucgccgcuggaagaaaaucucugacacugaaucucaucaccgagaugggccggcuucccacauucaugacccaaaagacgagagacgcccuggauaaccuggcggugcuccacaccgccgaagcugggggacgcgccuacaaucaugcucugagcgagcuuccggaaacacuggagacccuccugcugcucacacuucuggccaccguuacaggcgggaucuuucuguuccucauguccggacggggcauuggcaagaugacccuggggaugugcugcaucauuacggccucuauccuucugugguaugcucagauucagccucacuggaucgcggccagcaucauucucgaguuuuuccugaucgugcugcucauucccgaacccgagaaacagagaacaccucaagacaaccagcuuaccuacgucgugaucgcuauucugaccgucguggccgccacaauggcuaaugaaaugggauuucuggagaagaccaaaaaggaccucggccugggguccaucgccacacagcagccggaaagcaacauucuugauaucgaccugcgccccgcgucugccuggacgcucuacgcuguugccaccacauucgugaccccuaugcugcggcauuccaucgagaauagcuccgugaacgucucucugacagcuauugccaaucaagcgaccguucucaugggacuuggcaaaggguggccccugagcaagauggauaucggagugccucugcucgccauuggcuguuauucccaggugaaccccaucacgcugaccgcugcccuucugcuccuggucgcucacuacgccauuaucggcccugggcugcaggcuaaggccacaagagaggcgcagaaacgggccgcugccggaaucaugaagaauccgaccguggacggcauuacaguuaucgaucucgaccccauuccuuaugaucccaaauuugaaaagcaacuuggacaggugaugcugcugauccucugcgucacccaggugcugaugaugcgcacgacaugggcucuuugugaggcccugacccucgccacaggaccuauuucuacccugugggaaggcaaccccgggagauucuggaauaccacaaucgcggucagcauggcuaacaucuuucggggauccuaccuggccggcgcuggccuccuuuucagcauuaugaaaaauacgaccaacacacgcagagggaccggaaacaucggcgagacacugggggaaaaguggaaaucucggcugaaugcccucggaaaguccgaguuucaaauuuauaagaaaagcggcauccaggagguggaccgcacccuggccaaggaagggauuaaaagaggagagacggaucaccaugcuguuucucggggcuccgccaaacuucgcugguucguggaaagaaacauggucacaccggagggcaaagugguugaccuggggugcggacggggcggguggagcuacuauuguggaggccucaagaaugugagagaggucaaggggcugaccaaaggaggcccuggccacgaggagcccauccccaugucuaccuacggguggaaccuggugcgccuccagagcggaguggaugucuuuuucaucccucccgaaaagugcgacacacuucugugugauauuggcgaguccucuccuaauccgaccgucgaagcggggcggacacugagagugcucaaccugguggagaauuggcuuaacaauaacacgcaguucugcaucaaaguccugaaucccuacaugccuagcguuauugagaagauggaagcccuccaacgcaaauauggaggcgcucuggugcggaacccccuguccagaaauagcacccaugagauguacuggguguccaacgccucugggaauaucgucagcuccgugaacaugauuucucgcaugcucaucaaccgguuuacaaugagacacaagaaggcuaccuaugaaccugacguugaccuuggaagcggcacacgcaauauuggcaucgaguccgaaauccccaaccuggauauuaucgggaaacggauugagaagaucaaacaggagcaugaaaccucuuggcacuacgaccaggaucacccguauaagacgugggccuaccauggaagcuaugagaccaaacagacaggcuccgcgagcucuauggugaauggggucgugagacugcucaccaagccuugggacguucugcccacagugacccaaauggccaugacagauaccacgccuuucggacagcagcgcgucuuuaaggaaaaaguggacacacggacccaggagcccaaggaaggcaccaagaaacuuaugaaaauuacagcugaguggcuguggaaagagcucgggaaaaagaagacgccuagaauguguacccgcgaagaguucacaagaaaagugcgguccaacgccgcucugggagccaucuuuaccgaugaaaauaaguggaaaagcgcucgcgaggccgucgaggacucuagauucugggaacugaucgauaaggagcggaaccuccaccuggaaggcaaaugcgagacauguguuuacaauaugaugggcaagagagaaaagaaacuuggggaguuuggaaaggcgaaaggcucccgggccauuugguacauguggcugggggcucgcuuccucgaguuugaagcccugggauuccuuaacgaggaccauugguuuagcagagaaaauucucuguccggcguggagggggaaggccuccacaagcugggauauauccugcgggaugugagcaaaaaggagggcggggcuauguacgccgacgacaccgccggaugggauacacgcauuacccucgaggaccugaagaacgaagagauggucacgaaucacauggaaggcgagcauaagaaacuugcggaagcuaucuucaaacugaccuaucaaaacaaagugguuagagugcagcggcccacaccgcgcgggaccgucauggauauuaucuccagacgggaccagcgcggaagcggccaaguggggacauacggccucaauaccuuuacgaacauggaggcccagcugaucagacagauggagggagaaggcguuuucaaaaauauucagcaccuuacagugaccgaggaagucgccgugcaaaacuggcuggcucggguugggcgcgagagacucucucggauggccaucagcggagaugacugcguggucaagccucuggaugaccgcuucgcuaacgcccugacagcgcucaaugauaugggcaaggugagaaaagacauucagcagugggagcccuccaagggguggaacgauuggacccagguccccuuuugcucucaucacuuccaugaacugaucaugaaagacggacgggugcuuguugugccuuguagaaaucaagaugagcugauugcccgcgcucggaucagccagggcgccggguggucccucagagaaacggcuugccugggcaagucuuaugcccagauguggagccuuauguacuuucaccgccgggaccugagacucgcggccaacgcuauuuguuccgccgucccgucucacugggugcccaccagccgcacaaccugguccauccaugcuaaacacgaguggaugacaaccgaagacaugcugacaguguggaaucggguuuggaucagagagaacccuuggauggaggauaagacccccguggaaagcugggaggaaauuccuuaucugggaaagcgcgaggaccaguggugcggcucucucaucgggcugacgucccgggccacaugggcuaaaaauauucaagccgcgaucaaccaggucagaagccuuauuggaaaugaagaguacaccgauuacaugcccucuaugaagcgcuuccggagagaggaagaggaagccggcgugcugugguga

SEQ ID NO: 20051 - RNA, 9876 nt, Artificial Sequence
  derived and/or modified CDS sequence (opt5) from DENV-2__FJ205877__SS-prME
agcgccggcaugaucauuaugcugauccccaccgugauggcuuuccaccucaccacgagaaauggggagccucauaugauugucggaauccaggaaaagggcaagagccugcuuuucaagaccgaggacgggguuaauaugugcacccugauggccauggaucucggagaacugugugaggacaccauuaccuacaagugcccccuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgaaagacgcuacgugcugggacggcugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagcgcauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccggagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauuagauccguuacacgccuugagaaucugauguggaagcagaucacgccggaacucaaccacauccuggccgagaaugaagugaaacugaccauuaugacaggagauaucaagggcauuaugcaagcugggaaacggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuacagaccuggauaccacacccagauugcuggccccuggcaucucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuauuaccgggaacaugagcuuuaaggaccugggacgcgugguugugauggucggcgcuacgauggccgaugacaucggcaugggggugaccuaucucgcccugcuggcugccuucaaaguucggccuacauuugcggcuggacuucugcucagaaagcugaccuccaaggagcucaugaugacaaccauuggcaucgugcugcuuucucaaagcacgauucccgaaacaguccuggagcucaccgaugcccuggcccuggggaugauggugcuuaaaaucgugcgcaauauggaaaaguaccagcuggcugucacaaucaugaccauucucugcguuccuaacgccgugauccugcagaaugcguggaaaguguccuguaccauucucgcugucgugucuguuagcccccugcuucugacauccagcagacagaagacggacuggaucccucucgcccugaccauuaaaggacugaaccccacagccaucuuccuuaccacacugucucggaccaauaagaaacgcuccuggccgcucaacgaggcuaucauggccgugggcauggucagcauucuggcuucuucccuccugaagaaugacaucccuaugacggggccccuuguggccggaggccugcugacaguuugcuaugugcucaccggcagaagcgcggaucuggaacuugagcgggccaccgacgucaagugggaggaucaagcugaaauuucuggguccagcccuauccuguccauuacaaucagcgaggacggaucuaugagcauuaaaaacgaagaggaggaacagacccucacaauccugauccgcacgggccuccuggugauuuccgggcuuuuucccaucucuauuccgaucaccgccgcugccugguaccugugggaggucaagaaacagagagccggagugcugugggauguuccuucucccccucccaugggcaaggcugaacucgaggacggggcguaucggauuaaacagaagggaauccugggcuacucccaaaucggcgccgggguguacaaggaaggaacauuccacaccauguggcaugucacacgcggcgcugugcuuaugcacaaagggaagagaauugagcccuccugggccgauguuaaaaaggaccugaucagcuauggaggcggguggaaacucgagggagaauggaaggagggcgaagaggugcagguccuggcccucgaaccuggcaagaauccgcgggcugugcagaccaaacccgggcuguuuaagacgaacaccggaacaauuggcgccgugucccuugauuucucuccugggaccagcggaucccccaucauugacaaaaagggcaaaguugucgggcuguacggaaacggcguggugacacgcagcggcgcguaugucucugcuaucgcccagaccgagaaguccaucgaggauaauccugaaauugaggacgauaucuuuagaaagcggagacugacaauuauggaccuccaccccggggccggaaaaacgaagcgcuaccugccugcuaucgugcgggaagccauuaaaagaggccuucgcacccugauccucgcgccgacacggguuguggcugccgagauggaagaggcccugagagggcuccccauucgcuaucaaaccccugcuauccgggccgagcauaccggaagagaaaucgucgaccugaugugucacgcuacauucacgaugcgccuucugagccccgugcggguuccuaacuacaaucugauuaucauggaugaggcccauuucaccgaccccgcgucuauugccgcuagaggcuauaucuccacacggguggaaaugggggaggccgcuggcauuuuuaugaccgccacaccgccuggaagccgcgaucccuucccccaguccaacgccccuaucaucgacgaggaaagagagauucccgaacggucuuggaauagcggccacgagugggucaccgauuuuaaggggaaaacggugugguucguuccuuccaucaaggcuggaaacgacauugcggccugccuccgcaagaauggcaaaaaggugauccagcugagcagaaaaacauuugauucugaauacgucaagacccggaccaacgacugggauuucguggugacaaccgacauuuccgagaugggggcuaauuuuaaagccgagagagucaucgauccgcgccgguguaugaagcccguuauccuuacagacggagaagagagagugauucuggccggcccuaugcccgugacccauagcucugcugcccaacgccgggggagaaucggccgcaacccuaaaaaugaaaacgaccaguacauuuauaugggagagccccucgaaaaugaugaggacugcgcgcacuggaaggaggcuaagaugcugcuggauaacaucaauacgccggaaggcauuaucccuagcauguucgagcccgaacgggagaaagucgacgccauugauggggaauacagacuccgcggagaggccagaaagacauuuguggaccuuaugcggcgcggcgaucugccuguuuggcuggcuuauaaaguggccgcggaggggaucaacuaccccgacagacggugguguuucgauggaaucaagaacaaucagauucucgaagagaacgucgaaguggagaucuggccuaaagagggcgaacgcaagaagcugaaacccagauggcuugacccgcggauuuauuccgagccuagagcccugaaggaauuuaaagaguuuccgcccgggcgcaagucucucacccugaaucugaucacagaaaugggccggcucccuaccuucaugacgcagaaaaccagagaugcucuugacaaccuggccggacugcacacagcugaggccggcgggcgcgcugauaaucaugcccucagcgagcuggcggaaacccuugagacacugcuccugcugacccuccuugccacaggaaccggcgggauuuuucuguuccugauguccggacggggcaucggcaagaugacgcucgggaugugcugcaucauuacagcuucuauccugcuuugggacgcccaaauucagccgcacuggaucgcugccagcauuauccuggaauuuuuccucaucguucugcugauucccgagccugaaaagcagagaacaccccaggacaaccaacucaccuacguggucaucgccauucuuacaguggucggagcuaccaugccuaaugagaugggcuuucuggagaaaacaaagaaagaucuggggcucggauccaucgcgacgcagcagcccgaaagcaacauucuggacaucgaucuucggccugccucugcuuggacccuguaugccguggccacaaccuucguuacaccgaugcuccgccauuccauugagaauagcuccgugaacgugucucugaccgcuaucgccaaucaggcgacgguccugaugggccucgggaagggaugggcccuugcuaaaauggacaucggcguuccccugcugggcauuggguguuacagccaagugaacccuaucacccucacaggagcccugcuucugcucggcgggcacuacgcuauuaucggacccggccugcaggccaaggcgaccagagaagcccagaagcgggcugccccugggauuaugaaaaaucccacaguggauggaaucaccgucaucgaccuggauccgauuccuuaugaccccaaguuugagaaacagcucggccaagugaugcuucugauccugugcguuacgcagguccucaugaugcgcacaaccugggcucugugugaagcccuuacacuggcuaccggccccauuuccacccucugggaggggaacccuggaagauucuggaauacaacgaucgccgucucuauggcgaacauuuuucggggcagcuaccuggccggggcuggacugcuguucuccaucaugaagaauaccacaaacacccgcagaggcacagggaacaugggagagacccuuggcgaaaaauggaaaagccggcugaaugcccugggcaaaucugaguuucagaucuauaagaaguccgggauucaagaaguggaucgcacgcucgcuaaagagggaaucaagagaggcgagacagaccaccaugccgucagccgggggucugccaaacugagaugguucguggaacgcaacaugguuacccccgagggaaagguggucgaucuuggcugcgcgagagggggaugguccuacuauuguggcggccugaaaaaugugcgggaaguuaaggggcucaccaagggaggcccugggcacgaggaaccgauucccaugagcacauacggauggaaccuggugcgccugcagucuggcgucgacguguuuuucaucccucccgagaaaugcgauacccuccuuugugacauuggggagagcuccccuaaucccacaguggaagcuggacggacgcugagaguucugaaccucgucgagaauuggcugaacaauaacacccaguucugcaucaaggugcuuaauccguauaugccuucugugaucgagaagauggaggcccugcagcgcaaguacggcggcgcucucguccggaacccccugagcagaaauuccacacaugaaauguacuggguuagcaacgccuccgggaauauugugucuagcgugaacaugaucucccgcaugcugauuaaccgguuuaccaugagacacaaaaaggccacauaugagccugacgucgaucucggaucuggcacccgcaauaucgggauugagagcgaaauccccaaccuugacauuaucggaaagcggaucgagaaaauuaagcaagaacaugagacguccuggcacuacgaucaggaccacccuuauaaaaccugggcuuaccauggcucuuaugaaacaaagcagaccgggagcgccuccagcauggugaauggaguugugagacugcugacaaaacccugggauguccucccgaccgugacacagauggcgaugaccgacacgacaccuuucggccaacagcgcguuuuuaaggagaagguggauaccagaacccaggaccccaaagagggcacaaagaaacugaugaagaucacggccgaauggcuuuggaaagagcuggggaagaaaaagacaccccggauguguacacgcgaagaguucaccagaaagguccggucuaacgcugcccucggagcuauuuuuacagaugagaauaaauggaaguccgccagagaagcgguggaggacagccgguucugggaacugguggauaaagagcgcaaccugcaccucgaaggcaagugcgagaccugugucuacaauaugauggggaaaagagagaagaagcugggagaauuuggcaaagccaaggcuucucgggccaucugguauauguggcuuggggcucgcuuccuggaguuugaagcccucggcuuccugaacgaggaccauugguuuuccagagaaaauagccuuucuggaguugagggcgaggggcugcacaaacucggauacauucugcgggacguguccaagaaagaaggcggggcuauguacgccgaugacacagcgggaugggauacccgcaucacgcuggaggaccucaagaacgaagagauggugaccaaucacauggaaggcgagcauaagaaacuggccgaggcuaucuucaaacuuacauaucagaacaaagucgugagaguucaacggccuaccccgcgcgggacagugauggauauuaucagcagacgggaccagcgcggcuccggacaggucgccaccuacggccugaauacguuuacaaacauggaagcucaacucauuagacagauggagggggaaggaguguucaagaauauccagcaccugaccguuacagaggagguggccguccagaacuggcuugcccgggugggccgcgaaagacugccccggauggcgauuagcggggaugacugcguugugaaaccucucgaugcuagauucgccaacgcccugaccgcucugaaugccaugggaaagauccgcaaggacauccaacagugggagcccucuaaaggcuggaacgauuggacgcaggucccuuuuugcagccaucacuuccaugaacucauuaugaaggacgggcgggugcuggucgugcccuguagaaaucaggaugagcuuaucggccgcgcucggauuucccaaggagccggcuggucucugagagaaaccgcgugccucgggaaaagcuaugcccagauguggucccugauguacuuucaccgccgggaccuuagacuggcugccaacgcuaucuguucugccguuccuagccacugggugcccacaucccgcaccacauggucuauucaugcgaagcacgaguggaugaccacagaggacaugcucaccgucuggaauaaaguguggauccgggaaaacccguggauggaggauaagacgccuguggaaagcugggaggaaauucccuaucugggaaagagagaggaccaguggugcggcucccugaucgggcucacaagccgcgccaccugggcuaaaaauauccaggccgcuauuaaccaaguucggucucugaucggaaaugaggaauacaccgauuauaugccuuccaugaagagauuccggagagaggaagaggaagccggcgugcuuugguga

SEQ ID NO: 20052 - RNA, 9876 nt, Artificial Sequence
  derived and/or modified CDS sequence (opt5) from DENV-2__FJ024454__SS-prME
agcgccggcaugaucauuaugcugauccccaccgugauggcuuuccaccugaccacgcggaauggggagccucauaugauugucggaauccaggaaaagggcaagucccugcuuuuuaagaccgaggacgggguuaauaugugcacccugauggccauggaucucggagaacugugugaggacaccauuacauacaagugcccccuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggacccguuacgauggaguguucuccgagaaccggccuugauuucaaugaaauggugcugcuccagauggagaacaaagccuggcugguccaccggcagugguuucuugaccugccucuccccuggcugccuggggcugauaagcaggaguccaauuggauucaaaaggaaacacuggugaccuucaaaaacccccaugccaagaaacaggacguugugguccucggaagccaggagggcgcuaugcacacagcccugaccggggccacggaaauccaaauguccucuggcaaucuucuguuuacaggacaucucaagugccgccugagaauggacaaacuucagcugaagggcaugagcuacuccauguguaccgggaaguucaaaguggucaaggagauugcugagacacagcacggaaccaucgugauucggguucaguaugaaggcgaugggagccccugcaaaaucccuuucgagaucauggaccucgaaaagagauacgugcugggacgccugauuaccgucaacccgaucgugacagagaaagauucucccguuaacauugaagcggagccucccuuuggcgacuccuacaucauuaucgggguggagccuggccaacucaagcugaauugguucaagaaaggaagcucuauuggccagauguuugaaacgaccaugagaggggccaagagaauggcuauccuuggagauacagccugggacuucggcagccucgggggagucuuuaccuccaucggcaaagcccuccaucagguguucggggcuauuuauggcgccgcguuuucuggagugagcuggacaaugaagauccugauuggcguuaucauuaccuggaucgggaugaacucccgcagcacgucucuguccgucagccuugugcucgugggaaucgucacacuguaccugggcgugaugguucaggcugauucuggguguguggucuccuggaaaaauaaggagcucaagugcggaagcggcauuuucaucaccgacaacgugcacaccuggacagaacaauauaaauuucagcccgaguccccgucuaagcuggccagcgccauucagaaagcucaggaagaggggaucuguggcauucgguccguuaccagacuugagaaucugauguggaagcaaaucacaccugaacucaaccacauccuggccgagaaugaagugaaacugacgauuaugaccggagauaucaagggcauuaugcaggcugggaaacgcucucuucggccccagccuacagagcucaaguacagcuggaagaccuggggaaaagccaagaugcuguccacagaaagcuauaaccagaccuuccugaucgacggccccgagacggcggagugcccuaauaccaacagagccuggaacucucucgaagucgaggauuacggguuuggaguguucacaaccaacauuuggcugaaacuuaaggaaaaacaagacgcuuuuugugacuccaagcugaugagcgccgcuaucaaggauaaucgcgccguucaugcggacaugggcuauuggaucgagucugcccucaacgauacauggaaaauugagaaggcuuccuucaucgaagugaaaaauugccacuggcccaagagccauacccuguggucuaacggcguccuggagagcgaaaugauuaucccgaaaaaccuugccgggccugugucccagcacaauuaccggcccggauaccacacacagauugcuggccccuggcaucucgggaagcuggagauggacuucgauuuuugugacggaaccacggugaucgucacagaagauugcggcaacagagggccuagccugcgcaccaccacagccucuggaaagcucauuaccgaguggugcugucgguccugcacgcugccgccccuuagauaucggggcgaggacggcuguugguacgggauggaaauccgcccucugaaagagaaggaagagaaucucguuaacagccuggugacagccggacacggccaaguggauaauuucucccuggggguccuuggaauggcucucuuucuggaagagaugcugagaacccgggugggcacaaaacaugcgauccuccugguugccgugucuuucgucacccuuauuacagggaacaugagcuuuaaggaccugggaagagugguugugauggucggcgcuaccauggccgaugacaucggcaugggggugacguaucucgcccugcuggcugccuucaaaguucgccccaccuuugcggcuggacuucugcuccggaagcugacauccaaggagcucaugaugaccacaauuggcaucgugcugcuuucucagagcaccauuccugaaacgguccuggagcucacagaugcccuggcccuggggaugauggugcuuaaaaucgugagaaauauggaaaaguaccagcuggcugucaccaucauggccauucucugcguucccaacgcggugauccugcagaaugcuuggaaaguguccuguacaauucucgccgucgugucuguuagcccucugcuucugaccuccagccaacagaagaccgacuggaucccccucgcccugacaauuaaaggacugaacccgacggcuaucuuccuuaccacacugucucgcaccaauaagaaaagauccuggccucucaacgaggccaucauggcugugggcauggucagcauucuggccucuucccuccugaagaaugacauccccaugacagggccucuuguggcgggaggccugcugaccguuugcuaugugcucacgggccggagcgccgaucuggaacuugagcgcgcuacagacgucaagugggaggaucaggccgaaauuucuggguccagccccauccuguccauuaccaucagcgaggacggaucuaugagcauuaaaaacgaagaggaggaacagacccucacaauccugaucagaaccggccuccuggugauuuccgggcuuuuuccgaucucuauuccuaucacagcugccgccugguaccugugggaggucaagaaacaacgggcuggagugcugugggauguucccagcccuccgcccaugggcaaggcggaacucgaggacggggccuaucgcauuaaacagaagggaauccugggcuacucccagaucggcgcugggguguacaaggaaggaacguuccacaccauguggcaugucacaagaggcgccgugcuuaugcacaaagggaagcggauugagccuucuugggccgauguuaaaaaggaccugaucagcuauggaggcggguggaaacucgagggagaauggaaggagggcgaagaggugcagguccuggcucucgaaccgggcaagaauccccgcgccgugcaaaccaaaccugggcuguuuaagacaaacaccggaacgauuggcgcggugucccuugauuucucucccgggaccagcggauccccuaucauugacaaaaagggcaaaguugucgggcuguacggaaacggcguggugacaagaagcggcgcuuaugucucugccaucgcccagaccgagaaguccaucgagaauaaccccgaaauugaggaugacaucuuucggaagcgcagacugacaauuauggaucuccacccuggggcuggaaaaaccaagcgguaccugccggccaucgugagagaagcgauuaaacgcggccuucggacacugauccucgcucccacgagaguuguggccgccgagauggaagaggcucugcgcgggcucccuauucgguaucagacccccgccaucagagcugagcauacaggacgcgaaaucgucgaccugaugugucacgccaccuucaccaugcggcuucugagcccugugagaguucccaauuacaaccugauuaucauggacgaggcgcauuucacagauccggccucuauugcugcccgcggcuauaucuccacgcggguggaaaugggggaggcugccggcauuuuuaugaccgccacaccucccggaagcagagaccccuucccucaauccaaugcucccaucaucgaugaggaacgggagauuccugaacgcucuuggaacagcggccacgagugggucaccgacuuuaaggggaaaacagugugguucguuccguccaucaaggcgggaaaugauauugccgcuugccucagaaagaacggcaaaaaggugauccagcugagccggaaaaccuuugacucugaauacgucaagacgcgcacaaaugauugggacuucguggugaccaccgauauuuccgagaugggggccaacuuuaaagccgagagagucaucgacccccggagauguaugaagccuguuauccuuacagauggagaggaacgcgugauucuggcuggccccaugccugugacccauagcucugccgcgcagcggagagggcgcaucggccggaaucccaaaaacgaaaaugaccaguacauuuauaugggagagccgcucgaaaacgacgaggauugcgcucacuggaaggaggccaagaugcugcuggacaauaucaacacaccugaaggcauuauccccagcauguucgagccugaaagagagaaagucgaugccauugacggggaauaccgccuccggggagaggcuagaaagaccuuuguggaucuuaugcgcagaggcgaccugcccguuuggcuggccuauaaaguggcggccgaggggaucaacuacgcugaucggcgcugguguuucgacggaaucaagaauaaccaaauucucgaagagaaugucgaaguggagaucuggccuaaagagggcgaaagaaagaagcugaaaccccgguggcuugaugcccgcauuuauuccgacccgcuggcucucaaggaguuuaaagaguucgccgcugggagaaagucucugacgcugaaccucaucacagagaugggccggcuuccuaccuucaugacacagaaaaccagagaugcccuggacaaucuggcgguucuccacacggccgaagcuggaggccgcgccuacaaccaugcucugagcgagcuucccgagacccuggaaacacuccugcugcucacccuucuggccacagugaccgggggaauuuuucuguuccucauguccggccgggggaucggaaagaugacacugggcaugugcugcaucauuaccgccucuauccuucugugguaugcucagauucagccccacuggaucgcggccagcauuauccucgaguuuuuccugaucguccugcucauuccugaaccggagaagcaaagaacgccccaggauaaucagcuuacauacguggucaucgcuauucugaccgugguugccgccaccauggcuaacgaaaugggcuuucuggagaaaacaaagaaagaccucgggcugggauccaucgccacccagcaaccugagagcaauauucuugacaucgaucugcgccccgcgucugccuggacacucuacgcuguggccacgaccuucgugacaccuaugcugcggcauuccauugaaaacagcuccgucaauguuucucugaccgcuaucgccaaccaggcgacagugcucaugggccuugggaagggauggccccugagcaaaauggacaucggcgugccucugcucgccauuggguguuauucccaggucaauccgaucacccugacggcugcccuucugcuccugguggcucacuacgccauuaucggacccggccugcaggcuaaggccaccagagaggcgcaaaagcgggccgcugccggcauuaugaaaaacccuacaguugaugggaucaccgugaucgaccucgaucccauuccuuaugaccccaaguuugaaaaacagcuuggacaggucaugcugcugauccucugcgugacacaaguccugaugaugcgcaccacgugggcucuuugugaggcccugacacucgccaccggcccgauuucuacacugugggaagggaauccuggaagauucuggaacaccaccaucgcggugagcauggcuaauauuuuucggggcuccuaccuggccggggcuggacuccuuuucagcaucaugaagaacacaacgaacacccgcagaggcacaggcaauaugggggagacccugggagagaaauggaagucucggcugaacgcccucggcaaauccgaauuucagaucuauaaaaagagcgggauucaggagguugaucgcacacuggccaaagaaggaaucaagagaggcgagaccgaccaccaugcugugucucggggguccgccaaacuucgcugguucgucgagagaaauauggugacgcccgaaggaaagguuguggaucugggcugcggcagagggggauggagcuacuauuguggcgggcucaaaaacguccgggaggugaagggacugacaaagggcgggcccggacacgaagaaccuauucccaugucuaccuacggcuggaaucuggugcgccuccagagcggcguugacgucuuuuucaucccuccggaaaaaugcgauacccuucugugugacauuggggaguccucucccaacccuacaguggaggcgggacggacccugagagugcucaaucuggucgaaaacuggcuuaauaacaauacacaauucugcaucaagguucugaaccccuacaugccuagcgugaucgagaaaauggaagcccuccagcgcaaguauggcggggcucuggugcggaauccccuguccagaaacagcacgcaugagauguacugggucuccaaugccucuggaaacauugugagcuccguuaacaugaucucucgcaugcucauuaaucgguuuaccaugagacacaaaaaggcuacauaugaaccggauguggaccuuggcagcgggacccgcaacaucggaauugaguccgagacaccuaaucuggacaucauuggcaagcggaucgagaagaucaagcaggagcaugaaaccucuuggcacuacgaucaggaccaccccuauaaaacgugggccuaccauggcagcuaugagaccaagcaaacaggguccgcgagcucuauggucaccggagugguuagacugcucacaaaaccuugggaugugcugcccaccgucacacagauggccaugaccgacacgacaccuuucggccagcagcgcguguuuaaggaaaagguggauacccggacccaagaccccaaagaggcuacaaagaaacuuaugaagauuacggccgaguggcuguggaaagaacucgggaagaaaaagaccccgagaauguguacacgcgaggaguucaccagaaagguccgguccaacgcugcccugggagcuaucuuuacagaugagaauaaauggaaaagcgcccgcgaggcgguugaagacucuagauucugggagcugguggauaaagaacggaaccuccaccuggagggcaagugcgaaaccuguguguacaauaugauggggaaaagagagaagaaacuuggagaguuuggcaaagccaagggcucccgggcuauuugguacauguggcugggggcccgcuuccucgaauuugaggcucugggauuccuuaacgaagaccauugguuuagcagagaaaauucucuguccggcgucgaaggggagggacuccacaaacugggcuauauccugcgggaugugagcaagaaagaagggggcgccauguacgccgacgacacagcgggaugggauacccgcauuacgcucgaagaccugaagaacgaggaaaugguuaccaaucacauggagggcgaacauaagaaacuugcugaggccaucuucaagcugacauaucagaacaaaguggucagagugcagcggccuacaccccgcgggacaguuauggauaucauuuccagacgggaccaacgcggaagcggccagguggggaccuacggacucaauacguuuacaaacauggaggcccagcugaucagacagauggaaggcgagggggucuucaagaauauucaacaccuucccgugaccgaagagguugcugugcagaacuggcuggcccgggucggccgcgagagacucucucggaugccuaucagcggagaugacugcguggucaaaccgcuggaugcucgcuuccccacagcccugaccccucucaacgacaugggcaagauuagaaaggauauccaucagugggaccccuccaaaggguggaaugauuggacgcaggucccuuuuugcucucaccauuuccacgaacugaucaugaaggacggacggguucuugugguccccuguagaaaccaagaugaccugauugcgcgcgcccggaucagccagggcccuggguggucccucagagagaccgcuugccugggaaaaucuuaugcccagauguggagccuuauguacuuucaccgccgggaccugagacucgcugccaaugcgauuuguuccgccgugcccucucauugggugccgacaagccgcaccacaugguccauccacgcuaagcaugaauggaugaccacagaggauaugcugaccguuuggaaccggguguggauuagagaaaauccuuggauggaggacaaaacgcccgucgagagcugggaagagaucccuuaucugggcaagcgcgaagaucaguggugcgggucucucauuggccugacaucccgggccaccugggcuaagaacauccaaguggccaucaaucagguuagaagccuuauuggaaacgaggaauacaccgacuacaugcccucuaugaaacgcuuccggagagaggaggaagaggcuggcgugcugugguga

SEQ ID NO: 20053 - RNA, 9876 nt, Artificial Sequence
  derived and/or modified CDS sequence (opt5) from DENV-2__FJ205878__SS-prME
agcgccggaaugaucauuaugcugauccccaccgugacagcuuuccaccugacgacccggaauggggagccucauaugauugucggaauccaggaaaagggcaagagccugcuuuuuaagacagaggacgggguuaauaugugcacccugauggccauggaucucggagaacugugugaggacacaauuaccuacaagugcccgcuucugcggcaaaacgaacccgaggauaucgacuguuggugcaauucuacaagcaccugggugacguauggcaccuguacaaccacaggggagcaccgcagagaaaagcgguccguggcgcucgucccucaugugggaaugggccuggagacccgcacggaaacauggaugucuagcgagggcgcuuggaagcacgcccagagaaucgagaccuggauucugcggcaucccggguucacaaucauggccgcuauucucgccuacaccaucggaaccacacacuuucagcgcguucugauuuucauccuucugacggcuguggccccuuccaugaccaugagaugcauuggcaucucuaaccgggauuuugucgaaggggugagcggaggcuccuggguugacaucgugcucgagcacgggagcugugucacaaccauggcgaagaauaagcccacacuggauuucgaacuuauuaaaaccgaggccaagcagccugcuacgcugcgcaaauauugcaucgaagccaagcucacaaacaccaccacagagucuagauguccgacccaaggagagcccucccugaaagaagaacaggacaagcgguuugugugcaagcauagcaugguggaucgcggcuggggcaauggguguggacuguucggcaaagggggaauugucacaugcgcuauguuuacgugcaagaaaaacauggaaggcaagaucguucagccugagaaucucgaauacaccauuguggugacaccccacucuggggaggagcaugccgucggaaacgacaccggcaaacacggccaggaaaucaaggugacaccucaauccagcaucaccgaggcggaacugacgggguauggaaccguuacaauggaguguucucccagaaccggccuugauuucaaugaaauggugcugcuccagauggagaacaaagccuggcugguccaccggcagugguuucuugaccugccgcucccuuggcugcccggggcugauaagcaggaguccaauuggauucaaaaggaaacacuggugaccuucaaaaacccucaugccaagaaacaggacguugugguccucggaagccaggagggcgcuaugcacacggcccugacaggggccaccgaaauccaaauguccucuggcaaucuucuguuuacaggacaucucaagugccgccugagaauggacaaacuucagcugaagggcaugagcuacuccauguguaccgggaaguucaaaguggucaaggagauugcugagacccagcacggaacaaucgugauucggguucaguaugaaggcgaugggagccccugcaaaauccccuucgagaucauggaccucgaaaagagauacgugcugggacgccugauuacggucaacccuaucgugaccgagaaagauucuccgguuaacauugaagcggagcccccuuuuggcgacuccuacaucauuaucgggguggagcccggccaacucaagcugaauugguucaagaaaggaagcucuauuggccagauguuugaaacaaccaugagaggggcuaagagaauggcuauccuuggagauacagccugggacuucggcagccucggcggggucuuuaccuccaucgggaaagcccuccaucagguguucggggcuauuuauggcgccgcguuuucuggagugagcuggacgaugaagauccugauuggcguuaucauuacauggaucgggaugaacucccgcagcaccucucuguccgucagccuugugcucgugggaaucgucacccuguaccugggcgugaugguucaggcugauucuggguguguggucuccuggaaaaauaaggagcucaagugcggaagcggcauuuucaucacagacaacgugcacaccuggacagaacaauauaaauuucagccugagucccccucuaagcuggccagcgccauucagaaagcucaggaagaggggaucuguggcauucgguccguuacgagacuugagaaucugauguggaagcaaaucaccccggaacucaaccacauccuggccgagaaugaagugaaacugacaauuaugaccggagauaucaagggcauuaugcaggcugggaaacgcucucuucggccucagcccacagagcucaaguacagcuggaagaccuggggaaaagccaagaugcuguccacggaaagcuauaaccagaccuuccugaucgacggcccugagacagcggagugccccaauaccaacagagccuggaacucucucgaagucgaggauuacggguuuggaguguucacaaccaacauuuggcugaaacuuaaggaaaaacaagacgcuuuuugugacuccaagcugaugagcgccgcuaucaaggauaaucgcgccguucaugcggacaugggcuauuggaucgagucugcccucaacgauacauggaaaauugagaaggcuuccuucaucgaagugaaaaauugccacuggccuaagagccauacccuguggucuaacggcguccuggagagcgaaaugauuauccccaaaaaccuugccgggccggugucccagcacaauuaccggccuggauaccacacgcagauugcuggccccuggcaucucgggaagcuggagauggacuucgauuuuugugacggaacaaccgugaucgucaccgaagauugcggcaacagagggcccagccugcgcacaaccacggccucuggaaagcucauuacagaguggugcugucgguccugcacccugccuccgcuuagauaucggggcgaggacggcuguugguacgggauggaaauccgcccccugaaagagaaggaagagaaucucguuaacagccuggugacagccggacacggccaaguggauaauuucucccuggggguccuuggaauggcucucuuucuggaagagaugcugagaacccgggugggcacaaaacaugcgauccuccugguugccgugucuuucgucacccuuauuacggggaacaugagcuuuaaggaccugggaagagugguugugauggucggcgcuaccaugacagaugacaucggcaugggggugaccuaucucgcccugcuggccgcuuucaaaguucgcccuacauuugccgcgggacuucugcuccggaagcugaccuccaaggagcucaugaugacgacaauuggcaucgugcugcuuucucagagcaccauucccgaaacaguccuggagcucaccgaugcucuggcccuggggaugauggugcuuaaaaucgugagaaauauggaaaaguaccagcuggccgucaccaucauggcuauucucugcguuccuaacgccgugauccugcagaaugcguggaaaguguccuguacaauucucgcugucgugucuguuagcccccugcuucugacguccagccaacagaagaccgacuggaucccucucgcccugacaauuaaaggacugaaccccaccgccaucuuccuuacaacccugucucgcacgaauaagaaaagauccuggccgcucaacgaggcuaucauggccgugggcauggucagcauucuggcuucuucccuccugaagaaugacaucccuaugacagggccccuuguggccggaggccugcugaccguuugcuaugugcucaccggccggagcgcggaucuggaacuugagcgcgccacagacgucaagugggaggaucaggcugaaauuucuggguccagcccuauccuguccauuaccaucagcgaggacggaucuaugagcauuaaaaacgaagaggaggaacagacacucacgauccugaucagaaccggccuccuggugauuuccgggcuuuuucccaucucuauuccgaucacagccgcugccugguaccugugggaggucaagaaacaacgggccggagugcugugggauguuccuucucccccucccaugggcaaggcugaacucgaggacggggcguaucgcauuaaacagaagggaauccugggcuacucccagaucggcgccgggguguacagagaaggaaccuuccacacaauguggcaugucacccggggcgcugugcuuaugcacaaggggaaacgcauugagcccuccugggccgauguuaagaaagaccugaucagcuauggaggcggguggaagcucgagggagaauggaaagagggcgaagaggugcagguccuggcccucgaaccuggcaagaauccgagagcugugcaaacgaagcccgggcuguuuaaaaccaacacaggaaccauuggcgccgugucccuugauuucucuccugggacaagcggaucccccaucauugacaagaaaggcaagguugucgggcuguacggaaacggcguggugacccggagcggcgcguaugucucugcuaucgcccagacagagaaauccaucgaggauaauccugaaauugaggacgauaucuuucgcaagagacggcugacgauuauggaccuccaccccggggccggaaagaccaaaagauaccugccugcuaucgugcgcgaagccauuaagcggggccuuagaacacugauccucgcgccgacccgcguuguggcugccgagauggaagaggcccugcgggggcuccccauuagauaucagaccccugcuauccgcgccgagcauacaggacgggaaaucgucgaccugaugugucacgcuacguucaccaugagacuucugagccccgugcgcguuccuaacuacaaucugauuaucauggaugaggcccauuucacagaccccgcgucuauugccgcucggggcuauaucuccaccagaguggaaaugggggaggccgcuggcauuuuuaugacagccaccccgccuggaagccgggaucccuucccccaauccaacgccccuaucaucgacgaggaacgcgagauucccgaaagaucuuggaauagcggccacgagugggucacggauuuuaaagggaagacagugugguucguuccuuccaucaaagcuggaaacgacauugcggccugccuccggaagaauggcaagaaagugauccagcugagccgcaagaccuuugauucugaauacgucaaaaccagaacaaacgacugggauuucguggugaccacagacauuuccgagaugggggcuaauuuuaaggccgagcgggucaucgauccgagacgcuguaugaaacccguuauccuuaccgacggagaggaacgggugauucuggccggcccuaugcccgugacgcauagcucugcugcccagagacgcgggcggaucggcagaaacccuaagaaugaaaacgaccaguacauuuauaugggagagccccucgaaaaugaugaggacugcgcgcacuggaaagaggcuaagaugcugcuggauaacaucaauacaccggaaggcauuaucccuagcauguucgagcccgaacgcgagaaggucgacgccauugauggggaauaccggcucagaggagaggcccgcaaaaccuuuguggaccuuaugagacggggcgaucugccuguuuggcuggcuuauaagguggccgcggaggggaucaacuacgccgaccgcagaugguguuucgauggaaucaaaaacaaucaaauucucgaagagaacgucgaaguggagaucuggacaaaggagggcgaacggaaaaagcugaagccccgcuggcuugacgcuagaauuuauuccgauccucuggcccucaaagaguuuaaggaguucgcugccgggcggaaaucucugacccugaaucucaucacggagaugggcagacuucccaccuucaugacacagaagacccgcgacgcucuggauaaccuggccguucuccacacagcggaagccggaggccgggcuuacaaucaugcccugagcgagcuuccggagacccuggaaacacuccugcugcucacccuucuggcuacggugacagggggaauuuuucuguuccucauguccggcagagggaucggaaaaaugacccugggcaugugcugcaucauuaccgccucuauccuucugugguaugcccagauucagccucacuggaucgcugcgagcauuauccucgaguuuuuccugaucguccugcucauucccgaacccgagaagcaacgcacaccucaggacaaccagcuuaccuacguggucaucgccauucugacagugguugcugccacgauggccaaugaaaugggcuuucuggagaagaccaaaaaggaccucgggcugggauccaucgcuacacagcaaccggagagcaacauucuugauaucgaccugcggcccgccucugcguggacccucuacgccguggcuacaaccuucgugacgccuaugcugagacauuccauugaaaauagcuccgucaacguuucucugaccgccaucgcuaaucaggccacagugcucaugggccuugggaaaggauggccccugagcaagauggauaucggcgugccucugcucgcgauuggguguuauucccaggucaaccccaucacccugacagccgcccuucugcuccugguggcccacuacgcuauuaucggaccuggccugcaggccaaagcuacccgggaggcccaaaagcgcgcggccgcuggcauuaugaagaauccgacgguugacgggaucacagugaucgaucucgaccccauuccuuaugaucccaaauuugaaaagcagcuuggacaggucaugcugcugauccucugcgugacccaaguccugaugaugagaacaaccugggcccuuugugaggcucugacccucgccacaggcccuauuucuacgcugugggaagggaaccccggacgguucuggaauaccacaaucgccgugagcauggcgaacauuuuucgcggcuccuaccuggcuggggccggacuccuuuucagcaucaugaaaaauaccacaaacaccagacggggcacgggcaacaugggggagacacugggagagaaguggaaaucucgccugaaugcucucggcaaguccgaauuucagaucuauaaaaagagcgggauucaggagguugacagaacccuggccaaggaaggaaucaaacggggcgagaccgaucaccaugccgugucucgcggguccgcuaaacuuagaugguucgucgagcggaacauggugacaccggaaggaaaaguuguggaccugggcugcggcagagggggauggagcuacuauuguggcgggcucaagaauguccgcgaggugaaaggacugaccaagggcgggccuggacacgaggaacccauucccaugucuacauacggcuggaaccuggugcggcuccagagcggcguugaugucuuuuucaucccucccgaaaagugcgacacgcuucugugugauauuggggaguccucuccuaauccgaccguggaggccggaagaacacugcgcgugcucaaccuggucgaaaauuggcuuaacaauaacacccaauucugcaucaaaguucugaaucccuacaugccuagcgugaucgagaagauggaagcgcuccagcggaaauauggcggggcccuggugagaaacccccugucccgcaauagcacacaugagauguacugggucuccaacgcuucuggaaauauugugagcuccguuaacaugaucucucggaugcucauuaacagauuuaccaugcgccacaagaaagccacguaugaaccugacguggaccuuggcagcgggacccggaauaucggaacagaguccgagauucccaaccuggauaucauuggcaagagaaucgaaaagaucaaacaggagcaugaaaccucuuggcacuacgaccaggaucacccguauaagacaugggcuuaccauggcagcuaugagaccaaacaaacaggguccgccagcucuauggucaauggagugguucgccugcucaccaagccuugggacgugcugcccauggucacgcagauggcgaugacagauaccaccccuuucggccagcagcggguguuuaaagaaaagguggacacaagaacgcaagagcccaaggaggggaccaagaaacuuaugaaaauuacagccgaauggcuguggaaagagcucggcaagaagaaaaccccucgcauguguacaagagaagaguucacccggaagguccgcuccaacgcugcccugggcgcuaucuuuacagaugagaauaaguggaaaagcgccagagaagcuguugaggacucucgguucugggaacugguggauaaggagagaaaccuccaccuggaagggaaaugcgagaccuguguguacaauaugaugggaaagcgggagaagaaacuuggcgaauuuggcaaagccaaagggucccgcgcgauuugguacauguggcugggagccagauuccucgaguuugaagcucugggcuuccuuaacgaggaccauugguuuagccgggaaaauucucuguccggggucgagggagagggccuccacaagcugggguauauccugcgcgaugugagcaaaaaggaaggcggagccauguacgcugacgacacggccggcugggauaccagaauuacacucgaggaccugaaaaacgaagagaugguuaccaaucacauggaaggggagcauaagaaacuugccgaggcgaucuucaaacugacauaucagaacaaggugguccgggugcagcgccccaccccgagaggaacgguuauggauaucauuucccggcgcgaccaaagaggcagcggacaggugggaacauacggccucaauaccuuuacaaacauggaagcucagcugauccggcagauggagggggaaggcgucuucaaaaauauucaacaccuuaccgugacggaggagguugccgugaagaacuggcuggcccgcgucggaagagaacggcucucucgcauggcuaucagcggcgaugacugcguggucaaaccucuggaugacagauucgccaacgcucugaccgcccucaaugauauggggaagauucggaaggacauccagcagugggagcccuccaaaggauggaacgauuggacacaggugcccuuuugcucucaucacuuccaugaacugaucaugaaggacggcagaguucuuguggucccuugucgcaaucaagaugagcugauugggcgggcgagaaucagccagggagccggcuggucccuccgcgaaaccgcuugccuggggaaaucuuaugcccagauguggagccuuauguacuuucaccggagagaccugcgccucgcugccaacgcgauuuguuccgccgugccgucucacugggugcccacaagccggaccacaugguccauccaugcuaagcacgaguggaugaccacggaggacaugcugacaguuuggaauagaguguggauucgcgaaaacccuuggauggaggauaaaacccccgucgaaagcugggaggaaaucccuuaucugggcaagcgggaggaccaguggugcggaucucucauuggccugaccuccagagccacaugggcuaagaauauccaagccgcuaucaaccaggugcgcagccuuauugggaaugaggaauacaccgauuacaugcccucuaugaaacgguucagacgggaggaagaggaagccggaguucugugguga

SEQ ID NO: 20054 - RNA, 9876 nt, Artificial Sequence
  derived and/or modified CDS sequence (opt5) from DENV-2__FJ205879__SS-prME
agcgccggcaugaucauuaugcugauccccaccgugauggcuuuccaccugacgacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuuauuugcaagcauagcaugguggaucgcggcuggggcaauggguguggacuguucggcaaagggggaaucgugaccugcgcuauguuuacaugcaagaaaaacauggaaggcaagauuguccagccugagaaucucgaauacacgaucguugugacaccccacucuggggaggagcaugccgugggaaacgacacaggcaaacacggcaaggaaaucaaagucaccccucaguccagcauuacagaggcggaacugaccggguauggaacggugaccauggaguguucucccagaacaggccuugauuucaaugaaaugguucugcuccaaauggagaacaaggccuggcuggugcaccggcagugguuucuugaccugccgcucccuuggcugcccggggcugauaagcaggaguccaauuggauccagaaagaaacccuggucacauucaagaacccucaugccaaaaagcaagacgugguugugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugaaagagaucgcugagacccagcacggaaccauugucauccgggugcaguaugaaggcgaugggagccccugcaagauccccuucgagauuauggaccucgagaagcgguacguucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggagucuucaccacaaacaucuggcugaaacuuaaagaaaagcaggacgcuuuuugugacuccaagcugaugagcgccgcuaucaaagauaaucgcgccgugcaugcggacaugggcuauuggauugagucugcccucaacgauaccuggaagaucgagaaggcuagcuucauugaaguuaagaauugccacuggccuaaaagccauacacuguggucuaacggcgugcuggagagcgaaaugaucauucccaagaaccuugccgggccggucucccaacacaauuaccggccuggauaccacacccagaucgcuggccccuggcaucucgggaagcuggagauggacuucgauuuuugugacggaacgacagugguggucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagaccgacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacgucaaaacacgcaccaacgacugggauuucguggugaccacagacauuuccgagaugggggccaauuuuaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaaagagagaaggucgacgccauugauggggaauaccgccuccggggagaggcuagaaaaacguuuguggaccuuaugcgcagaggcgaucugccuguuuggcuggccuauaagguggcggccgaggggaucaacuacgcugaccggcgcugguguuucgauggaaucaaaaacaaucagauucucgaagagaacgucgaaguggagaucuggacaaaggagggcgaaagaaagaaacugaagccccgguggcuugacgcccgcauuuauuccgauccucuggcucucaaagaguuuaaggaguucgccgcugggagaaaaucucugacccugaaucucaucacagagaugggccggcuucccaccuucaugacgcaaaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucacaaccgccucuauucuucugugguaugcucagauccagccucacuggauugcggccagcaucauucucgaguuuuuccugaucguccugcucauccccgaacccgagaaacagagaaccccucaagacaaccagcuuacauacguggucauugcuauccugaccgugguugccgccacaauggcuaaugaaaugggcuuucuggagaagacgaaaaaggaccucgggcugggauccauugccacccagcagccggagagcaacauccuugauauugaccugcgccccgcgucugccuggacacucuacgcuguggccaccacauucgugaccccuaugcugcggcauuccaucgaaaauagcuccgucaacguuucucugacggcuauugccaaucaagcgaccgugcucaugggccuugggaaaggauggccccugagcaagauggauaucggcgugccucugcucgccaucggguguuauucccaggucaaccccauuacacugaccgcugcccuucugcuccugguggcucacuacgccaucauuggaccuggccugcaggcuaaggccacaagagaggcgcagaaacgggccgcugccggcaucaugaagaauccgaccguugacgggauuacggugaucgaucucgaccccaucccuuaugaucccaaauuugaaaagcaacuuggacaggucaugcugcugauucucugcgugacacagguccugaugaugcgcaccacaugggcucuuugugaggcccugacccucgccaccggcccuaucucuacacugugggaagggaaccccggaagauucuggaauacgaccauugcggugagcauggcuaacaucuuucggggcuccuaccuggccggggcuggacuccuuuucagcauuaugaaaaauacaaccaacccgcgcagaggcacaggcaacaugggggagacccugggagagaaguggaaaucucggcugaaugcccucggcaaguccgaauuucaaaucuauaagcgcagcgggauccaggagguugacagaacgcuggccaaagaaggaauuaagcggggcgagacagaucaccaugcugugucucgcggguccgccaaacuuagaugguucgucgagcggaacauggugaccccugaaggaaagguuguggaccugggcugcggcagagggggauggagcuacuauuguggcgggcucaaaaauguccgcgaggugaagggacugaccaagggcgggcccggacacgaagaacccaucccuaugucuacauacggcuggaaccuggugcggcuccagagcggcguugaugucuuuuucauucccccugaaaaaugcgacacccuucugugugauaucggggaguccucuccgaaucccacaguggaggcgggaagaacgcugcgcgugcucaaccuggucgaaaauuggcuuaacaauaacacccaguucugcauuaagguucugaauccuuacaugcccagcgugaucgagaaaauggaagcccuccaacggaaguauggcggggcucuggugagaaacccucugucccgcaauagcacacaugagauguacugggucuccaacgccucuggaaauaucgugagcuccguuaacaugauuucucggaugcucaucaacagauuuaccaugcgccacaaaaaggcuacauaugaacccgacguggaccuuggcagcgggacccggaauauuggaaucgaguccgagauuccgaaccuggauaucauuggcaagagaaucgagaagaucaagcaggagcaugaaacgucuuggcacuacgaccaggaucacccuuauaaaaccugggccuaccauggcagcuaugagacaaagcagaccggguccgcgagcucuauggucaauggagugguucgccugcucacaaaacccugggacgugcugccuaccgucacacaaauggccaugaccgauacgacacccuucggccagcagcggguguuuaaggaaaagguggacaccagaacccaggagccuaaagaggggacaaagaaacuuaugaagauuacggcugaauggcuguggaaagagcucggaaagaaaaagacacccagaauguguacaagagaagaguucacccggaagguccgcuccaacgccgcucugggcgccaucuuuacagaugagaauaaauggaaaagcgcuagagaagccguugaggacucucgguucugggaacugguggauaaagagagaaaccuccaccuggaagggaagugcgagaccuguguguacaauaugaugggaaaacgggagaagaaacuuggcgaauuuggcaaagcgaaggggucccgcgccauuugguacauguggcugggagcuagauuccucgaguuugaagcccugggcuuccuuaacgaggaccauugguuuagccgggaaaauucucuguccggggucgagggagagggccuccacaaacugggguauauccugcgcgaugugagcaagaaagaaggcggagcuauguacgccgacgacacagccggcugggauaccagaauuacgcucgaggaccugaagaacgaagagaugguuaccaaucacauggaaggggagcauaagaaacuugcggaggcuaucuucaagcugacauaucaaaacaaagugguccgggugcagcgcccgaccccuagaggaacaguuauggauaucauuucccggcgcgaccagagaggcagcgggcaagugggaaccuacggccucaauacguuuacaaacauggaagcccagcugauccggcagauggagggggaaggcgucuucaagaauauucagcaccuuaccgugacagaggagguugccgugcaaaacuggcuggcucgcgucggaagagaacggcucucucgcauggccaucagcggcgaugacugcguggucaaaccccuggaugacagauucgcuaacgcccugaccgcgcucaaugauauggggaagauucggaaggacauccagcagugggagcccuccaaaggauggaacgauuggacacaggugccuuuuugcucucaucacuuccaugaacugaucaugaaggacggcagaguucuuguggucccgugucgcaaucaagaugagcugauugggcgggccagaaucagccagggagcuggcuggucccuccgcgaaaccgccugccuggggaaaucuuaugcucagauguggagccuuauguacuuucaccggagagaccugcgccucgccgcgaacgccauuuguuccgcugugcccucucacugggugccuacaagccggaccacaugguccauccaugccaagcacgaguggaugaccacagaggacaugcugaccguuuggaauagaguguggauucgcgaaaaccccuggauggaggauaaaacgccugucgaaagcugggaggaaauccccuaucugggcaagcgggaggaccaguggugcggaucucucauuggccugacauccagagcuaccugggccaagaauauccaagcugccaucaaccaggugcgcagccuuauugggaaugaggaauacaccgauuacaugccuucuaugaaacgguucagacgggaggaagaggaagcgggaguucugugguga

SEQ ID NO: 20055 - RNA, 9876 nt, Artificial Sequence
  derived and/or modified CDS sequence (opt5) from DENV-2__FJ390385__SS-prME
agcgccggaaugaucauuaugcugauccccacagugauggcuuuccaccugacgacgagaaauggggagccucauaugauuguuggaauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgcgacggagaaggauucuccggugaacauugaagccgagcccccuuuuggcgacuccuacaucauuaucgggguugagcccggccagcucaagcugaauugguucaaaaagggaagcucuauuggccaaauguuugaaaccacaaugagaggggcuaaaagaauggccauccuuggagauaccgccugggacuucggcagccucgggggaguguuuacauccaucggcaaggcucuccaucaggucuucggggccauuuauggcgcggcuuuuucuggagugagcuggaccaugaaaauccugauuggcgugaucauuacguggaucgggaugaacucccgcagcacaucucuguccguuagccuuguccucgugggaaucgugacccuguaccugggcgucauggugcaggccgauucuggguguguuguguccuggaagaauaaggagcucaaaugcggaagcggcauuuucaucaccgacaacguccacacauggaccgaacaguauaaguuucaaccugagucccccucuaaacuggccagcgcuauucagaaggcccaggaagaggggaucuguggcauucgguccgugacaagacuugagaaucugauguggaaacagaucacgccggaacucaaccacauccuggcugagaaugaaguuaagcugaccauuaugacaggagauaucaaaggcauuaugcaagccgggaagcgcucucuucggccucagcccaccgagcucaaguacagcuggaaaacauggggaaaggcgaaaaugcuguccaccgaaagcuauaaccagacguuccugaucgacggcccugagaccgccgagugccccaauacaaacagagcuuggaacucucucgaaguggaggauuacggguuuggagucuucaccacaaacauuuggcugaaacuuaaagaaaagcaggacgccuuuugugacuccaagcugaugagcgcugccaucaaagauaaucgcgcggugcaugccgacaugggcuauuggaucgagucugcucucaacgauaccuggaagauugagaaagccuccuucaucgaaguuaagaauugccacuggccuaaaagccauacacuguggucuaacggcgugcuggagagcgaaaugauuauccccaagaaccuugcugggccggucucccaacacaauuaccggccuggauaccacacccagauugccggccccuggcaucucgggaagcuggagauggacuucgauuuuugugacggaacgacagugaucgugaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucgucaacagccugguuaccgcuggacacggccagguggauaauuucucccugggggugcuuggaauggcgcucuuucuggaagagaugcugagaacacgggucggcaccaagcaugccauccuccugguggcuguuucuuucgugacacuuauuaccgggaacaugagcuuuaaagaccugggaagagucgugguuauggugggcgccacgauggccgaugacaucggcaugggggucaccuaucucgcucugcuggccgcguucaaggugcgcccuacauuugcugccggacuucugcuccggaagcugaccuccaaagagcucaugaugacaaccauuggcaucguucugcuuucucaaagcacgauucccgaaacagugcuggagcucaccgaugcccuggcucuggggaugaugguccuuaagaucgugagaaauauggaaaaauaccagcuggccgugacaaucauggcgauucucugcgucccuaacgcuguuauccugcagaaugccuggaaggugggauguaccauucucgccguggucuccgugucuccccugcuucugaccagcucccagcagaagaccgacuggaucccucucgcucugacgauuaagggccugaaccccaccgccaucuuccuuacaacccugagccgcacaaauaaaaagagaucuuggccgcucaacgaggcuaucauggccguugggaugguguccauucuggcgagcucucuccugaagaaugacaucccuaugaccggaccccuugucgccggcggccugcugacggugugcuauguucucacagggcgguccgcugaucuggaacuugagcgcgccaccgacgugaaaugggaggaucaggcugaaauuagcggaucuuccccuauccugagcauuaccaucuccgaggacggcagcaugucuauuaagaacgaagaggaggaacagacacucaccauccugaucagaacagggcuccuggucauuagcggacuuuuucccaucuccauuccgaucacggccgccgcuugguaccugugggaggugaaaaagcagcgggcgggcguccugugggaugugccuucucccccucccauggggaaagccgaacucgaggacggagcuuaucgcauuaagcaaaagggcauccugggcuacagccagaucggggccggaguuuacaaagaaggcaccuuccacacaauguggcaugugaccagaggggccguccuuaugcacaagggaaaacggauugagcccuccugggcugaugugaagaaagaccugaucucuuauggcgggggauggaagcucgagggcgaauggaaggagggcgaagagguucaggugcuggcccucgaaccugggaaaaauccgcgcgcgguccagacaaagcccggacuguuuaaaaccaacacgggcaccauuggggcugugagccuugauuucuccccuggaacaucuggcagccccaucauugacaagaaagggaaggugguuggacuguacggcaacggcgucgugaccagauccggggccuaugugagcgccaucgcucaaacagagaagucuaucgaggauaauccugaaauugaggacgauaucuuucggaaacgcagacugaccauuauggaccuccaccccggagccggcaagacaaaacgguaccugccugcgaucgucagagaagcuauuaagcgcgggcuucggacgcugauccucgccccgaccagagugguugccgcugagauggaagaggcccugcgcggacuccccauucgguaucagaccccugcuaucagauccgagcauaccggccgcgaaaucguggaccugaugugucacgccaccuucacaaugcggcuucugagccccgucagagugccuaacuacaaucugauuaucauggaugaggcgcauuucacggaccccgccucuauugcugcccgcggguauaucuccacccggguugaaaugggcgaggcugccggaauuuuuaugacagccaccccgccuggcagcagagaucccuucccccaguccaacgcuccuaucaucgacgaggaacgggagauucccgaacgcucuuggaauagcgggcacgagugggugacagauuuuaaaggaaagaccgucugguucgugccuuccaucaaggcgggcaacgacauugccgcuugccuccgcaaaaaugggaagaaaguuauccaacugagccggaagacguuugauucugaauacgugaaaacacgcaccaacgacugggauuucgucgugaccacagacauuuccgagaugggagccaauuuuaaggccgagagagugaucgauccgcggagauguaugaaacccgucauccuuaccgacggcgaggaacgcguuauucuggcugggccuaugcccgugacacauagcucugccgcgcagcggagaggccgcaucggacggaacccuaagaaugaaaacgaccaguacauuuauaugggcgagccccucgaaaaugaugaggacugcgcucacuggaaggaggccaaaaugcugcuggauaacaucaauaccccggaagggauuaucccuagcauguucgagcccgaaagagagaagguggacgccauugauggagaauaccgccuccggggcgaggcuagaaaaacguuugucgaccuuaugcgcagaggggaucugccuguguggcuggccuauaagguugcggccgagggaaucaacuacgcugaccggcgcugguguuucgauggcaucaaaaacaaucagauucucgaagagaacguggaagucgagaucuggacaaaggagggggaaagaaagaaacugaagccccgguggcuugacgcccgcauuuauuccgauccucuggcucucaaagaguuuaaggaguucgccgcuggcagaaaaucucugacccugaaucucaucacagagaugggacggcuucccaccuucaugacgcaaaagaccagagacgcccuggauaaccuggcggugcuccacacagccgaagcuggcgggcgcgccuacaaucaugcucugagcgagcuuccggagacccuggaaacacuccugcugcucacccuucuggccacaguuaccggaggcauuuuucuguuccucauguccgggcggggaaucggcaagaugacgcugggcaugugcugcaucauuacagccucuauccuucugugguaugcucagauucagccucacuggaucgcggccagcauuauccucgaguuuuuccugaucgugcugcucauucccgaacccgagaaacagagaaccccucaagacaaccagcuuaccuacgucgugaucgcuauucugacagucguggccgccaccauggcuaaugaaaugggguuucuggagaagaccaagaaggaccucggacugggcuccaucgccacgcagcagccggagagcaacauucuugauaucgaccugcgccccgcgucugccuggacccucuacgcuguugccacaaccuucgugacaccuaugcugcggcauuccauugaaaauagcuccgugaacgucucucugaccgcuaucgccaaucaagcgacgguucucauggggcuuggaaaaggcuggccccugagcaagauggauaucggggugccucugcucgccauuggauguuauucccaggugaaccccaucacccugacagcugcccuucugcuccuggucgcucacuacgccauuaucggcccuggccugcaggcuaaggccaccagagaggcgcagaaacgggccgcugccgggauuaugaagaauccgacaguggacggaaucaccguuaucgaucucgaccccauuccuuaugaucccaaauuugaaaagcaacuuggccaggugaugcugcugauccucugcgucacacaggugcugaugaugcgcacaaccugggcucuuugugaggcccugacacucgccaccgggccuauuucuacccugugggaaggaaaccccggcagauucuggaauacaacgaucgcggucagcauggcuaacauuuuucggggguccuaccuggccggagcuggccuccuuuucagcaucaugaaaaauaccacaaacacccgcagaggcacagggaacaugggagagacccugggcgagaaguggaaaucucggcugaaugcccucgggaaguccgaauuucaaaucuauaagcgcagcggcauucaggagguggacagaacgcuggccaaagaaggcaucaagcgcggggaaacagaucaccaugcuguuucucggggauccgccaaacuuagaugguucguggagcggaacauggucaccccggaaggcaaggugguugaccugggcugcgggagaggaggcuggagcuacuauugugggggacucaaaaaugugcgcgaggucaagggccugaccaaagggggaccuggccacgaagaacccauucccaugucuacauacggcuggaaccuggugcggcuccagagcgggguggaugucuuuuucaucccucccgaaaaaugcgacacccuucugugugauauuggagaguccucuccuaauccgacagucgaggcgggcagaacgcugcgcgugcucaaccugguggaaaauuggcuuaacaauaacacccaguucugcaucaagguccugaaucccuacaugccuagcguuaucgagaaaauggaagcccuccaacggaaguaugggggagcucuggugagaaacccccugucccgcaauagcacacaugagauguacuggguguccaacgccucuggcaauauugucagcuccgugaacaugaucucucggaugcucauuaacagauuuaccaugcgccacaaaaaggcuacauaugaaccugacguugaccuugggagcggaacccggaauaucggcacggaguccgagauucccaaccuggauaucauuggcaagagaaucgagaagaucaagcaggagcaugaaaccucuuggcacuacgaccaggaucacccguauaaaacaugggccuaccaugggagcuaugagaccaagcagacaggauccgcgagcucuauggugaauggcgucgugcgccugcucaccaaaccuugggacguucugcccacagugacccaaauggccaugacggauacaaccccuuucgggcagcagcgggucuuuaaggaaaagguggacaccagaacacaggagcccaaagagggaacgaagaaacuuaugaagauuaccgcugaauggcuguggaaagagcucggcaagaaaaagacaccucgcauguguaccagagaagaguucacacggaaggugcgcuccaacgccgcucugggggccaucuuuaccgaugagaauaaauggaaaagcgcuagagaagccgucgaggacucucgguucugggaacugguugauaaagagagaaaccuccaccuggaaggaaagugcgagacauguguguacaauaugaugggcaaacgggagaagaaacuuggcgaauuugggaaagcgaagggaucccgcgccauuugguacauguggcugggcgcuagauuccucgaguuugaagcccugggguuccuuaacgaggaccauugguuuagccgggaaaauucucuguccggaguggagggcgaggggcuccacaaacugggcuauauccugcgcgaugucagcaagaaagaaggaggcgcuauguacgccgacgacaccgccgggugggauacgagaauuacccucgaggaccugaagaacgaagagauggugacaaaucacaugaagggagaacauaagaaacuugcggaggcuaucuucaaacugaccuaucaaaacaaaguugugcggguccagcgccccacaccgagaggcaccgugauggauaucauuucccggcgcgaccagagagggagcggacaaguuggcacguacgggcucaauacauuuaccaacauggaggcccagcugauccggcagauggaaggcgagggaguguucaaaaauauucagcaccuuacagucaccgaagagguggccguucaaaacuggcuggcucgcgugggcagagagcggcucucucgcauggccaucagcggggaugacugcgucgugaagccucuggaugacagauucgcuaacgcccugacggcgcucaaugauaugggaaagauucggaaagacauccagcagugggaacccuccaagggcuggaacgauuggacccagguccccuuuugcucucaucacuuccaugagcugaucaugaaagacgggagagugcuuguugugccuugucgcaaucaagaugaacugauuggacgggccagaaucagccagggcgcuggguggucccuccgcgagacagccugccugggcaagucuuaugcucagauguggagccuuauguacuuucaccggagagaccugcgccucgccgcgaacgccauuuguuccgcugucccgucucacugggugcccaccagccggacaaccugguccauccaugccaaacacgaauggaugacaaccgaggacaugcugacgguguggaauagaguuuggauucgcgagaacccuuggauggaagauaagacacccguggagagcugggaagagaucccuuaucugggaaagcgggaagaccaguggugcggcucucucauugggcugaccuccagagcuaccugggccaaaaauauccaagcugccaucaaccagguccgcagccuuauuggaaaugaggaguacacagauuacaugcccucuaugaagcgguucagacgggaagaggaagaggcgggcgugcugugguga

SEQ ID NO: 20056 - RNA, 9876 nt, Artificial Sequence
  derived and/or modified CDS sequence (opt5) from DENV-2__FJ024458__SS-prME
agcgccggcaugaucauuaugcugauccccaccgugauggcuuuccaccugaccacgagaaauggggaaccucauaugauugucggaauccaggaaaagggcaagucccugcuuuuuaagaccgaagacgggguuaauaugugcacccugauggccauggaucucggagaacugugugaagacaccauuacauacaagugcccccuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggcgccggucucuuagaccucagcccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacauggauuauuggaucgagucugcccucaacgacaccuggaaaauugagaaggcuuccuucaucgaagugaaaaauugccacugggccaagagccauacacuguggucuaacggcguccuggagagcgaaaugauuaucccuaaaaaccuugcuggccccgugucccaacacaauuacagacucggguaccacacccagauugccggaccguggcaucugggcaagcuggagauggauuucgacuuuugugaugggacgacagugaucgucaccgaagacugcggaaaccgcggcccuagccuccggaccacaaccgccucugggaagcugauuacggaguggugcuguagauccugcacacuuccgccccugcgguaucgcggagaggauggcuguugguacggcauggaaaucagaccucucaaagagaaggaagagaaucugguuaacagccuggugaccgcugggcacggacagguggacaauuucucccuuggcguccucgggauggcgcuguuucuggaagagaugcuccggacaagagugggaaccaaacaugccauccugcuuguugcugugucuuucgucacacugauuaccggcaacaugagcuuuaaggaucucgggcgcgugguugugauggucggagccacgauggccgacgauaucggcaugggcgugaccuaucuggcucugcuugccgcguucaaaguucggccgacauuugcugccgggcugcuccugagaaagcucaccuccaaggagcugaugaugacaaccauuggaaucgugcuucugucucaaagcacgauucccgaaacaguccucgagcugaccgacgcccuggcucuuggcaugauggugcugaaaaucgugcgcaauauggaaaaguaccagcucgccgucacaaucauggcgauucugugcguuccuaacgcugugauccuccagaaugccuggaaaguguccuguaccauucuggccgucgugucuguuagcccccuucugcucaccuccagccagcaaaagacagacuggaucccucuggcucugacgauuaaagggcuuaaccccaccgccaucuuccugacaacccucucuagaacaaauaagaaacgguccuggccucugaacgaggcuaucauggccgugggaauggucagcauucucgcgucuucccugcuuaagaaugauauccccaugaccggcccgcugguggccgggggacugcucacgguuugcuaugugcugacaggccgcagcgcugaccuugaacuggagagagccaccgaugucaagugggaggaccaggcugaaauuucuggcuccagcccuauccucuccauuaccaucagcgaggaugggucuaugagcauuaaaaacgaagaggaggaacagacacugaccauccucauccggacaggacugcuugugauuuccggccuguuucccaucucuauuccuaucacggccgccgcuugguaccugugggaggucaagaaacagcgcgcgggggugcucugggacguucccagcccgccucccaugggaaaggccgaacuggaggauggcgcuuauagaauuaaacaaaaggggauccuuggauacucccagaucggcgccggcguguacaaggaagggaccuuccacacaauguggcaugucacccggggagccgugcugaugcacaaaggcaagcgcauugagccuucuugggcugacguuaaaaaggaucucaucagcuaugggggaggcuggaaacuggagggggaauggaaggagggagaagaggugcagguccucgcccuggaacccggcaagaaucccagagcggugcagacaaaaccuggccuuuuuaagaccaacacggggaccauuggagcugugucccuggacuucucuccgggcacaagcgggucccccaucauugauaaaaagggaaaaguugucggccuguacgggaacggaguggugacccggagcggcgccuaugucucugccaucgcucaaacagagaaguccaucgaggacaauccugaaauugaggaugacaucuuucgcaagagacggcucaccauuauggaccugcaccccggcgccgggaaaacaaagagauaccuuccugcgaucgugcgcgaagcuauuaaacggggacugagaacgcucauccuggcccccacccgcguuguggccgcugagauggaagaggcccuccggggccugccuauuagauaucagacaccggcuauccgcgccgagcauaccgggcgggaaaucgucgaucuuaugugucacgcgaccuucacaaugagacugcugagccccgugcgcguuccuaacuacaaucucauuaucauggacgaggcccauuucacggaucccgcuucuauugccgcucggggauauaucuccaccagaguggaaaugggcgaggccgccgggauuuuuaugacagcuaccccucccggcagccgggacccguucccucaguccaacgcgcccaucaucgaugaggaacgcgagauucccgaaagaucuuggaauagcggacacgagugggucacagacuuuaagggcaaaaccgugugguucguuccuuccaucaaggccgggaacgauauugcugccugccugcggaagaauggcaaaaaggugauccaacuuagccgcaaaacguuugacucugaauacgucaagacaagaaccaacgauugggacuucguggugaccacagauauuuccgagaugggagccaauuuuaaagcugagcgggucaucgaccccagacgcuguaugaagccuguuauccugaccgacggggaggaacgggugauucucgccggaccgaugcccgugacacauagcucugcggcucagagacgcggccggaucgggagaaacccuaaaaaugaaaacgaucaguacauuuauaugggcgagccccuggaaaaugacgaggauugcgcccacuggaaggaggccaagaugcugcucgacaacaucaauaccccugaaggaauuauccccagcauguucgagccggaacgcgagaaagucgaugcuauugacggcgaauaccggcuuagaggggaggcccgcaagacguuuguggaucugaugagacggggagaccugccuguuuggcucgcguauaaaguggccgcugagggcaucaacuacgccgaucgcagaugguguuucgacgggaucaagaacaaucagauucuggaagagaacgucgaaguggagaucuggacaaaagagggagaacggaagaaacuuaaaccccgcuggcuggaugcuagaauuuauuccgacccucucgcccugaaggaguuuaaagaguucgcugccggccggaagucucugacccucaaucuuaucacagagauggggagacugcccaccuucaugacgcagaagacccgcgaugcgcuggacaaccucgccguucugcacacagcugaagccggcggacgggcuuacaaucaugcccuuagcgagcugccugagacccucgaaacacugcugcuccuuacccugcuggccacagugaccggcgggauuuuucucuuccugauguccggaagaggcaucgggaagaugacgcuuggaaugugcugcaucauuacagcuucuauccugcucugguaugcgcagauucagccccacuggaucgccgcuagcauuauccuggaguuuuuccugaucguccuccuuauuccggaaccugagaagcagcgcacaccccaagacaaccagcugaccuacguggucaucgccauucugacagugguugccgcuaccauggccaaugaaaugggcuuucucgagaaaacaaagaaagauuucggccugggguccaucgcgacgcagcagcccgagagcaacauucuugacaucgaucugcggccugccucugcuuggacccucuacgccguggcuacaaccuuugugacaccgaugcugagacauuccauugaaaauagcuccgucaacguuucucugaccgccaucgcgaaucaagccacggugcucaugggacuuggcaagggguggccccugagcaaaauggacaucggagugccucugcucgcuauuggcuguuauucccaggucaaccccaucacccugacagccgcccuucugcuccugguggcccacuacgcuauuaucgggccuggacugcaggccaaggcgacccgggaggcccagaagcgcgcugccgcuggcauuaugaaaaaucccacaguugauggcaucaccgugaucgaccucgauccuauuccguaugaccccaaguucgaaaaacaacuugggcaggucaugcugcugauccucugcgugacgcagguccugaugaugagaacaaccugggcccuuugugaggcccugacacucgcgaccggaccuauuucuacccugugggaaggcaaccccgggcgguuuuggaauacaacgaucgcugugagcauggccaacauuuuccgcggauccuaccuggcuggcgccgggcuccuuuuuagcaucaugaagaauaccacaaacaccagacggggaacaggcaacaucggcgagacccugggggagaaauggaagucucgccugaaugcccucggaaaauccgaguuccaaauuuauaaaaagagcggcauccaggagguugauagaacgcuggcuaaagaagggauuaagcggggagagacagaccaccaugccgugucucgcggcuccgcgaaacuuagaugguuugucgagcggaacauggugaccccugaagggaagguuguggaucugggaugcggcagaggcggguggagcuacuauuguggaggccucaaaaauguccgcgaggugaaggggcugaccaagggaggccccgggcacgaagaacccaucccuaugucuacauacggauggaaccuggugcggcuccagagcggcguugacgucuucuucauuccgcccgaaaaaugcgauacccuucugugugacaucggcgaguccucuccuaaucccacaguggaggccgggagaacgcugcgcgugcucaaccuggucgaaaauuggcuuaacaauaacacccaguuuugcaucaagguucugaauccuuacaugccgagcgugauugagaaaauggaagcucuccaacggaaguauggaggcgcccuggugagaaacccccugucccgcaauagcacacaugagauguacugggucuccaacgcuucugggaauaucgugagcuccguuaacaugauuucucggaugcucaucaacagauucaccaugcgccacaaaaaggccacauaugaaccugacguggaucuuggaagcggcacccggaauauugggaucgaguccgagauucccaaccuggacaucaucggaaagagaauugagaagaucaagcaggagcaugaaacgucuuggcacuacgaucaggaccacccuuauaaaaccugggcguaccauggcagcuaugagacaaagcagaccggcuccgccagcucuauggucaauggggugguucgccugcucacaaaacccugggaugugcugccgaccgucacacaaauggcuaugaccgacacgacaccuuuuggacagcagcggguguucaaggaaaagguggauaccagaacccaggagcccaaagagggcacaaagaaacuuaugaagauuacggccgaauggcuguggaaagagcucgggaagaaaaagaccccucgcauguguacaagagaagaguuuacccggaagguccgcuccaacgcugcccugggagcuaucuucacagacgagaauaaauggaaaagcgccagagaagcgguugaggauucucgguuuugggaacugguggacaaagagagaaaccuccaccuggaaggcaagugcgagaccuguguguacaauaugauggggaaacgggagaagaaacuuggagaguucggcaaagccaagggcucccgcgcuauuugguacauguggcugggggccagauuucucgaguucgaagcucugggauuucuuaacgaggaucauugguucagccgggaaaauucucuguccggcgucgagggggagggacuccacaaacugggcuauauccugcgcgacgugagcaagaaagaagggggcgccauguacgccgacgauacagcgggaugggacaccagaaucacgcucgaggaucugaagaacgaagagaugguuaccaaucacauggaaggcgagcauaagaaacuugcugaggccauuuuuaagcugacauaucaaaacaaagugguccgggugcagcgccccaccccuagagggacaguuauggacaucauuucccggcgcgaucagagaggaagcggccaaguggggaccuacggacucaauacguucacaaacauggaagcccagcugauccggcagauggagggcgaaggggucuucaagaauauucagcaccuuaccgugacagaggagguugcugugcaaaacuggcuggcccgcgucggcagagaacggcucucucgcauggcuaucagcggagacgauugcguggucaaaccccuggacgauagauuugccaacgcgcugaccgcccucaaugacaugggcaagauccggaaggauauucagcagugggagccguccaaaggguggaacgacuggacgcaggucccuuucugcucucaucacuuucaugaacugaucaugaaggauggaagaguucuugugguccccugucgcaaucaagacgagcugauuggccgggcuagaaucagccagggggccggauggucccuccgcgaaaccgcuugccugggcaaaucuuaugcccagauguggagccuuauguacuuccaccggagagaccugcgccucgcggccaacgcuauuuguuccgccgugcccucucacugggugccuacaagccggaccacaugguccauccaugcuaagcacgaguggaugaccacagaggauaugcugaccguuuggaauagaguguggauucgcgaaaacccguggauggaggacaaaacgcccgucgaaagcugggaggaaaucccuuaucuggggaagcgggaggaucaguggugcggcucucucaucggacugacauccagagccaccugggcuaagaauauucaagccgcgaucaaccaggugcgcagccuuauuggcaaugaggaauacaccgacuacaugcccucuaugaaacgguuuagacgggaggaagaggaagccgggguucugugguga

SEQ ID NO: 20057 - RNA, 9876 nt, Artificial Sequence
  derived and/or modified CDS sequence (opt5) from DENV-2__FJ205880__SS-prME
uccgccggaaugaucauuaugcugauccccacagugauggcuuuccaccugacaacgcggaauggggagccucauaugauugucggaauccaggaaaagggcaaaucccugcuuuuuaagaccgaggacgggguuaauaugugcacacugauggccauggaucuuggagaacugugugaggacaccauuacauacaaaugcccgcuucugcggcaaaaugaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucggcggggucuuuacauccaucgggaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuccugugacagcaagcugaugucugccgcuaucaaggauaaucgcgccguucaugcggacaugggcuauuggaucgaguccgcccucaacgauaccuggaaaauugagaaggcuagcuuuaucgaagugaaaaauugccacuggccuaagucucauacacuguggagcaacggcguccuggaguccgaaaugauuauccccaaaaaccuugccgggccggugagccagcacaauuaccggccuggauaccacacccagauugcuggccccuggcaucucgggaagcuggagauggacuucgauuucugugacggaacgacagugaucgucaccgaagauugcggcaacagagggcccucucugcgcaccacaaccgccuccggaaagcucauuacggaguggugcugucggagcugcacacugccuccgcuuagauaucggggcgaggacggcuguugguacgggauggaaauccgcccccugaaagagaaggaagagaaucucguuaacucccuggugaccgccggacacggccaaguggauaauuuuucucuggggguccuuggaauggcucucuuccuggaagagaugcugaaaacaagagugggcaccaagcaugcgauccuccugguugccgugagcuuugucacacuuauuaccgggaacauguccuucaaagaccugggacgggugguugugauggucggcgcuacgauggccgaugacaucggcaugggggugaccuaucucgcccugcuggcugccuuuaagguuagaccuacauucgcggcuggacuucugcuccgcaagcugaccucuaaagagcucaugaugacaaccauuggcaucgugcugcuuagccaguccacgauucccgaaacaguccuggagcucaccgaugcccuggcccuggggaugauggugcuuaagaucgugcggaauauggaaaaauaccagcuggcugucacaaucauggccauucucugcguuccuaacgcggugauccugcagaaugcuuggaaggugucuuguaccauucucgccgucgugagcguuagcccccugcuucugaccagcucucaacagaaaacagacuggaucccucucgcccugacgauuaagggacugaaccccaccgcuaucuuucuuacaacccuguccagaacaaauaaaaagcgcagcuggccgcucaacgaggccaucauggcugugggcauggucucuauucuggccuccagccuccugaagaaugacaucccuaugaccgggccccuuguggcgggaggccugcugacgguuugcuaugugcucacaggcagaucugccgaucuggaacuugagcgggcuaccgacgucaaaugggaggaucaggccgaaauuuccgggagcuccccuauccugagcauuaccaucucugaggacggaagcauguccauuaagaacgaagaggaggaacagacacucaccauccugauccgcacaggccuccuggugauuucugggcuuuuccccaucagcauuccgaucacggcugccgccugguaccugugggaggucaaaaagcaaagagcuggagugcugugggauguuccuucucccccucccaugggcaaagcggaacucgaggacggggccuaucggauuaagcagaagggaauccugggcuacagccagaucggcgcugggguguacaaagaaggaaccuuucacacaauguggcaugucacccgcggcgccgugcuuaugcacaaggggaaaagaauugagcccagcugggccgauguuaagaaagaccugaucuccuauggaggcggguggaagcucgagggagaauggaaggagggcgaagaggugcagguccuggcucucgaaccuggcaaaaauccgcgggccgugcaaacaaagcccgggcuguucaaaaccaacacgggaaccauuggcgcggugucucuugauuuuagcccugggacauccggaagccccaucauugacaagaaaggcaagguugucgggcuguacggaaacggcguggugacccgcucuggcgcuuaugucuccgccaucgcccagacagaaaaguccaucgaggauaauccugaaauugaggacgauaucuucagaaaacggcgccugaccauuauggaccuccaccccggggcuggaaagacaaaaagauaccugccugccaucgugcgggaagcgauuaagagaggccuucgcacgcugauccucgcuccgacccggguuguggccgccgagauggaagaggcucugagagggcuccccauucgcuaucagaccccugccauccgggcugagcauaccggaagagaaaucgucgaccugaugugucacgccaccuuuacaaugcgccuucugucucccgugcggguuccuaacuacaaucugauuaucauggaugaggcgcauuucacggaccccgccuccauugcugccagaggcuauaucagcacccgcguggaaaugggggaggcugccggcauuuucaugacagccaccccgccuggaucccgggaucccuuuccccaaucuaacgcuccuaucaucgacgaggaaagagagauucccgaacggagcuggaacuccggccacgagugggucacagauuucaaagggaagaccgugugguuuguuccuagcaucaaggcgggaaacgacauugccgcuugccuccgcaaaaauggcaagaaagugauccagcugucuagaaagacguucgauuccgaauacgucaaaacacggaccaacgacugggauuuuguggugaccacagacauuagcgagaugggggccaauuucaaggccgagcgcgucaucgauccgagacgguguaugaaacccguuauccuuaccgacggagaagagagagugauucuggcuggcccuaugcccgugacacauucuagcgccgcgcagcgccgggggagaaucggccgcaacccuaagaaugaaaacgaccaguacauuuauaugggagagccccucgaaaaugaugaggacugcgcucacuggaaggaggccaaaaugcugcuggauaacaucaauaccccggaaggcauuaucccuuccauguuugagcccgaacgggagaaggucgacgccauugauggggaauacagacuccgcggagaggcucggaaaacguucguggaccuuaugagacgcggcgaucugccuguuuggcuggccuauaagguggcggccgaggggaucaacuacgcugacagacggugguguuuugauggaaucaaaaacaaucaaauucucgaagagaacgucgaaguggagaucuggacaaaggagggcgaacgcaagaaacugaagcccagauggcuugacgcccggauuuauucugauccucuggcucucaaagaguucaaggaauuugccgcugggcgcaaaagccugacccugaaucucaucacagagaugggcagacuucccaccuucaugacgcagaagacccgggacgcccuggauaaccuggcgguucuccacacagccgaagcuggaggcagagccuacaaucaugcucuguccgagcuuccggagacccuggaaacacuccugcugcucacccuucuggccacagugaccgggggaauuuuccuguuucucaugucuggccgcgggaucggaaagaugacgcugggcaugugcugcaucauuacagccagcauccuucugugguaugcucagauucagccucacuggaucgcggccuccauuauccucgaguucuuucugaucguccugcucauucccgaacccgagaaacaacggaccccucaggacaaccagcuuaccuacguggucaucgcuauucugacagugguugccgccaccauggcuaaugaaaugggcuuccuggagaagaccaagaaggaccucgggcugggaagcaucgccacgcagcaaccggagucuaacauucuugauaucgaccugagacccgcguccgccuggacccucuacgcuguggccacaaccuuugugacaccuaugcugcgccauagcauugaaaauuccucugucaacguuagccugaccgcuaucgccaaucaggcgacggugcucaugggccuugggaaaggauggccccuguccaagauggauaucggcgugccucugcucgccauuggguguuauucucaggucaaccccaucacccugacagcugcccuucugcuccugguggcucacuacgccauuaucggaccuggccugcaggcuaaggccacccgggaggcgcagaagcgggccgcugccggcauuaugaagaauccgacaguugacgggaucaccgugaucgaucucgaccccauuccuuaugaucccaaauucgaaaagcagcuuggacaggucaugcugcugauccucugcgugacgcaaguccugaugaugcggacaaccugggcucuuugugaggcccugacacucgccaccggcccuauuagcacccugugggaagggaaccccggacgcuuuuggaauacaacgaucgcgguguccauggcuaacauuuucagaggcagcuaccuggccggggcuggacuccucuuuucuaucaugaaaaauaccacaaacacccggcgcggcacaggcaacaugggggagacccugggagagaaguggaaauccagacugaaugcccucggcaagagcgaguuccagaucuauaagaaaucugggauucaggagguugaccggacgcuggccaaggaaggaaucaaacgcggcgagacagaucaccaugcuguguccagagggagcgccaaacuucggugguuugucgagcgcaacauggugaccccggaaggaaaaguuguggaccugggcugcggcagagggggauggucuuacuauuguggcgggcucaagaauguccgggaggugaagggacugaccaaaggcgggccuggacacgaggaacccauucccaugagcacauacggcuggaaccuggugagacuccaguccggcguugaugucuucuuuaucccucccgaaaagugcgacacccuucugugugauauuggggagucuagcccuaauccgacaguggaggcgggacgcacgcugcgggugcucaaccuggucgaaaauuggcuuaacaauaacacccaauucugcaucaaaguucugaaucccuacaugccuuccgugaucgagaagauggaagcccuccagagaaaauauggcggggcucuggugcgcaacccccugagcagaaauuccacacaugagauguacugggucucuaacgccagcggaaauauuguguccucuguuaacaugaucagcagaaugcucauuaaccgcuucaccaugcggcacaagaaggcuacauaugaaccugacguggaccuuggcuccgggaccagaaauaucggaauugagucugagauccccaaccuggauauuaucggcaaacgcaucgaaaagauuaaacaggagcaugaaacgagcuggcacuacgaccaggaucacccguauaagaccugggccuaccauggcuccuaugagacaaaacaaaccgggagcgcgucuuccauggucaauggagugguucggcugcucacaaagccuugggacgugcugcccaccgucacacagauggccaugaccgauacgacaccuuuuggccagcagagaguguucaaggaaaaaguggacacccgcacccaagagcccaaggaggggaccaagaaacuuaugaaaaucacggcugaauggcuguggaaggagcucggcaaaaagaagaccccucggauguguacaagagaagaguuuacccgcaaagucagaagcaacgccgcucugggcgccauuuucacagaugagaauaaguggaaaucugcucgggaagccguugaggacucccgcuuuugggaacugguggauaaggagagaaaccuccaccuggaagggaaaugcgagaccuguguguacaauaugaugggaaagcgggagaagaaacuuggcgaguucggcaaggcgaaagggagcagagccaucugguacauguggcugggagcucgguuucucgaguucgaagcccugggcuuucuuaacgaggaccauugguucucucgcgaaaauucccugagcggggucgagggagagggccuccacaagcugggguauauucugagagauguguccaaaaaggaaggcggagcuauguacgccgacgacacagccggcugggauacccggaucacgcucgaggaccugaagaacgaagagaugguuaccaaucacauggaaggggagcauaagaaacuugcggaggcuaucuuuaaacugacauaucagaacaaggugguccgcgugcagagacccaccccgcggggaacaguuauggauauuaucagccgcagagaccaacggggcucuggacaggugggaaccuacggccucaauacguucacaaacauggaagcccagcugauucgccagauggagggggaaggcgucuuuaaaaauauccaacaccuuaccgugacagaggagguugccgugcagaacuggcuggcuagagucggacgggaacgccucagcagaauggccauuuccggcgaugacugcguggucaagccucuggaugaccgguucgcuaacgcccugaccgcgcucaaugauauggggaagauccgcaaagacauccagcagugggagcccucuaagggauggaacgauuggacgcaagugcccuucugcagccaucacuuucaugaacugauuaugaaagacggcagaguucuuguggucccuugucggaaucaggaugagcugaucgggagagcccgcauuucccagggagcuggcuggucucuccgggaaaccgccugccuggggaaaagcuaugcucagauguggucccuuauguacuuccacagacgcgaccugcggcucgccgcgaacgccaucuguucugcugugccgagccacugggugcccacauccagaaccacauggagcauucaugccaaacacgaguggaugaccacagaggacaugcugaccguuuggaaucgcguguggauccgggaaaacccuuggauggaggauaagacgcccgucgaaucuugggaggaaauuccuuaucugggcaagagagaggaccaauggugcggaucccucaucggccugacaagccgcgcuaccugggccaaaaauauccaggcugccauuaaccaggugcggucucuuaucgggaaugaggaauacaccgauuacaugcccuccaugaagagauuucgccgggaggaagaggaagcgggaguucugugguga

SEQ ID NO: 20058 - RNA, 9876 nt, Artificial Sequence
  derived and/or modified CDS sequence (opt5) from DENV-2__FJ390387__SS-prME
agcgccggaaugaucauuaugcugauccccaccgucauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaagugcccuucgagaucauggaccucgaaaagagauacguccugggacgccugaucacagugaacccuauuguuacggagaaagauucuccggugaacaucgaagcggagcccccuuuuggcgacuccuacauuaucauuggggucgagcccggccaacucaagcugaauugguucaagaaaggaagcucuaucggccagauguuugaaaccacaaugagaggggcuaagagaauggcuauucuuggagauaccgccugggacuucggcagccucgggggaguguuuacauccaucggcaaagcccuccaucagguguucggggcuaucuauggcgccgcguuuucuggaguuagcuggaccaugaagauucugaucggcgucauuaucacguggauugggaugaacucccgcagcacaucucuguccgugagccuugugcucgucggaaucgugacccuguaccugggcguuauggugcaggcugauucugggugugucguguccuggaaaaauaaggagcucaagugcggaagcggcaucuucauuaccgacaacguucacacauggaccgaacaauauaaauuucagccugagucccccucuaagcuggccagcgccauccagaaagcucaggaagaggggauuuguggcauccgguccgugacaagacuugagaaucugauguggaagcaaauuacgccggaacucaaccacauccuggccgagaaugaagucaaacugaccaucaugacaggagauauuaagggcaucaugcaggcugggaaacgcucucuucggccucagcccaccgagcucaaguacagcuggaagacauggggaaaagccaagaugcuguccaccgaaagcuauaaccagacguuccugauugacggcccugagaccgcggagugccccaauacaaacagagccuggaacucucucgaaguggaggauuacggguuuggaguuuucaccacaaacaucuggcugaaacuuaaggaaaaacaagacgcuuuuugugacuccaagcugaugagcgccgcuauuaaggauaaucgcgccgugcaugcggacaugggcuauuggaucgagucugcccucaacgauaccuggaaaaucgagaaggcuuccuucauugaagucaaaaauugccacuggccuaagagccauacacuguggucuaacggcgugcuggagagcgaaaugaucauucccaaaaaccuugccgggccggugucccagcacaauuaccggccuggauaccacacccagaucgcuggccccuggcaucucgggaagcuggagauggacuucgauuuuugugacggaacgacagucauuguuaccgaagauugcggcaacagagggcccagccugcgcaccacaaccgccucuggaaagcucaucacggaguggugcugucgguccugcacacugccuccgcuuagauaucggggcgaggacggcuguugguacgggauggaaauucgcccccugaaagagaaggaagagaaucucgugaacagccuggugaccgccggacacggccaagucgauaauuucucccugggggugcuuggaauggcucucuuucuggaagagaugcugagaacacggguuggcaccaaacaugcgauccuccugguggccgucucuuucgugacacuuaucaccgggaacaugagcuuuaaggaccugggaagaguuguggucauggugggcgcuacgaugaccgaugacauuggcauggggguuacauaucucgcccugcuggccgcuuucaaagugcgcccuaccuuugccgcgggacuucugcuccggaagcugacauccaaggagcucaugaugaccacgaucggcauuguccugcuuucucagagcacaauccccgaaaccgugcuggagcucacagaugcucuggcccuggggaugauggugcuuaaaauugucagaaauauggaaaaguaccagcuggccguuaccaucauggcuauccucugcgugccuaacgccgugauucugcagaaugcguggaaagucuccuguaccauccucgcugugguuucugugagcccccugcuucugacauccagccaacagaagacggacuggauuccucucgcccugaccaucaaaggacugaaccccacagccauuuuccuuaccacacugucucgcaccaauaagaaaagauccuggccgcucaacgaggcuaucauggccgucggcauggugagcauccuggcuucuucccuccugaagaaugacauuccuaugacggggccccuuguugccggaggccugcugacagugugcuauguccucaccggccggagcgcggaucuggaacuugagcgcgccaccgacgugaagugggaggaucaggcugaaaucucuggguccagcccuauucuguccaucacaauuagcgaggacggaucuaugagcaucaaaaacgaagaggaggaacagacccucacaauucugaucagaacgggccuccuggucaucuccgggcuuuuucccauuucuaucccgauuaccgccgcugccugguaccugugggaggugaagaaacaacgggccggaguucugugggaugugccuucucccccucccaugggcaaggcugaacucgaggacggggcguaucgcaucaaacagaagggcauucugggcuacucccagaucggcgccggggucuacaaggaaggaacauuccacaccauguggcaugugacaagaggcgcuguucuuaugcacaaagggaagcggaucgagcccuccugggccgaugugaaaaaggaccugauuagcuauggaggcggguggaaacucgagggagaauggaaggagggcgaagagguccaggugcuggcccucgaaccuggcaagaauccgcgcgcugugcaaaccaaacccgggcuguuuaagacgaacaccggaacaaucggcgccguuucccuugauuucucuccugggaccagcggaucccccauuaucgacaaaaagggcaaagucguggggcuguacggaaacggcguggucacaagaagcggcgcguaugugucugcuauugcccagaccgagaaguccaucgaggauaauccugaaaucgaggacgauauuuuucggaagcgcagacugacaaucauggaccuccaccccggggccggaaaaacgaagcgguaccugccugcuauuguuagagaagccaucaaacgcggccuucggacccugauucucgcgccgacaagaguggucgcugccgagauggaagaggcccugcgcgggcuccccauccgguaucagaccccugcuauuagagccgagcauaccggacgcgaaaucguggaccugaugugucacgcuacauucacgaugcggcuucugagccccguuagagugccuaacuacaaucugaucauuauggaugaggcccauuucaccgaccccgcgucuaucgccgcucgcggcuauauuuccacacgggucgaaaugggggaggccgcuggcaucuuuaugaccgccacaccgccuggaagcagagaucccuucccccaauccaacgccccuauuaucgacgaggaacgggagauccccgaacgcucuuggaauagcggccacgagugggugaccgauuuuaaggggaaaacgguuugguucgugccuuccauuaaggcuggaaacgacaucgcggccugccucagaaagaauggcaaaaaggucauucagcugagccggaaaacauuugauucugaauacgugaagacccgcaccaacgacugggauuucguggucacaaccgacaucuccgagaugggggcuaauuuuaaagccgagagaguuauugauccgcggagauguaugaagcccgugauccuuacagacggagaggaacgcgugauccuggccggcccuaugcccgucacccauagcucugcugcccagcggagagggcgcauuggccggaacccuaaaaaugaaaacgaccaguacaucuauaugggagagccccucgaaaaugaugaggacugcgcgcacuggaaggaggcuaagaugcugcuggauaacauuaauacgccggaaggcaucauuccuagcauguucgagcccgaaagagagaaaguggacgccaucgauggggaauaccgccuccggggagaggccagaaagacauuuguugaccuuaugcgcagaggcgaucugccuguguggcuggcuuauaaagucgccgcggaggggauuaacuacgccgaccggcgcugguguuucgauggaaucaagaacaaucaaauccucgaagagaacguggaaguugagauuuggaccaaagagggcgaaagaaagaagcugaaaccccgguggcuugacgcucgcaucuauuccgauccucuggcccucaaggaguuuaaagaguucgcugccgggagaaagucucugacacugaaucucauuaccgagaugggccggcuucccacguucaugacccagaaaacaagagacgcucuggauaaccuggccgugcuccacaccgcggaagccggaggccgcgcuuacaaucaugcccugagcgagcuuccggagacacuggaaacccuccugcugcucacacuucuggcuaccgucacagggggaaucuuucuguuccucauguccggccgggggauuggaaagaugacacugggcaugugcugcaucaucaccgccucuauucuucugugguaugcccagauccagccucacuggauugcugcgagcaucauucucgaguuuuuccugaucgugcugcucauccccgaacccgagaagcaaagaaccccucaggacaaccagcuuacauacgucgugauugccauccugaccguuguggcugccacaauggccaaugaaaugggcuuucuggagaaaacgaagaaagaccucgggcugggauccauugcuacccagcaaccggagagcaacauccuugauauugaccugcgccccgccucugcguggacacucuacgccguggcuaccacauucgucaccccuaugcugcggcauuccaucgaaaauagcuccguuaacgugucucugacggccauugcuaaucaggccaccgugcucaugggccuugggaagggauggccccugagcaaaauggauaucggcgucccucugcucgcgaucggguguuauucccaggugaaccccauuacacugaccgccgcccuucugcuccugguugcccacuacgcuaucauuggaccuggccugcaggccaaggcuacaagagaggcccaaaagcgggcggccgcuggcaucaugaaaaauccgaccguggacgggauuacggucaucgaucucgaccccaucccuuaugaucccaaguuugaaaaacagcuuggacaggugaugcugcugauucucugcgucacacaagugcugaugaugcgcaccacaugggcccuuugugaggcucugacccucgccaccggcccuaucucuacacugugggaagggaaccccggaagauucuggaauacgaccauugccguuagcauggcgaacaucuuucggggcuccuaccuggcuggggccggacuccuuuucagcauuaugaagaauacaaccaacacacgcagaggcaccggcaacaugggggagacgcugggagagaaauggaagucucggcugaaugcucucggcaaauccgaauuucagaucuauaaaaagagcgggauccaggagguggaccgcacacuggccaaagaaggaauuaagagaggcgagaccgaucaccaugccgucucucggggguccgcuaaacuucgcugguucguggagagaaacaugguuaccccggaaggaaagguggucgaccugggcugcggcagagggggauggagcuacuauuguggcgggcucaaaaaugugcgggaggugaagggacugacaaagggcgggccuggacacgaagaacccauccccaugucuaccuacggcuggaaccugguucgccuccagagcggcgucgauguguuuuucauuccucccgaaaaaugcgacacacuucugugugauaucggggaguccucuccuaauccgacgguggaggccggacggacccugagaguccucaaccugguugaaaauuggcuuaacaauaacacacaauucugcauuaaggugcugaaucccuacaugccuagcgugaucgagaaaauggaagcgcuccagcgcaaguauggcggggcccugguccggaacccccuguccagaaauagcacccaugagauguacuggguguccaacgcuucuggaaauaucguuagcuccgugaacaugauuucucgcaugcucaucaaccgguuuacaaugagacacaaaaaggccaccuaugaaccugacgucgaccuuggcagcgggacgcgcaauauuggaaucgaguccgagauucccaaccuggauaucauuggcaagcggaucgagaagaucaagcaggagcaugaaaccucuuggcacuacgaccaggaucacccguauaaaacaugggcuuaccauggcagcuaugagaccaagcaaacaggguccgccagcucuauggugaauggaguugugagacugcucaccaaaccuugggacguccugcccacagugacccagauggcgaugacggauacaaccccuuucggccagcagcgcguguuuaaggaaaaggucgacacccggacacaagagcccaaagaggggacgaagaaacuuaugaagauuaccgccgaauggcuguggaaagagcucggaaagaaaaagacaccuagaauguguacccgcgaagaguucacaagaaagguucgguccaacgcugcccugggcgcuaucuuuaccgaugagaauaaauggaaaagcgcccgcgaagcuguggaggacucuagauucugggaacugguggauaaagagcggaaccuccaccuggaagggaagugcgagacaugugucuacaauaugaugggaaaaagagagaagaaacuuggcgaauuuggcaaagccaaggggucccgggcgauuugguacauguggcugggagcccgcuuccucgaguuugaagcucugggcuuccuuaacgaggaccauugguuuagcagagaaaauucucuguccgggguggagggagagggccuccacaaacugggguauauccugcgggauguuagcaagaaagaaggcggagccauguacgcugacgacaccgccggcugggauacgcgcauuacccucgaggaccugaagaacgaagagauggugacaaaucacauggaaggggagcauaagaaacuugccgaggcgaucuucaagcugaccuaucagaacaaagucgugagaguucagcggcccacaccgcgcggaaccgugauggauaucauuuccagacgggaccaacgcggcagcgggcaggucggaacguacggccucaauacauuuaccaacauggaagcucagcugaucagacagauggagggggaaggcguguucaagaauauucaacaccuuacaguuaccgaggagguggccgucaaaaacuggcuggcccgggugggacgcgaaagacucucucggauggcuaucagcggcgaugacugcgucgugaagccucuggaugaccgcuucgccaacgcucugacggcccucaaugauauggggaagauuagaaaagacauccagcagugggagcccuccaagggauggaacgauuggacccagguucccuuuugcucucaucacuuccaugaacugaucaugaaagacggccgggugcuugucgugccuuguagaaaucaagaugagcugguggggcgcgcgcggauuagccagggagccggcuggucccucagagaaacagcuugccuggggaagucuuaugcccagauguggagccuuauguacuuucaccgccgggaccugagacucgcugccaacgcgaucuguuccgccguuccgucucacugggugcccaccagccgcacaaccugguccauucaugcuaaacacgaguggaugacaaccgaggacaugcugacggucuggaaucggguguggaucagagaaaacccuuggauggaggauaagacacccguugaaagcugggaggaaauuccuuaucugggcaagcgcgaggaccaguggugcggaucucucaucggccugaccucccgggccaccugggcuaaaaauauucaagccgcuaucaaccaggugagaagccuuaucgggaaugaggaauacacagauuacaugcccucuaugaagcgcuuccggagagaggaagaggaagccggaguccugugguga

SEQ ID NO: 20059 - RNA, 9876 nt, Artificial Sequence
  derived and/or modified CDS sequence (opt5) from DENV-2__FJ024461__SS-prME
agcgccggcaugaucauuaugcugauccccaccgugauggcuuuccaccugaccacgagaaauggggaaccucauaugauugucggaauccaggaaaagggcaaaucccugcuuuuuaagaccgaagacgggguuaauaugugcacgcugauggccauggaucuuggagaacugugugaggacaccauuacauacaaaugcccgcuucugcggcaaaaugaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuuccuucaucgaagugaagaauugccacuggccuaaaagccauacacuguggucuaacggcguccuggagagcgaaaugauuauccccaagaaccuugccgggccggugucccaacacaauuaccggcucggauaccacacccagauugcuggcccuuggcaucuggggaagcuggagauggacuucgauuuuugugacggaacgacagugaucgucaccgaagauugcggcaacagagggcccagccuccgcaccacaaccgccucuggaaaacugauuacggaguggugcugucgguccugcacacuucccccucugagauaucggggcgaggacggcuguugguacgggauggaaauccgcccgcucaaggagaaagaagagaaucugguuaacagccuggugaccgccggacacggccagguggauaauuucucccuugggguccucggaauggcucuguuucuggaagagaugcucagaacacgggugggcaccaagcaugcgauccugcuuguugccgugucuuucgucacacugauuaccgggaacaugagcuuuaaagaccucggaagagugguugugauggucggcgcuacgauggccgaugacaucggcaugggggugaccuaucuggcccugcuugcugccuucaagguucgccccacauuugcggcuggacugcuccugcggaagcucaccuccaaagagcugaugaugacaaccauuggcaucgugcuucugucucaaagcacgauuccugaaacaguccucgagcugaccgaugcccuggcccuugggaugauggugcugaagaucgugagaaauauggaaaaauaccagcucgcugucacaaucauggccauucugugcguucccaacgcggugauccuccagaaugcuuggaagguguccuguaccauucuggccgucgugucuguuagcccucuucugcucaccuccagccagcagaagaccgacuggaucccccuggcccugacgauuaagggacuuaacccuaccgcuaucuuccugacaacccucucucgcacaaauaaaaagagauccuggccccugaacgaggccaucauggcugugggcauggucagcauucucgccucuucccugcuuaagaaugacaucccgaugaccgggccucugguggcgggaggccugcucacgguuugcuaugugcugacaggccggagcgccgaucuugaacuggagcgcgcuaccgacgucaaaugggaggaucaggccgaaauuucuggguccagccccauccucuccauuaccaucagcgaggacggaucuaugagcauuaagaacgaagaggaggaacagacacugaccauccucaucagaacaggccugcuugugauuuccgggcuguuuccuaucucuauucccaucacggcugccgccugguaccugugggaggucaaaaagcagcgggcuggagugcucugggauguuccgagcccucccccuaugggcaaagcggaacuggaggacggggccuaucgcauuaagcaaaagggaauccuuggcuacucccagaucggcgcugggguguacaaagaaggaaccuuccacacaauguggcaugucaccagaggcgccgugcugaugcacaaggggaaacggauugagcccucuugggccgauguuaagaaagaccucaucagcuauggaggcggguggaagcuggagggagaauggaaggagggcgaagaggugcagguccucgcucuggaacccggcaaaaauccucgcgccgugcagacaaagccggggcuuuuuaaaaccaacacgggaaccauuggcgcggugucccuggauuucucucccgggacaagcggauccccuaucauugacaagaaaggcaagguugucgggcuguacggaaacggcguggugaccagaagcggcgcuuaugucucugccaucgcccaaacagagaaggggaucgaggauaaucccgaaauugaggacgauaucuuucggaaacgcagacucaccauuauggaccugcacccuggagcuggcaagacaaaacgguaccuucccgccaucgugagagaagcgauuaagcgcgggcugcggacgcucauccuggcuccuaccagaguuguggccgccgagauggaagaggcucuccgcggacugccgauucgguaucagacacccgccaucagagcugagcauaccggccgcgaaaucgucgaccuuaugugucacgccaccuucacaaugcggcugcuguccccugugagaguucccaacuacaaucucauuaucauggaugaggcgcauuucacggacccugccagcauugcugcccgcggguauaucucuacccggguggaaaugggcgaggcugccggaauuuuuaugacagccacacccccgggcuccagagauccuuucccccagagcaacgcucccaucaucgacgaggaacgggagauuccugaacgcuccuggaacucugggcacgagugggucacagauuuuaaaggaaagaccgugugguucguucccagcaucaaggcgggcaacgacauugccgcuugccugcgcaaaaaugggaagaaagugauccaacuuucccggaagacguuugauagcgaauacgucaaaacacgcaccaacgacugggauuucguggugaccacagacauuucugagaugggagccaauuuuaaggccgagagagucaucgauccucggagauguaugaaaccgguuauccugaccgacggcgaggaacgcgugauucucgcugggcccaugccugugacacauuccagcgccgcgcagcggagaggccgcaucggacggaaccccaagaaugaaaacgaccaguacauuuauaugggcgagccucuggaaaaugaugaggacugcgcucacuggaaggaggccaaaaugcugcucgauaacaucaauacccccgaagggauuaucccgucuauguucgagccugaaagagagaaggucgacgccauugauggagaauaccgccuucggggcgaggcuagaaaaacguuuguggaccugaugcgcagaggggaucugcccguuuggcucgccuauaagguggcggccgagggaaucaacuacgcugaccggcgcugguguuucgauggcaucaaaaacaaucagauucuggaagagaacgucgaaguggagaucuggacaaaggagggggaaagaaagaaacuuaagccucgguggcuggacgcccgcauuuauagcgauccccucgcucugaaagaguuuaaggaguucgccgcuggcagaaaaucccugacccucaaucuuaucacagagaugggacggcugccuaccuucaugacgcaaaagaccagagacgcccuggauaaccucgcgguucugcacacagccgaagcuggcgggcgcgccuacaaucaugcucuuucugagcugcccgagacccucgaaacacugcugcuccuuacccugcuggccacagugaccggaggcauuuuucucuuccugaugagcgggcggggaaucggcaagaugacgcuuggcaugugcugcaucauuacagccuccauccugcucugguaugcucagauucagccgcacuggaucgcggccucuauuauccuggaguuuuuccugaucguccuccuuauuccugaacccgagaaacagagaacaccccaagacaaccagcugaccuacguggucaucgcuauucugacagugguugccgccaccauggcuaaugaaaugggguuucucgagaagaccaagaaggacuucggacugggcagcaucgccacgcagcagccugaguccaacauucuugauaucgaccugcgcccggcgagcgccuggacccucuacgcuguggccacaaccuuugugacacccaugcugcggcauucuauugaaaauuccagcgucaacguuucccugaccgcuaucgccaaucaagcgacggugcucauggggcuuggaaaaggcuggccucugucuaagauggauaucggggugccccugcucgccauuggauguuauagccaggucaacccuaucacccugacagcugcccuucugcuccugguggcucacuacgccauuaucggccccggccugcaggcuaaggccaccagagaggcgcagaaacgggccgcugccgggauuaugaagaauccuacaguugacggaaucaccgugaucgaucucgacccgauucccuaugauccuaaauucgaaaagcaacuuggccaggucaugcugcugauccucugcgugacgcagguccugaugaugcgcacaaccugggcucuuugugaggcccugacacucgccaccgggcccauuuccacccugugggaaggaaacccuggcagauuuuggaauacaacgaucgcggugucuauggcuaacauuuuccgggggagcuaccuggccggagcuggccuccucuuuuccaucaugaaaaauaccacaaacacccgcagaggcacagggaacaucggagagacccugggcgagaaguggaaaagccggcugaaugcccucgggaagucugaguuccaaauuuauaagaaauccggaauccaggagguugaccgcacgcuggccaaggaaggcauuaaaagaggggagacagaucaccaugcugugagccggggaucugccaaacuucgcugguuugucgagagaaacauggugacccccgaaggcaaaguuguggaccugggcugcgggcggggaggcugguccuacuauugugggggacucaagaaugucagagaggugaagggccugaccaaagggggaccgggccacgaagaaccuauccccaugagcacauacggcuggaaccuggugcgccuccagucugggguugaugucuucuucauucccccugaaaagugcgacacccuucugugugauaucggagagagcucccccaauccuacaguggaggcgggccggacgcugagagugcucaaccuggucgaaaauuggcuuaacaauaacacccaguuuugcaucaaaguucugaauccguacaugcccucugugauugagaagauggaagcccuccaacgcaaauaugggggagcucuggugcggaacccucugagcagaaauuccacacaugagauguacugggucagcaacgccuccggcaauaucgugucuagcguuaacaugauuucccgcaugcucaucaaccgguucaccaugagacacaagaaggcuacauaugaacccgacguggaccuugggucuggaacccgcaauauuggcaucgagagcgagauuccuaaccuggauaucaucggcaaacggauugaaaagaucaaacaggagcaugaaacguccuggcacuacgaccaggaucaccccuauaagaccugggccuaccaugggucuuaugagacaaaacagaccggaagcgcguccagcauggucaauggcgugguuagacugcucacaaagccgugggacgugcugccuaccgucacacaaauggccaugaccgauacgacacccuuugggcagcagcgcguguucaaggaaaaaguggacacccggacccaggagccuaaggagggaaccaagaaacuuaugaaaauuacggcugaauggcuguggaaggagcucggcaaaaagaagacccccagaauguguacacgcgaagaguuuaccagaaaaguccggucuaacgccgcucugggggccaucuucacagaugagaauaaguggaaauccgcucgcgaagccguugaggacagcagauuuugggaacugguggauaaggagcggaaccuccaccuggaaggaaaaugcgagaccuguguguacaauaugaugggcaagagagagaagaaacuuggcgaguucgggaaggcgaaaggaucucgggccauuugguacauguggcugggcgcucgcuuucucgaguucgaagcccugggguuucuuaacgaggaccauugguucuccagagaaaauagccugucuggagucgagggcgaggggcuccacaagcugggcuauauccugcgggauguguccaaaaaggaaggaggcgcuauguacgccgacgacacagccgggugggauacccgcaucacgcucgaggaccugaagaacgaagagaugguuaccaaucacauggaaggagagcauaagaaacuugcggaggcuauuuuuaaacugacauaucaaaacaaaguggucagagugcagcggccuacccccagaggcacaguuauggauaucauuagcagacgggaccagcgcggguccggacaagugggcaccuacgggcucaauacguucacaaacauggaagcccagcugaucagacagauggagggcgaaggagucuucaaaaauauucagcaccuuaccgugacagaggagguugccgugcaaaacuggcuggcucgggucggccgcgaaagacucagccggauggccaucucuggggaugacugcguggucaagccgcuggaugaccgcuuugcuaacgcccugaccgcgcucaaugauaugggaaagaucagaaaagacauucagcagugggagccuagcaagggcuggaacgauuggacacaggugcccuucugcucccaucacuuucaugaacugaucaugaaagacgggcggguucuugugguccccuguagaaaucaagaugagcugauuggacgcgcccggaucucucagggcgcuggguggagccucagagaaaccgccugccugggcaaguccuaugcucagauguggucucuuauguacuuccaccgccgggaccugagacucgccgcgaacgccauuuguagcgcugugccuucccacugggugccgacaucucgcaccacauggagcauccaugccaaacacgaguggaugaccacagaggacaugcugaccguuuggaaucggguguggauuagagaaaaccccuggauggaggauaagacgccugucgaauccugggaggaaauccccuaucugggaaagcgcgaggaccaguggugcggcagccucaucgggcugacaucucgggcuaccugggccaaaaauauucaagcugccaucaaccaggugagaucccuuauuggaaaugaggaauacaccgauuacaugccuagcaugaagcgcuuucggagagaggaagaggaagcgggcguucugugguga

SEQ ID NO: 20060 - RNA, 9876 nt, Artificial Sequence
  derived and/or modified CDS sequence (opt5) from DENV-2__FJ373299__SS-prME
agcgccggaaugaucauuaugcugauccccaccgugauggcuuuccaccugacaacgcggaauggggagccucauaugauugucggaauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgccgggaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaggacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacucccgccugaugagcgccgcuaucaaggauaaucgggccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccagcacaauuacagaccuggauaccacacccagauugcuggccccuggcaucucgggaaacuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaggagaaagaagagaaucucguuaacagccuggugaccgccggacacggccaaguggauaauuucucccuggggguccuuggaauggcucucuuucuggaagagaugcugcggacaagagugggcaccaagcaugcgauccuccugguugccgugucuuucgucacacuuauuaccgggaacaugagcuuuaaagaccugggacgcgugguugugauggucggcgcuacgauggccgaugacaucggcaugggggugaccuaucucgcccugcuggcugccuucaagguucggccuacauuugcggcuggacuucugcucagaaaacugaccuccaaggagcucaugaugacaaccauuggcaucgugcugcuuucucagagcacgauucccgaaacaguccuggagcucaccgaugcccuggcccuggggaugauggugcuuaagaucgugcgcaauauggaaaaauaccagcuggcugucacaaucauggccauucucugcguuccuaacgcggugauccugcagaaugcuuggaagguguccuguaccauucucgccgucgugucuguuagcccccugcuucugaccuccagccaacagaaaacagacuggaucccucucgcccugacgauuaagggacugaaccccaccgcuaucuuccuuacaacccugucuagaacaaauaaaaagcgguccuggccgcucaacgaggccaucauggcugugggcauggucagcauucuggccucuucccuccugaaaaaugacaucccuaugaccgggccccuuguggcgggaggccugcugacgguuugcuaugugcucacaggccgcagcgccgaucuggaacuugagagagcuaccgacgucaagugggaggaucaggccgaaauuucuggguccagcccuauccuguccauuaccaucagcgaggacggaucuaugagcauuaagaacgaagaggaggaacagacacucaccauccugauccggacaggccuccuggugauuuccgggcuuuuucccaucucuauuccgaucacggcugccgccugguaccugugggaggucaaaaagcaacgcgcuggagugcugugggauguuccuucucccccucccaugggcaaagcggaacucgaggacggggccuauagaauuaagcagaaaggaauccugggcuacucccagaucggcgcugggguguacaaggaaggaaccuuccacacaauguggcaugucacccggggcgccgugcuuaugcacaaggggaaacgcauugagcccuccugggccgauguuaagaaagaccugaucagcuauggaggcggguggaagcucgagggagaauggaaagagggcgaagaggugcagguccuggcucucgaaccuggcaagaauccgagagccgugcaaacaaagcccgggcuguuuaaaaccaacacgggaaccauuggcgcggugucccuugauuucucuccugggacaagcggaucccccaucauugacaagaaaggcaagguugucgggcuguacggaaacggcguggugacccggagcggcgcuuaugucucugccaucgcccagacagagaaauccaucgaggauaauccugaaauugaggacgauaucuuucgcaagagacggcugaccauuauggaccuccaccccggggcuggaaagacaaaaagauaccugccugccaucgugcgcgaagcgauuaagcggggccuuagaacgcugauccucgcuccgacccgcguuguggccgccgagauggaagaggcucugcgggggcuccccauuagauaucagaccccugccauccgcgcugagcauaccggacgggaaaucgucgaccugaugugucacgccaccuucacaaugagacuucugagccccgugcgcguuccuaacuacaaucugauuaucauggaugaggcgcauuucacggaccccgccucuauugcugcccggggcuauaucuccaccagaguggaaaugggggaggcugccggcauuuuuaugacagccaccccgccuggaagccgggaucccuucccccaauccaacgcuccuaucaucgacgaggaacgcgagauucccgaaagaucuuggaauagcggccacgagugggucacagauuuuaaagggaagaccgugugguucguuccuuccaucaaagcgggaaacgacauugccgcuugccuccggaagaauggcaagaaagugauccagcugagccgcaagacguuugauucugaauacgucaaaacaagaaccaacgacugggauuucguggugaccacagacauuuccgagaugggggccaauuuuaaggccgagcgggucaucgauccgagacgcuguaugaaacccguuauccuuaccgacggagaggaacgggugauucuggcuggcccuaugcccgugacacauagcucugccgcgcagagacgcgggcggaucggcagaaacccuaagaaugaaaacgaccaguacauuuauaugggagagccccucgaaaaugaugaggacugcgcucacuggaaagaggccaagaugcugcuggauaacaucaauaccccggaaggcauuaucccuagcauguucgagcccgaacgcgagaaggucgacgccauugauggggaauaccggcucagaggagaggcucgcaaaacguuuguggaccuuaugagacggggcgaucugccuguuuggcuggccuauaagguggcggccgggggaaucaacuacgcugaccgcagaugguguuucgauggcaucaaaaacaaucaaauucucgaggaaaacgucgagguggaaaucuggacaaaggagggggagcggaaaaagcugaagccccgcuggcuugacgccagaauuuauuccgauccucuggcucucaaagaauuuaaggaguucgccgcuggccggaaaucucugacccugaaucucaucacagaaaugggaagacuucccaccuucaugacgcagaagacccgcgacgcccuggauaaccuggcgguucuccacacagccgaggcuggcgggcgggccuacaaucaugcucugagcgaacuuccggagacccuggagacacuccugcugcucacccuucuggccacagugaccggaggcauuuuucuguuccucauguccgggagaggaaucggcaaaaugacgcugggcaugugcugcaucauuacagccucuauccuucugugguaugcucagauucagccucacuggaucgcggccagcauuauccucgaauuuuuccugaucguccugcucauucccgagcccgaaaagcaacgcaccccucaggacaaccagcuuaccuacguggucaucgcuauucugacagugguugccgccaccauggcuaaugagaugggguuucuggaaaagaccaagaaggaccucggacugggcuccaucgccacgcagcaaccggagagcaacauucuugauaucgaccugcggcccgcgucugccuggacccucuacgcuguggccacaaccuucgugacaccuaugcugagacauuccauugagaauagcuccgucaacguuucucugaccgcuaucgccaaucaggcgacggugcucauggggcuuggaaaaggcuggccccugagcaagauggauaucggggugccucugcucgccauuggauguuauucccaggucaaccccaucacccugacagcugcccuucugcuccugguggcucacuacgccauuaucggcccuggccugcaggcuaaagccacccgggaagcgcaaaagcgcgccgcugccgggauuaugaagaauccgacaguugacggaaucaccgugaucgaucucgaccccauuccuuaugaucccaaauuugagaagcagcuuggccaggucaugcugcugauccucugcgugacgcaaguccugaugaugagaacaaccugggcucuuugugaagcccugacacucgccaccgggccuauuucuacccugugggagggaaaccccggccgguucuggaauacaacgaucgcggugagcauggcuaacauuuuucgcggguccuaccuggccggagcuggccuccuuuucagcaucaugaaaaauaccacaaacaccagacggggcacagggaacaugggagaaacccugggcgagaaguggaaaucucgccugaaugcccucgggaaguccgaguuucagaucuauaaaaagagcggcauucaggaaguugacagaacgcuggccaaggagggcaucaaaagaggggaaacagaucaccaugcugugucucgcggauccgccaaacuuagaugguucgucgagcggaacauggugaccccggagggcaaaguuguggaccugggcugcgggagaggaggcuggagcuacuauugugggggacucaagaauguccgcgaagugaaaggccugaccaaagggggaccuggccacgaggaacccauucccaugucuacauacggcuggaaccuggugcggcuccagagcgggguugaugucuuuuucaucccucccgagaagugcgacacccuucugugugauauuggagaauccucuccuaauccgacaguggaggcgggcagaacgcugcgcgugcucaaccuggucgagaauuggcuuaacaauaacacccaauucugcaucaaaguucugaaucccuacaugccuagcgugaucgaaaagauggaggcccuccagcggaaauaugggggagcucuggugagaaacccccugucccgcaauagcacacaugaaauguacugggucuccaacgccucuggcaauauugugagcuccguuaacaugaucucucggaugcucauuaacagauuuaccaugcgccacaagaaagcuacauaugagccugacguggaccuugggagcggaacccggaauaucggcauugaauccgagacgcccaaccuggauaucauuggcaagagaaucgagaagaucaaacaggaacaugagaccucuuggcacuacgaccaggaucacccguauaagacaugggccuaccaugggagcuaugaaaccaaacaaacaggauccgcgagcucuauggucaauggcgugguucgccugcucaccaagccuugggacgugcugcccacagucacccagauggccaugacggauacaaccccuuucgggcagcagcggguguuuaaagagaagguggacaccagaacacaagaacccaaggagggaacgaagaaacuuaugaaaauuaccgcugaguggcuguggaaagaacucggcaaaaagaaaacaccucgcauguguaccagagaggaguucacacggaagguccgcuccaacgccgcucugggggccaucuuuaccgaugagaauaaguggaaaagcgcuagagaggccguugaagacucucgguucugggagcugguggauaaggaaagaaaccuccaccuggagggaaaaugcgaaacauguguguacaauaugaugggcaagcgggagaagaaacuuggcgaguuugggaaagcgaaaggaucccgcgccauuugguacauguggcugggcgcuagauuccucgaauuugaggcccugggguuccuuaacgaagaccauugguuuagccgggaaaauucucuguccggagucgaaggcgaggggcuccacaagcugggcuauauccugcgcgaugugagcaaaaaggagggaggcgcuauguacgccgacgacaccgccgggugggauacgagaauuacccucgaagaccugaaaaacgaggaaaugguuacaaaucacauggagggagaacauaagaaacuugcggaggcuaucuucaaacugaccuaucagaacaaggugguccgggugcagcgccccacaccgagaggcaccguuauggauaucauuucccggcgcgaccaaagagggagcggacaggugggcacguacgggcucaauacauuuaccaacauggaggcccagcugauccggcagauggaaggcgagggagucuucaaaaauauucaacaccuuacagugaccgaagagguugccgugcagaacuggcuggcucgcgucggcagagagcggcucucucgcauggccaucagcggggaugacugcguggucaagccucuggaugacagauucgcuaacgcccugacggcgcucaaugauaugggaaaaauucggaaggacauccagcagugggaacccuccaagggcuggaacgauuggacccaagugcccuuuugcucucaucacuuccaugagcugaucaugaaagacgggagaguucuuguggucccuugucgcaaucaggaugaacugauuggacgggccagaaucagccagggcgcuggguggucccuccgcgagacagccugccugggcaagucuuaugcucagauguggagccuuauguacuuucaccggagagaccugcgccucgccgcgaacgccauuuguuccgcugugccgucucacugggugcccaccagccggacaaccugguccauccaugccaaacacgaauggaugacaaccgaggacaugcugacgguuuggaauagaguguggauucgcgagaacccuuggauggaagauaagacacccgucgagagcugggaagagaucccuuaucugggaaaacgggaagaccaauggugcggcucucucauugggcugaccuccagagcuaccugggccaagaauauccagguggcuaucaaccagguucgcagccuuauuggaaaugaggaguacacagauuacaugcccucuaugaagcgguucagacgggaagaggaagaggccggcgugcugugguga

SEQ ID NO: 20061 - RNA, 9876 nt, Artificial Sequence
  derived and/or modified CDS sequence (opt5) from DENV-2__FJ410193__SS-prME
agcgccggcaugaucauuaugcugauccccacagugauggcuuuccaccugacaacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucguuccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuuauuugcaagcauagcaugguggaucgcggcuggggcaauggguguggacuguucggcaaagggggaaucgugaccugcgcuauguuuacaugcaagaaaaacauggaaggcaagauuguccagccugagaaucucgaauacacgaucguugugacaccccacucuggggaggagcaugccgugggaaacgacacaggcaaacacggcaaggaaaucaaagucaccccucaguccagcauuacagaggcggaacugaccggguauggaacggugaccauggaguguucucccagaacaggccuugauuucaaugaaaugguucugcuccaaauggagaacaaggccuggcuggugcaccggcagugguuucuugaccugccgcucccuuggcugcccggggcugauaagcaggaguccaauuggauccagaaagaaacccuggucacauucaagaacccucaugccaaaaagcaagacgugguugugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugaaagagaucgcugagacccagcacggaaccauugucauccgggugcaguaugaaggcgaugggagccccugcaagauccccuucgagauuauggaccucgagaagcgguacguucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggagucuucaccacaaacaucuggcugaaacuuaaagaaaagcaggacgcuuuuugugacuccaagcugaugagcgccgcuaucaaagauaaucgcgccgugcaugcggacaugggcuauuggauugagucugcccucaacgauaccuggaagaucgagaaggcuagcuucauugaaguuaagaauugccacuggccuaaaagccauacacuguggucuaacggcgugcuggagagcgaaaugaucauucccaagaaccuugccgggccggucucccaacacaauuaccggccuggauaccacacccagaucgcuggccccuggcaucucgggaagcuggagauggacuucgauuuuugugacggaacgacagugauugugaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauccgcccccugaaggagaaagaagagaaucucgucaacagccugguuaccgccggacacggccagguggauaauuucucccugggggugcuuggaauggcucucuuucuggaagagaugcugagaacacgggucggcaccaagcaugcgauucuccugguggccguuucuuucgugacacuuaucaccgggaacaugagcuuuaaagaccugggaagagucgugguuauggugggcgcuacgauggccgaugacauuggcaugggggucaccuaucucgcccugcuggcugccuucaaggugcgcccuacauuugcggcuggacuucugcuccggaagcugaccuccaaagagcucaugaugacaaccaucggcauuguucugcuuucucaaagcacgauccccgaaacagugcuggagcucaccgaugcccuggcccuggggaugaugguccuuaagaucgugagaaauauggaaaaauaccagcuggcugugacaauuauggccauccucugcgucccuaacgcgguuauucugcagaaugcuuggaagguguccuguaccauccucgccguggucucugugagcccccugcuucugaccuccagccagcagaagaccgacuggauuccucucgcccugacgaucaagggacugaaccccaccgcuaucuuccuuacaacccugucucgcacaaauaaaaagagauccuggccgcucaacgaggccauuauggcuguuggcauggugagcauccuggccucuucccuccugaagaaugacauuccuaugaccgggccccuugucgcgggaggccugcugacggugugcuauguucucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauccugauuagaacaggccuccuggucaucuccgggcuuuuucccauuucuaucccgauuacggcugccgccugguaccugugggaggugaaaaagcagcgggcuggaguccugugggaugugccuucucccccucccaugggcaaagcggaacucgaggacggggccuaucgcaucaagcaaaagggaauccugggcuacucccagauuggcgcugggguuuacaaagaaggaaccuuccacacaauguggcaugugaccagaggcgccguccuuaugcacaaggggaaacggaucgagcccuccugggccgaugugaagaaagaccugauuagcuauggaggcggguggaagcucgagggagaauggaaggagggcgaagagguucaggugcuggcucucgaaccuggcaaaaauccgcgcgccguccagacaaagcccgggcuguuuaaaaccaacacgggaaccaucggcgcggugucccuugauuucucuccugggacaagcggaucccccauuaucgacaagaaaggcaaggugguugggcuguacggaaacggcgucgugaccagaagcggcgcuuaugugucugccaucgcccaaacagagaaguccauugaggauaauccugaaaucgaggacgauauuuuucggaaacgcagacugaccaucauggaccuccaccccggggcuggaaagacaaaacgguaccugccugccauugucagagaagcgaucaagcgcggccuucggacgcugauucucgcuccgaccagagugguugccgccgagauggaagaggcucugcgcgggcuccccauccgguaucagaccccugccaucagagcugagcauaccggacgcgaaauuguggaccugaugugucacgccaccuucacaaugcggcuucugagccccgucagagugccuaacuacaaucugaucauuauggaugaggcgcauuucacggaccccgccucuaucgcugcccgcggcuauauuuccacccggguugaaaugggggaggcugccggcaucuuuaugacagccaccccgccuggaagcagagaucccuucccccaguccaacgcuccuaucauugacgaggaacgggagauccccgaacgcucuuggaauagcggccacgagugggugacagauuuuaaagggaagaccgucugguucgugccuuccauuaaggcgggaaacgacaucgccgcuugccuccgcaaaaauggcaagaaaguuauucaacugagccggaagacguuugauucugaauacgugaaaacacgcaccaacgacugggauuucgucgugaccacagacaucuccgagaugggggccaauuuuaaggccgagagagugaucgauccgcggagauguaugaaacccgucauucuuaccgacggagaggaacgcguuauccuggcuggcccuaugcccgugacacauagcucugccgcgcagcggagagggcgcauuggccggaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaaagagagaagguggacgccaucgauggggaauaccgccuccggggagaggcuagaaaaacguuugucgaccuuaugcgcagaggcgaucugccuguguggcuggccuauaagguugcggccgaggggaucaacuacgcugaccggcgcugguguuucgauggaauuaaaaacaaucagauccucgaagagaacguggaagucgagauuuggacaaaggagggcgaaagaaagaaacugaagccccgguggcuugacgcccgcaucuauuccgauccucuggcucucaaagaguuuaaggaguucgccgcugggagaaaaucucugacccugaaucucauuacagagaugggccggcuucccaccuucaugacgcaaaagaccagagacgcccuggauaaccuggcggugcuccacacagccgaagcuggaggccgcgccuacaaucaugcucugagcgagcuuccggagacccuggaaacacuccugcugcucacccuucuggccacaguuaccgggggaaucuuucuguuccucauguccggccgggggaucggaaagaugacgcugggcaugugcugcauuacaaccgccucuauccuucugugguaugcucagauucagccucacuggaucgcggccagcauuauccucgaguuuuuccugaucgugcugcucauucccgaacccgagaaacagagaaccccucaagacaaccagcuuacauacgucgugaucgcuauucugaccgucguggccgccacaauggcuaaugaaaugggcuuucuggagaagacgaaaaaggaccucgggcugggauccaucgccacccagcagccggagagcaacauucuugauaucgaccugcgccccgcgucugccuggacacucuacgcuguugccaccacauucgugaccccuaugcugcggcauuccauugaaaauagcuccgugaacgucucucugacggcuaucgccaaucaagcgaccguucucaugggccuugggaaaggauggccccugagcaagauggauaucggcgugccucugcucgccauuggguguuauucccaggugaaccccaucacacugaccgcugcccuucugcuccuggucgcucacuacgccauuaucggaccuggccugcaggcuaaggccacaagagaggcgcagaaacgggccgcugccggcauuaugaagaauccgaccguggacgggaucacgguuaucgaucucgaccccauuccuuaugaucccaaauuugaaaagcaacuuggacaggugaugcugcugauccucugcgucacacaggugcugaugaugcgcaccacaugggcucuuugugaggcccugacccucgccaccggcccuauuucuacacugugggaagggaaccccggaagauucuggaauacgaccaucgcggucagcauggcuaacauuuuucggggcuccuaccuggccggggcuggacuccuuuucagcaucaugaaaaauacaaccaacacacgcagaggcaccggcaacaugggggagacgcugggagagaaguggaaaucucggcugaaugcccucggcaaguccgaauuucaaaucuauaagcgcagcgggauucaggagguggacagaacacuggccaaagaaggaaucaagcggggcgagaccgaucaccaugcuguuucucgcggguccgccaaacuuagaugguucguggagcggaacauggucaccccggaaggaaaggugguugaccugggcugcggcagagggggauggagcuacuauuguggcgggcucaaaaaugugcgcgaggucaagggacugacaaagggcgggccuggacacgaagaacccauucccaugucuaccuacggcuggaaccuggugcggcuccagagcggcguggaugucuuuuucaucccucccgaaaaaugcgacacacuucugugugauauuggggaguccucuccuaauccgacggucgaggcgggaagaacccugcgcgugcucaaccugguggaaaauuggcuuaacaauaacacacaguucugcaucaagguccugaaucccuacaugccuagcguuaucgagaaaauggaagcccuccaacggaaguauggcggggcucuggugagaaacccccugucccgcaauagcacccaugagauguacuggguguccaacgccucuggaaauauugucagcuccgugaacaugaucucucggaugcucauuaacagauuuacaaugcgccacaaaaaggcuaccuaugaaccugacguugaccuuggcagcgggacgcggaauaucggaauugaguccgagauccccaaccuggauauuaucggcaagagaaucgagaagauuaagcaggagcaugaaaccucuuggcacuacgaccaggaucacccguauaaaacaugggccuaccauggcagcuaugagaccaagcagacaggguccgcgagcucuauggugaauggagucgugcgccugcucaccaaaccuugggacguucugcccacagugacccaaauggccaugacggauacaaccccuuucggccagcagcgggucuuuaaggaaaagguggacaccagaacacaggagcccaaagaggggacgaagaaacuuaugaagaucaccgcugaauggcuguggaaagagcucggaaagaaaaagacaccucgcauguguaccagagaagaguucacacggaaggugcgcuccaacgccgcucugggcgccauuuuuaccgaugagaauaaauggaaaagcgcuagagaagccgucgaggacucucgguucugggaacugguugauaaagagagaaaccuccaccuggaagggaagugcgagacauguguguacaauaugaugggaaaacgggagaagaaacuuggcgaauuuggcaaagcgaaggggucccgcgccaucugguacauguggcugggagcuagauuccucgaguuugaagcccugggcuuccuuaacgaggaccauugguuuagccgggaaaauucucuguccgggguggagggagagggccuccacaaacugggguauauucugcgcgaugucagcaagaaagaaggcggagcuauguacgccgacgacaccgccggcugggauacgagaaucacccucgaggaccugaagaacgaagagauggugacaaaucacauggaaggggagcauaagaaacuugcggaggcuaucuucaagcugaccuaucaaaacaaaguugugcggguccagcgccccgccccgagaggaacagugauggauauuaucucccggcgcgaccagagaggcagcgggcaaguuggaaccuacggccucaauacguuuacaaacauggaagcccagcugauucggcagauggagggggaaggcguguucaagaauauccagcaccuuaccgucacagaggagguggcuguucaaaacuggcuggcccgcgugggaagagaacggcucucucgcauggcuauuagcggcgaugacugcgucgugaaaccucuggaugacagauucgccaacgcgcugaccgcccucaaugauauggggaagauccggaaggacauccagcagugggagcccuccaaaggauggaacgauuggacgcagguccccuuuugcucucaucacuuccaugaacugauuaugaaggacggcagagugcuuguugugccuugucgcaaucaagaugagcugaucgggcgggcuagaauuagccagggagccggcuggucccuccgcgaaaccgcuugccuggggaaaucuuaugcccagauguggagccuuauguacuuucaccggagagaccugcgccucgcggccaacgcuaucuguuccgccgucccgucucacugggugcccacaagccggaccacaugguccauucaugcuaagcacgaguggaugaccacagaggacaugcugaccguguggaauagaguuuggauccgcgaaaacccuuggauggaggauaaaacgcccguggaaagcugggaggaaauuccuuaucugggcaagcgggaggaccaguggugcggaucucucaucggccugacauccagagccaccugggcuaagaauauccaagccgcgauuaaccagguccgcagccuuaucgggaaugaggaauacaccgauuacaugcccucuaugaaacgguucagacgggaggaagaggaagccggagugcugugguga

SEQ ID NO: 20062 - RNA, 9876 nt, Artificial Sequence
  derived and/or modified CDS sequence (opt5) from DENV-2__FJ410195__SS-prME
agcgccggaaugaucauuaugcugauccccaccgugauggcuuuccaccugaccacgagaaauggggaaccucauaugauugucggaauccaggaaaagggcaaaucccugcuuuuuaagaccgaggacgggguuaauaugugcacgcugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugaucgucggcgcuacgauggccgaugacauuggcaugggggugaccuaucucgcccugcuggcugccuucaagguucgcccuacauuugcggcuggacuucugcuccggaagcugaccuccaaagagcucaugaugacaaccaucggcauugugcugcuuucucaaagcacgauccccgaaacaguccuggagcucaccgaugcccuggcccuggggaugauggugcuuaagaucgugagaaauauggaaaaauaccagcuggcugucacaauuaugaccauccucugcguuccuaacgccgugauucugcagaaugcguggaagguguccuguaccauccucgcugucgugucuguuagcccccugcuucugacauccagccgccagaaaacggacuggauuccucucgcccugaccaucaagggacugaaccccacagccaucuuccuuaccacacugucuagaaccaauaaaaagcgguccuggccgcucaacgaggcuauuauggccgugggcauggucagcauccuggcuucuucccuccugaagaaugacauuccuaugacggggccccuuguggccggaggccugcugacaguuugcuaugugcucaccggccgcagcgcggaucuggaacuugagagagccaccgacgucaaaugggaggaucaagcugaaaucucuggguccagcccuauucuguccaucacaauuagcgaggacggaucuaugagcaucaagaacgaagaggaggaacagacccucacaauccugauucggacgggccuccuggugaucuccgggcuucugcccauuucuaucccgauuaccgccgcugccugguaccugugggaggucaaaaagcagcgcgccggagugcucugggauguuccuucucccccucccaugggcaaagcugaacuggaggacggggcguauagaaucaagcagaagggaauccuuggcuacucccaaauuggcgccgggguguacaaagaaggaacauuucacaccauguggcaugucacacggggcgcugugcugaugcacaaggggaaacgcaucgagcccuccugggccgauguuaagaaagaccucauuagcuauggaggcggguggaagcuggagggagaauggaaggagggcgaagaggugcagguccucgcccuggaaccuggcaaaaauccgagagcugugcagaccaagcccgggcuuuucaaaacgaacaccggaacaaucggcgccgugucccuggauuuuucuccugggaccagcggaucccccauuaucgacaagaaaggcaagguugucgggcuguacggaaacggcguggugacacggagcggcgcguaugucucugcuaucgcccagaccgagaaguccauugaggauaauccugaaaucgaggacgauauuuuccgcaaaagacggcucacaaucauggaccugcaccccggggccggaaagacgaaaagauaccuuccugcuauugugcgcgaagccaucaagcggggccugagaacccucauucuggcgccgacacgcguuguggcugccgagauggaagaggcccuccgggggcugcccaucagauaucaaaccccugcuauccgcgccgagcauaccggacgggaaauugucgaccuuaugugucacgcuacauuuacgaugagacugcugagccccgugcgcguuccuaacuacaaucucaucauuauggaugaggcccauuucaccgaccccgcgucuaucgccgcucggggcuauauuuccacaagaguggaaaugggggaggccgcuggcaucuucaugaccgccacaccgccuggaagccgggaucccuuuccccaguccaacgccccuaucauugacgaggaacgcgagauccccgaaagaucuuggaauagcggccacgagugggucaccgauuucaaagggaagacggugugguuuguuccuuccauuaaggcuggaaacgacaucgcggccugccugcggaaaaauggcaagaaagugauucagcuuagccgcaagacauucgauucugaauacgucaaaaccagaaccaacgacugggauuuuguggugacaaccgacaucuccgagaugggggcuaauuucaaggccgagcgggucaucgauccgagacgcuguaugaaacccguuauucugacagacggagaggaacgggugauccucgccggcccuaugcccgugacccauagcucugcugcccaaagacgcgggcggauuggcagaaacccuaagaaugaaaacgaccaguacaucuauaugggagagccccuggaaaaugaugaggacugcgcgcacuggaaggaggcuaaaaugcugcucgauaacauuaauacgccggaaggcaucauuccuagcauguuugagcccgaacgcgagaaggucgacgccaucgauggggaauaccggcuuagaggagaggcccgcaaaacauucguggaccugaugagacggggcgaucugccuguuuggcucgcuuauaagguggccgcggaggggaucaacuacgccgaccgcagaugguguuuugauggaauuaaaaacaaucagauccuggaagagaacgucgaaguggagauuuggaccaaggagggcgaacggaagaaacuuaagccccgcuggcuggacgcuagaaucuauuccgauccucucgcccugaaagaguucaaggaauuugcugccgggcggaaaucucugacacucaaucuuauuaccgagaugggcagacugcccacguucaugacccagaagacacgcgacgcucuggauaaccucgccguucugcacaccgcggaagccggaggccgggcuuacaaucaugcccuuagcgagcugccggagacacucgaaacccugcugcuccuuacacugcuggcuaccgugacagggggaaucuuccucuuucugauguccggcagagggaucggaaagaugacacuuggcaugugcugcauuaucaccgccucuauucugcucugguaugcccaaauccagccucacuggauugcugcgagcaucauccuggaguucuuucugauuguccuccuuauccccgaacccgagaaacagcgcaccccucaggacaaccaacugacauacguggucauugccauccugaccgugguugcugccacaauggccaaugaaaugggcuuccucgagaagacgaaaaaggaccuggggcuuggauccauugcuacccagcagccggagagcaacauccuggauauugaccuccggcccgccucugcguggacacuguacgccguggcuaccacauuugugaccccuaugcugagacauuccaucgaaaauagcuccgucaacguuucucucacggccaucgcuaaucaggccaccgugcuuaugggccuggggaaaggauggccccugagcaagauggauauuggcgugccucuccuggcgaucggguguuauucccaagucaaccccauuacacuuaccgccgcucugcuccugcugguggcccacuacgcuaucauuggaccuggccuccaggccaaggcuacacgggaggcccagaaacgcgcggccgcuggcaucaugaagaauccgaccguugacgggaucacggugauugaucuugaccccaucccuuaugaucccaaauucgaaaagcagcugggacaagucaugcugcucauucugugcgugacacagguccuuaugaugagaaccacaugggcccugugugaggcucucacccuggccaccggcccuaucucuacacugugggaagggaaccccggacgguuuuggaauacgaccauugccgugagcauggcgaacaucuuccgcggcuccuaccucgcuggggccggacuucuguuuagcaucaugaaaaauacaaccaacacaagacggggcaccggcaacaugggggagacgcugggagagaaguggaaaucucgccucaaugcucugggcaagaacgaguuccagauuuauaagaaauccgggauccaagagguugacagaacacuugccaaggaaggaauuaaacggggcgagaccgaucaccaugccgugagccgcgggucugcuaagcugagaugguuugucgagcggaauauggugaccccggaaggaaaaguuguggaccucggcugcggcagagggggaugguccuacuauuguggcgggcugaagaacguccgcgaggugaagggacugacaaaaggcgggccuggacacgaagaacccauccccaugagcaccuacggcuggaaucucgugcggcuucagucuggcguugaugucuucuuuauuccucccgaaaagugcgacacacugcugugugauaucggggagagcuccccuaacccgacgguggaggccggaagaacccuccgcgugcugaaucuugucgaaaacuggcugaauaacaauacacaguucugcaucaaaguucucaaccccuacaugccuucugugauugagaagauggaagcgcugcagcggaaauauggcggggcccuggugagaaauccccucagccgcaacuccacccaugagauguacugggucagcaaugcuuccggaaacaucgugucuagcguuaacaugauuucccggaugcuuaucaauagauucacaaugcgccacaagaaggccaccuaugaaccugacguggaccugggcucugggacgcggaacauuggaaucgagagcgagauucccaaucuggauaucaucggcaaaagaauugaaaagaucaaacaagagcaugaaaccuccuggcacuacgaccaggaucacccguauaagacaugggcuuaccauggcucuuaugagaccaaacagacagggagcgccuccagcauggucaacggagugguucgccuccugaccaagccuugggacgugcuucccacagucacccagauggcgaugacggauacaaccccuuuuggccaacagcggguguucaaggaaaaaguggacaccagaacacaggagcccaaggaggggacgaaaaagcugaugaaaauuaccgccgaauggcucuggaaggagcugggcaaaaagaagacaccucgcauguguaccagagaagaguuuacacggaaaguccgcucuaaugcugcccugggcgcuaucuucaccgaugagaacaaguggaaauccgccagagaagcuguugaggacagccgguuuugggaacucguggauaaggagagaaaucugcaccuugaagggaaaugcgagacauguguguacaacaugaugggaaagcgggagaagaaacugggcgaguucggcaaggccaaagggucucgcgcgauuugguacauguggcucggagccagauuucuggaguucgaagcucuuggcuuucugaaugaggaccauugguucucccgggaaaacagccucucuggggucgagggagagggccugcacaagcugggguauauccuccgcgauguguccaaaaaggaaggcggagccauguacgcugacgacaccgccggcugggauacgagaaucacccuggaggaccuuaagaaugaagagaugguuacaaaccacauggaaggggagcauaaaaagcuggccgaggcgauuuuuaaacucaccuaucagaauaaggugguccgggugcaacgccccacaccgagaggaaccguuauggauaucauuagccggcgcgaccagagaggcuccgggcaggucggaacguacggccugaacacauucaccaauauggaagcucaacuuauccggcagauggagggggaaggcgucuuuaaaaacauucagcaccugacagugaccgaggagguugccgugcagaacuggcucgcccgcgucggaagagaacggcugagccgcauggcuaucucuggcgaugacugcguggucaagccucuggaugacagauucgccaaugcucucacggcccugaacgauauggggaagauccggaaagacauucaacagugggagcccagcaagggauggaaugauuggacccaggugcccuucugcucccaucacuuucaugaacuuaucaugaaagacggcagaguucugguggucccuugucgcaaccaggaugagcucauugggcgggcgagaaucucucaaggagccggcuggagccugcgcgaaacagcuugccuugggaaguccuaugcccagauguggucucugauguacuuccaccggagagaccuccgccuggcugccaaugcgauuuguagcgccgugccgucccacugggugcccaccucucggacaaccuggagcauccaugcuaaacacgaguggaugacaaccgaggacaugcugacgguuuggaacagaguguggauucgcgaaaauccuuggauggaggauaagacacccgucgaauccugggaggaaaucccuuaucucggcaagcgggaggaccaguggugcggaagccugaucggccuuaccucuagagccaccugggcuaaaaacauucaggccgcuaucaaucaagugcgcucccugauugggaacgaggaauacacagauuacaugcccagcaugaagcgguuuagacgggaggaagaggaagccggaguucucugguga

SEQ ID NO: 20063 - RNA, 9876 nt, Artificial Sequence
  derived and/or modified CDS sequence (opt5) from DENV-2__FJ432726__SS-prME
agcgccggaaugaucauuaugcugauccccacagugauggcuuuccaccugacaacgagaaauggggagccucauaugauuguuggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauauccgcggcauuaugcaagcugggaagcggucucuuagaccucagcccaccgagcucaaauacagcuggaagacauggggaaaggccaaaaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaagaaaagcaggacgcuuuuugugacuccaaacugaugagcgccgcuaucaaggauaaucgggccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggcuucccaacacaauuacagaccuggauaccacacccagauugccggccccuggcaucucgggaaacuggagauggacuucgauuuuugugacggaacgacagugaucgugaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaggagaaagaagagaaucucgucaacagccugguuaccgcuggacacggccagguggauaauuucucccugggggugcuuggaauggcgcucuuucuggaagagaugcugcggacaagagucggcaccaagcaugccauccuccugguggcuguuucuuucgugacacuuauuaccgggaacaugagcuuuaaagaccugggacgcgucgugguuauggugggcgccacgauggccgaugacaucggcaugggggucaccuaucucgcucugcuggccgcguucaaggugcggccuacauuugcugccggacuucugcucagaaaacugaccuccaaggagcucaugaugacaaccauuggcaucguucugcuuucucaaagcacgauucccgaaacagugcuggagcucaccgaugcccuggcucuggggaugaugguccuuaagaucgugcgcaauauggaaaaauaccagcuggccgugacaaucauggcgauucucugcgucccuaacgcuguuauccugcagaaugccuggaagguguccuguaccauucucgccguggucucugugagcccccugcuucugaccuccagccagcagaagacggacuggaucccucucgcucugacgauuaagggacugaaccccaccgccaucuuccuuacaacccugucuagaacaaauaaaaagcgguccuggccgcucaacgaggcuaucauggccguuggcauggugagcauucuggcgucuucccuccugaaaaaugacaucccuaugaccgggccccuugucgccggaggccugcugacggugugcuauguucucacaggccgcagcgcugaucuggaacuugagagagccaccgacgugaagugggaggaucaggcugaaauuucuggguccagcccuauccuguccauuaccaucagcgaggacggaucuaugagcauuaagaacgaagaggaggaacagacacucaccauccugauccggacaggccuccuggucauuuccgggcuuuuucccaucucuauuccgaucacggccgccgcuugguaccugugggaggugaaaaagcagcgcgcgggaguccugugggaugugccuucucccccucccaugggcaaagccgaacucgaggacggggcuuauagaauuaagcaaaaaggaauccugggcuacucccagaucggcgccgggguuuacaaggaaggaaccuuccacacaauguggcaugugacccggggcgccguccuuaugcacaaggggaaacgcauugagcccuccugggcugaugugaagaaagaccugaucagcuauggaggcggguggaagcucgagggagaauggaaagagggcgaagagguucaggugcuggcccucgaaccuggcaagaauccgagagcgguccagacaaagcccgggcuguuuaaaaccaacacgggaaccauuggcgcugugucccuugauuucucuccugggacaagcggaucccccaucauugacaagaaaggcaaggugguugggcuguacggaaacggcgucgugacccggagcggcgccuaugugucugccaucgcucaaacagagaaauccaucgaggauaauccugaaauugaggacgauaucuuucgcaagagacggcugaccauuauggaccuccaccccggggccggaaagacaaaaagauaccugccugcgaucguccgcgaagcuauuaagcggggccuuagaacgcugauccucgccccgacccgcgugguugccgcugagauggaagaggcccugcgggggcuccccauuagauaucagaccccugcuauccgcgccgagcauaccggacgggaaaucguggaccugaugugucacgcgaccuucacaaugagacuucugagccccguccgcgugccuaacuacaaucugauuaucauggaugaggcccauuucacggaccccgcuucuauugccgcucggggcuauaucuccaccagaguugaaaugggggaggccgccggcauuuuuaugacagcuaccccgccuggaagccgggaucccuucccccaguccaacgcgccuaucaucgacgaggaacgcgagauucccgaaagaucuuggaauagcggccacgagugggugacagauuuuaaagggaagaccgucugguucgugccuuccaucaaagccggaaacgacauugcugccugccuccggaagaauggcaagaaaguuauccaacugagccgcaagacguuugauucugaauacgugaaaacaagaaccaacgacugggauuucgucgugaccacagacauuuccgagaugggggccaauuuuaaggcugagcgggugaucgauccgagacgcuguaugaaacccgucauccuuaccgacggagaggaacggguuauucuggccggcccuaugcccgugacacauagcucugcggcucagagacgcgggcggaucggcagaaacccuaagaaugaaaacgaccaguacauuuauaugggagagccccucgaaaaugaugaggacugcgcccacuggaaagaggccaagaugcugcuggauaacaucaauaccccggaaggcauuaucccuagcauguucgagcccgaacgcgagaagguggacgcuauugauggggaauaccggcucagaggagaggcccgcaaaacguuugucgaccuuaugagacggggcgaucugccuguguggcuggcguauaagguugccgcugaggggaucaacuacgccgaccgcagaugguguuucgauggaaucaaaaacaaucagauucucgaagagaacguggaagucgagaucuggacaaaggagggcgaacggaaaaagcugaagccccgcuggcuugacgcuagaauuuauuccgauccucuggcccucaaagaguuuaaggaguucgcugccgggcggaaaucucugacccugaaucucaucacagagaugggcagacuucccaccuucaugacgcaaaagacccgcgacgcgcuggauaaccuggccgugcuccacacagcugaagccggaggccgggcuuacaaucaugcccugagcgagcuuccggagacccuggaaacacuccugcugcucacccuucuggccacaguuaccgggggaauuuuucuguuccucauguccggcagagggaucggaaaaaugacgcugggcaugugcugcaucauuacagcuucuauccuucugugguaugcgcagauucagccucacuggaucgccgcuagcauuauccucgaguuuuuccugaucgugcugcucauucccgaacccgagaagcagcgcaccccucaagacaaccagcuuaccuacgucgugaucgccauucugacagucguggccgcuaccauggccaaugaaaugggcuuucuggagaagaccaagaaggaccucgggcugggauccaucgcgacgcagcagccggagagcaacauucuugauaucgaccugcggcccgccucugcuuggacccucuacgccguugcuacaaccuucgugacaccuaugcugagacauuccauugaaaauagcuccgugaacgucucucugaccgccaucgcgaaucaagccacgguucucaugggccuugggaaaggauggccccugagcaagauggauaucggcgugccucugcucgcuauuggguguuauucccaggugaaccccaucacccugacagccgcccuucugcuccuggucgcccacuacgcuauuaucggaccuggccugcaggccaaagcgacccgggaggcccagaagcgcgcugccgcuggcauuaugaagaauccgacaguggacgggaucaccguuaucgaucucgaccccauuccuuaugaucccaaauuugaaaagcaacuuggacaggugaugcugcugauccucugcgucacacaggugcugaugaugagaacaaccugggcccuuugugaggcccugacacucgcgaccggcccuauuucuacccugugggaagggaaccccggacgguucuggaauacaacgaucgcugucagcauggccaacauuuuucgcggcuccuaccuggcuggggccggacuccuuuucagcaucaugaaaaauaccacaaacaccagacggggcacaggcaacaucggggagacccugggagagaaguggaaaucucgccugaaugcccucggcaaguccgaauuucaaauuuauaaaaagagcgggauccaggagguggacagaacgcuggcuaaggaaggaauuaaacggggcgagacagaucaccaugccguuucucgcggguccgcgaaacuuagaugguucguggagcggaacauggucaccccggaaggaaaagugguugaccugggcugcggcagagggggauggagcuacuauuguggcgggcucaagaaugugcgcgaggucaaaggacugaccaagggcgggccuggacacgaggaacccauccccaugucuacauacggcuggaaccuggugcggcuccagagcggcguggaugucuuuuucauuccucccgaaaagugcgacacccuucugugugauaucggggaguccucuccuaauccgacagucgaggccggaagaacgcugcgcgugcucaaccugguggaaaauuggcuuaacaauaacacccaguucugcaucaaaguccugaaucccuacaugccuagcguuauugagaagauggaagcucuccaacggaaauauggcggggcccuggugagaaacccccugucccgcaauagcacacaugagauguacuggguguccaacgcuucuggaaauaucgucagcuccgugaacaugauuucucggaugcucaucaacagauuuaccaugcgccacaagaaagccacauaugaaccugacguugaccuuggcagcgggacccggaauauuggaaucgaguccgagauucccaaccuggauaucaucggcaagagaauugaaaagaucaaacaggagcaugaaacgucuuggcacuacgaccaggaucacccguauaagaccugggcguaccauggcagcuaugagacaaaacagaccggguccgccagcucuauggugaauggagucgugcgccugcucacaaagccuugggacguucugcccaccgugacacaaauggcuaugaccgauacgacaccuuucggccagcagcgggucuuuaaagaaaagguggacaccagaacccaggagcccaaggaggggaccaagaaacuuaugaaaauuacggccgaauggcuguggaaggagcucggcaagaagaaaaccccucgcauguguacaagagaagaguucacccggaaggugcgcuccaacgcugcccugggcgcuaucuuuacagaugagaauaaguggaaaagcgccagagaagcggucgaggacucucgguucugggaacugguugauaaggagagaaaccuccaccuggaagggaaaugcgagaccuguguguacaauaugaugggaaagcgggagaagaaacuuggcgaauuuggcaaagccaaagggucccgcgcuauuugguacauguggcugggagccagauuccucgaguuugaagcucugggcuuccuuaacgaggaccauugguuuagccgggaaaauucucuguccgggguggagggagagggccuccacaagcugggguauauccugcgcgaugucagcaaaaaggaaggcggagccauguacgccgacgacacagcgggcugggauaccagaaucacgcucgaggaccugaaaaacgaagagauggugaccaaucacauggaaggggagcauaagaaacuugcugaggccauuuucaaacugacauaucaaaacaagguugugcggguccagcgccccaccccgagaggaacagugauggauaucauuucccggcgcgaccagagaggcagcgggcaaguuggaaccuacggccucaauacguuuacaaacauggaagcccagcugauccggcagauggagggggaaggcguguucaaaaauauucagcaccuuaccgucacagaggagguggcuguucauaacuggcuggcccgcgugggaagagaacggcucucucgcauggcuaucagcggcgaugacugcgucgugaagccucuggaugacagauucgccaacgcgcugaccgcccucaaugauauggggaaaauccggaaggacauucaacagugggagcccuccaagggauggaacgauuggacgcagguccccuuuugcucucaccauuuccacgaacugaucaugaaagacggccggauucuugugguuccuugucgcaaucaggaugagcugaucgggcgggcuagaauuagccaaggagccggcuggucccuccgcgaaaccgcuugccuggggaagucuuaugcccagauguggagccuuauguacuuucaccggagagaccugcgccucgcggccaacgcuaucuguuccgccgugccgucucauuggguccccacaagccggaccacaugguccauucacgcuaaacaugaguggaugaccacagaggacaugcugaccguguggaauagaguguggauccgcgaaaacccuuggauggaggauaagacgcccguugaaagcugggaggaaaucccuuaucugggcaaacgggaggaccaguggugcggaucucucauuggccugacauccagagccaccugggcuaagaauauccaggccgcgauuaaccaagugcgcagccuuaucgggaaugaggaauacaccgauuacaugcccucuaugaagcgguucagacgggaggaagaggaagccggaguccugugguga

SEQ ID NO: 20064 - RNA, 9876 nt, Artificial Sequence
  derived and/or modified CDS sequence (opt5) from DENV-2__JF730049__SS-prME
agcgccggcaugaucauuaugcugauccccaccgucauggcuuuccaccucaccacgcggaauggggaaccucauaugauugucggaauccaggaaaagggcaagagccugcuuuuuaagaccgaggacgggguuaauaugugcacgcugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugucgugggaaacgacacaggcaaacacggccaggaaaucaagguuaccccucaauccagcaucacagaggccgaacugaccggguauggaacggugaccauggaguguucucccagaacaggccuugauuucaaugaaaugguccugcuccagauggagaacaaagcguggcuggugcaccggcagugguuucuugaccugccgcucccuuggcugcccggggccgauaagcaggaguccaauuggauucaaaaggaaacccugguuacauucaaaaacccucaugcuaagaaacaggacguggucgugcucggaagccaggagggcgccaugcacaccgcucugacgggggccacagaaauccaaauguccucuggcaaucuucuguuuaccggacaucucaagugccgccugagaauggacaaacuucagcugaagggcaugagcuacuccauguguacagggaaguucaaagucgugaaggagauugccgagacccagcacggaaccaucguuauucgggugcaguaugaaggcgaugggagccccugcaaaauccccuucgagaucauggaccucgaaaagagauacguccugggacgccugauuacagugaacccuaucguuacggagaaagauucuccggugaacauugaagcugagcccccuuuuggcgacuccuacaucauuaucggggucgagcccggccaacucaagcugaauugguucaagaaaggaagcucuauuggccagauguuugaaaccacaaugagaggggcgaagagaauggccauccuuggagauaccgcuugggacuucggcagccucgggggaguguuuacauccaucggcaaagcccuccaucagguguucggggccauuuauggcgcugccuuuucuggaguuagcuggaccaugaagauccugauuggcgucaucauuacguggaucgggaugaacucccgcagcacaucucuguccgugagccuugugcucgucggaaucgugacccuguaccugggcguuauggugcaggcggauucugggugugucguguccuggaaaaauaaggagcucaagugcggaagcggcauuuucaucaccgacaacguucacacauggaccgaacaauauaaauuucagccugagucccccucuaagcuggcuagcgccauucagaaagcccaggaagaggggaucuguggcauucgguccgugacaagacuugagaaucugauguggaagcaaaucacgccggaacucaaccacauccugaccgagaaugaagucaaacugacaauuaugaccggagauaucaagggcauuaugcaggcugggaaacgcucucuucggccucagcccacagagcucaaguacagcuggaagaccuggggaaaagccaagauguucuccacggaaagcuauaaccagaccuuucugaucgacggcccugagacagcugagugccccaauaccaacagagccuggaacucucuggaaguggaggauuacggguucggaguuuuuacaaccaacauuuggcucaaacugaaggaaaaacaagacgcguucugugacuccaaacuuaugagcgccgcuaucaaggauaaucgcgccgugcaugcugacaugggcuauuggaucgagucugcccugaacgauacauggaaaauugagaaggcguccuucaucgaagucaaaaauugccacuggccuaagagccauacccucuggucuaacggcgugcuggagagcgaaaugauuauccccaaaaaccuggccgggccggugucccagcacaauuaccggccuggauaccacacgcagauugcuggccccuggcaucuugggaagcucgagauggacuuugauuucugugacggaacaaccgucaucguuaccgaagauugcggcaacagagggcccagccugcgcacaaccacggccucuggaaagcugauuacagaguggugcugucgguccugcacccucccuccgcugagauaucggggcgaggacggcuguugguacgggauggaaauccgcccccuuaaagagaaggaagagaaucuggugaacagccucgugacagcuggacacggccaagucgauaauuuuucccugggggugcugggaauggcccuuuuccucgaagagaugcugaaaaccagaguuggcacaaagcaugccauccugcucguggcugucucuuuugugacccugauuacggggaacaugagcuucaaagaccuuggacggguuguggucauggugggcgcgaccauggccgaugacaucggcauggggguuacauaucuggcucuccuggccgccuuuaaggugagaccuaccuucgcugccggacugcuucugcgcaagcucacauccaaagagcugaugaugaccacgauuggcaucguccuccugucucagagcacaauucccgaaaccgugcuugagcugacagaugcgcucgcucuggggaugauggugcugcggaucgucagaaauauggaaaaguaccagcuugccguuaccaucauggccauucugugcgugccuaacgcugugauccuccagaaugccuggaaagucuccuguaccauucuggcggugguuucugugagcccccuccugcuuacauccagccaacagaagacggacuggaucccucuggcucucaccauuaaaggacugaaccccacagccaucuuucugaccacacuuucucgcaccaauaagaaaagauccuggccgcugaacgaggccaucauggcugucggcauggugagcauucucgccucuucccugcucaagaaugacaucccuaugacggggccccugguugcuggaggccuucugacagugugcuauguccugaccggccggagcgccgaucucgaacuggagcgcgcgaccgacgugaagugggaggaucaggccgaaauuucuggguccagcccuauccuuuccauuacaaucagcgaggacggaucuaugagcauuaaaaacgaagaggaggaacagacccugacaauccucaucagaacgggccugcucgucauuuccgggcuguuccccaucucuauuccgaucaccgcugccgcuugguaccuuugggaggugaagaaacaacgggccggaguucugugggaugugccuucucccccucccaugggcaaggccgaacuggaggacggggcuuaucgcauuaaacagaagggaauccucggcuacucccagaucggcgcgggggucuacaaggaaggaacauuucacaccauguggcaugugacaagaggcgccguucugaugcacaaagggaagcggauugagcccuccugggcugaugugaaaaaggaccuuaucagcuauggaggcggguggaaacuggagggagaauggaaggagggcgaagagguccaggugcucgcccuggaaccuggcaagaauccgcgcgccgugcaaaccaaacccgggcuguucaagacguccaccggaacaauuggcgcuguuucucuggauuuuagcccugggaccuccggaagccccaucauugacaaaaagggcaaagucguggggcuuuacggaaacggcguggucacaagaucuggcgccuauguguccgcgaucgcucagaccgaaaagagcaucgaggauaacccugaaauugaggacgauaucuuccggaagcgcagacugacaauuauggaccugcaccccggggccggaaaaacgaagcgguaccucccugccaucguuagagaagcuauuaaacgcggccugcggacccuuauccuggccccgacaagaguggucgcggcugagauggaagaggcccuccgcgggcugcccauucgguaucagaccccugccaucagagcugagcauaccggacgcgaaaucguggaccucaugugucacgccacauucacgaugcggcugcuuucucccguuagagugccuaauuacaaccugauuaucauggaugaggcucauuuuaccgaccccgccuccauugcggcccgcggcuauaucagcacacgggucgaaaugggggaggcugccggcauuuucaugaccgcuacaccgccuggauccagagaucccuuuccccaaucuaaugccccuaucaucgacgaggaacgggagauucccgaacgcagcuggaacuccggccacgagugggugaccgauuucaaggggaaaacgguuugguuugugccuagcaucaaggccggaaaugacauugcugcgugccugagaaagaacggcaaaaaggucauccagcucucucggaaaacauucgauuccgaauacgugaagacccgcaccaaugacugggauuuuguggucacaaccgacauuagcgagaugggggccaacuucaaagcugagagaguuaucgauccgcggagauguaugaagcccgugauccugacagacggagaggaacgcgugauucuugccggcccuaugcccgucacccauucuagcgccgcucagcggagagggcgcaucggccggaauccuaaaaacgaaaaugaccaguacauuuauaugggagagccccuggaaaacgaugaggacugcgcccacuggaaggaggcgaagaugcuccuggauaauaucaacacgccggaaggcauuaucccuuccauguuugagcccgaaagagagaaaguggacgcuauugauggggaauaccgccugcggggagaggccagaaagacauucguugaccucaugcgcagaggcgaucuuccuguguggcuggccuauaaagucgcugccgaggggaucaauuacgcggaccggcgcugguguuuugauggaaucaagaacaaccaaauucuggaagagaauguggaaguugagaucuggaccaaagagggcgaaagaaagaagcucaaaccccgguggcuggacgcccgcauuuauucugauccucuugcucugaaggaguucaaagaguucgccgcugggagaaagagccucacacugaaccugaucaccgagaugggccggcuccccacguuuaugacccagaaaacaagagacgcccuugauaaucuggcugugcugcacaccgccgaagcgggaggccgcgccuacaaccaugcucucuccgagcugccggagacacuugaaacccugcuccugcugacacuccuugccaccgucacagggggaauuuuccuguuucugaugucuggccgggggaucggaaagaugacacucggcaugugcugcaucauuaccgcuagcauccugcuuugguaugcccagauucagccucacuggaucgccgcuuccauuauccuggaguucuuucucaucgugcugcugauucccgaacccgagaagcaaagaaccccucaggacaaucagcucacauacgucgugaucgcgauucuuaccguuguggccgcuacaauggccaacgaaaugggcuuccuggagaaaacgaagaaagaccuggggcucggaagcaucgccacccagcaaccggagucuaauauucuggauaucgaccuucgccccgcuuccgccuggacacuguacgcgguggccaccacauuugucaccccuaugcuccggcauagcauugaaaacuccucuguuaaugugagccugacggcuaucgccaaccaggcuaccgugcugaugggccucgggaagggauggccccuuuccaaaauggauaucggcgucccucugcuggccauuggguguuauucucaggugaaucccaucacacucaccgcggcccugcuucugcucguugcucacuacgccauuaucggaccuggccugcaggcuaaggccacaagagaggcucaaaagcgggccgcggccggcauuaugaaaaacccgaccguggacgggaucacggucaucgaucuggaccccauuccuuaugaucccaaguucgaaaaacagcucggacaggugaugcuucugauccugugcgucacacaagugcucaugaugcgcaccacaugggcucugugugaggcccuuacccuggcuaccggcccuauuagcacacucugggaagggaaucccggaagauuuuggaacacgaccaucgccguuuccauggccaauauuuuccggggcagcuaccuggcgggggcuggacugcucuuuucuaucaugaagaacacaaccaauacacgcagaggcaccggcaacaugggggagacgcuuggagagaaauggaagucccggcugaacgcccugggcaaaagcgaguuccagaucuauaagaagucugggauucaggagguggaccgcacacucgcuaaagaaggaaucaagagaggcgagaccgaucaccaugccgucucccgggggagcgccaaacugcgcugguuuguggagagaaauaugguuaccccggaaggaaagguggucgaccuuggcugcggcagagggggauggucuuacuauuguggcgggcugaaaaacgugcgggaggugaagggacucacaaagggcgggccuggacacgaagaacccauucccaugagcaccuacggcuggaaucugguucgccugcaguccggcgucgauguguucuucaucccucccgaaaaaugcgacacacuccuuugugauauuggggagucuagcccuaacccgacgguggaggcuggacggacccugagaguccugaaucucguugaaaacuggcugaauaacaauacacaauuuugcaucaaggugcuuaaccccuacaugccuuccgugaucgagaaaauggaagcccugcagcgcaaguauggcggggcgcucguccggaauccccugagcagaaacuccacccaugagauguacugggugucuaaugccagcggaaacauuguuuccucugugaauaugaucagccgcaugcugauuaaccgguucacaaugagacacaaaaaggcuaccuaugaaccugacgucgaccucggcuccgggacgcgcaacaucggaauugagucugagauccccaaucuugauauuaucggcaagcggaucgagaagauuaagcaggagcaugaaaccagcuggcacuacgaccaggaucacccguauaaaacaugggccuaccauggcuccuaugagaccaagcaaacagggagcgcuucuuccauggugaacggaguugugagacugcugaccaaaccuugggacguccuccccacagugacccagauggccaugacggauacaaccccuuuuggccagcagcgcguguucaaggaaaaggucgacacccggacacaagagcccaaagaggggacgaagaaacugaugaagaucaccgcggaauggcuuuggaaagagcugggaaagaaaaagacaccuagaauguguacccgcgaagaguuuacaagaaagguucggagcaaugccgcucucggcgccauuuucaccgaugagaacaaauggaagucugcucgcgaagccguggaggacuccagauuuugggaacugguggauaaagagcggaaucugcaccucgaagggaagugcgagacaugugucuacaacaugaugggaaaaagagagaagaagcugggcgaguucggcaaagcuaaggggagccgggccaucugguacauguggcuuggagcgcgcuuucuggaguucgaagcccucggcuuucugaaugaggaccauugguucucuagagaaaacucccuuagcgggguggagggagagggccugcacaaacucggguauauucugcgggauguuuccaagaaagaaggcggagcuauguacgccgacgacaccgcuggcugggauacgcgcaucacccuggaggaccucaagaaugaagagauggugacaaaccacauggaaggggagcauaagaaacuggccgaggccaucuuuaaacuuaccuaucagaauaaagucgugagaguucagcggcccacaccgcgcggaaccgugauggauauuaucagcagacgggaccaacgcggcucugggcaggucggaacguacggccugaacacauucaccaauauggaagcgcagcucauuagacagauggagggggaaggcguguucaagaacauccaacaccugacaguuaccgaggagguggcuguccagaauuggcuugcccgggugggacgcgaaagacugagccggauggccauuuccggcgaugacugcgucgugaaaccucucgaugaccgcuuugcuaacgcccugacggcucugaacgauauggggaagaucagaaaggacauccagcagugggagcccucuaaaggauggaaugauuggacccaaguucccuucugcagccaucacuuucaugaacucauuaugaaggacggccgggugcuggucgugccuuguagaaaccaggaugagcuuaucgggcgcgcccggauuucccagggagcgggcuggucucugagagaaacagccugccucgggaaaagcuaugcucagauguggucccugauguacuuccaccgccgggaccuuagacuggccgcuaaugccaucuguucugcggugccgagccacuggguucccaccucccgcacaaccuggagcauucaugccaagcacgaguggaugacaaccgaggacaugcucacgguguggaaccgggucuggaucagagaaaauccuuggauggaggauaaaacacccguggaaucuugggaggaaauuccuuaucugggcaagcgcgaggaccaauggugcggaucccugaucggccucaccagccgggcuaccugggccaagaacauccaggcugccauuaaucagguuagaucucugaucgggauugaggaauacacagauuacaugcccuccaugaaacgcuuucggagagaggaagaggaagcuggagugcuuugguga

SEQ ID NO: 20065 - RNA, 9876 nt, Artificial Sequence
  derived and/or modified CDS sequence (opt5) from DENV-2__FJ562098__SS-prME
agcgcuggcaugaucauuaugcugauccccaccgucauggcuuuccaccugaccacgagaaauggggaaccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgcgacggagaaggauucuccggugaacauugaagccgagcccccuuuuggcgacuccuacaucauuaucgggguugagcccggccagcucaagcugaauugguucaaaaagggaagcucuauuggccaaauguuugaaaccacaaugagaggggcuaaaagaauggccauccuuggagauaccgccugggacuucggcagccucgggggaguguuuacauccaucggcaaggcucuccaucaggucuucggggccauuuauggcgcggcuuuuucuggagugagcuggaccaugaaaauccugauuggcgugaucauuacguggaucgggaugaacucccgcagcacaucucuguccguuagccuuguccucgugggaaucgugacccuguaccugggcgucauggugcaggccgauucuggguguguuguguccuggaagaauaaggagcucaaaugcggaagcggcauuuucaucaccgacaacguccacacauggaccgaacaguauaaguuucaaccugagucccccucuaaacuggccagcgcuauucagaaggcccaggaagaggggaucuguggcauucgguccgugacaagacuugagaaucugauguggaaacagaucacgccggaacucaaccacauccuggcugagaaugaaguuaagcugaccauuaugacaggagauaucaaaggcauuaugcaagccgggaagcgcucucuucggccucagcccaucgagcucaaguacagcuggaaaaccuggggaaaggcgaaaaugcuguccacagaaagccauaaccagaccuuccugauugacggcccugagacggccgagugccccaauaccaacagagcuuggaacucucucgaaguggaggauuauggguuuggagucuucacaaccaacaucuggcugcgccuuaaggaaaaacaggacgccuuuugugacuccaagcugaugagcgcugccaucaaggauaaucgggcggugcacgccgacaugggcuacuggauugagucugcucucaacgauacauggaaaaucgagaaggccuccuucauugaaguuaaaaauugccauuggccuaagagccacacccuguggucuaacggcgugcuggagagcgaaauggucauccccaaaaaccuugcugggccggugucccaacacaauuauagaccuggauaccauacacagauugccggccccuggcaccucgggaagcuggagauggacuucgauuuuugugacggaaccacggugaucgucacagaagauugcggcaaccgcgggcccagccugcggaccaccacagccucuggaaagcucauuaccgaguggugcuguagauccugcacgcugccuccgcuucgguaccgcggcgaggacggcuguugguaugggauggaaaucagaccccugaaagagaaggaagagaaucucguuaacagccuggugacagcuggacauggccagguggauaauuucucccuggggguccuuggaauggcgcucuuucuggaagagaugcugcggaccagagugggcacaaaacacgccauccuccugguugcugugucuuucgucacccuuauuacagggaacaugagcuuuaaggaccugggacgcgugguugugauggucggcgccaccauggccgaugacaucggcaugggggugacguaccucgcucugcuggccgcguucaaaguucggccuaccuuugcugccggacuucugcucagaaagcugacauccaaggagcucaugaugaccacaauuggcaucgugcugcuuucucaaagcaccauucccgaaacgguccuggagcucacagaugcccuggcucuggggaugauggugcuuaaaaucgugcgcaauauggaaaaguaucagcuggccgucaccaucauggcgauucucugcguuccuaacgcugugauccugcagaaugccuggaaaguguccuguacaauucucgccgucgugucuguuagcccccugcuucugaccuccagccagcaaaagaccgacuggaucccucucgcucugacaauuaaaggacugaaccccacggccaucuuccuuaccacacugucuagaaccaauaagaaacgguccuggccgcucaacgaggcuaucauggccgugggcauggucagcauucuggcgucuucccuccugaagaaugacaucccuaugacagggccccuuguggccggaggccugcugaccguuugcuacgugcucacgggccgcagcgcugaucuggaacuugagagagccacagacgucaagugggaggaucaggcugaaauuucuggguccagcccuauccuguccauuaccaucagcgaggacggaucuaugagcauuaaaaacgaagaggaggaacagacccucacaauccugauccggaccggccuccuggugauuuccgggcuuuuucccaucucuauuccgaucacagccgccgcuugguaucugugggaggucaagaaacagcgcgcgggagugcugugggauguuccuucucccccucccaugggcaaggccgaacucgaggacggggcuuacagaauuaaacaaaagggaauccugggcuauucccagaucggcgccgggguguacaaggaaggaacguuccauaccauguggcacgucacacggggcgccgugcuuaugcacaaagggaagcgcauugagcccuccugggcugauguuaaaaaggaccugaucagcuacggaggcggguggaaacucgagggagaauggaaggagggcgaagaggugcagguccuggcccucgaaccuggcaagaauccgagagcggugcagaccaaacccgggcuguuuaagacaaacaccggaacgauuggcgcugugucccuugauuucucuccugggaccagcggaucccccaucauugacaaaaagggcaaaguugucgggcuguauggaaacggcguggugacacggagcggcgccuacgucucugccaucgcucaaaccgagaaguccaucgaggauaauccugaaauugaggacgauaucuuucgcaagagacggcugacaauuauggaccuccaucccggggccggaaaaaccaagagauaucugccugcgaucgugcgcgaagcuauuaaacggggccuuagaacacugauccucgccccgacgcgcguuguggccgcugagauggaagaggcccugcgggggcuccccauuagauaccagaccccugcuauccgcgccgagcacacaggacgggaaaucgucgaccugaugugucaugcgaccuucaccaugagacuucugagccccgugcgcguuccuaacuauaaucugauuaucauggaugaggcccacuucacagaccccgcuucuauugccgcucggggcuacaucuccacgagaguggaaaugggggaggccgccggcauuuuuaugaccgcuacaccgccuggaagccgggaucccuucccccaguccaacgcgccuaucaucgacgaggaacgcgagauucccgaaagaucuuggaauagcggccaugagugggucaccgauuuuaaggggaaaacagugugguucguuccuuccaucaaggccggaaacgacauugcugccugccuccggaagaauggcaaaaaggugauccaacugagccgcaaaaccuuugauucugaauaugucaagacgagaacaaacgacugggauuucguggugaccaccgacauuuccgagaugggggccaauuuuaaagcugagcgggucaucgauccgagacgcuguaugaagcccguuauccuuacagacggagaggaacgggugauucuggccggcccuaugcccgugacccacagcucugcggcucagagacgcgggcggaucggcagaaacccuaaaaaugaaaacgaccaguacauuuacaugggagagccccucgaaaaugaugaggacugcgcccacuggaaggaggccaagaugcugcuggauaacaucaauacaccggaaggcauuaucccuagcauguucgagcccgaacgcgagaaagucgacgcuauugauggggaauaucggcucagaggagaggcccgcaagaccuuuguggaccuuaugagacggggcgaucugccuguuuggcuggcguacaaaguggccgcugaggggaucaacuaugccgaccgcagaugguguuucgauggaaucaagaacaaucagauucucgaagagaacgucgaaguggagaucuggacgaaagagggcgaacggaagaagcugaaaccccgcuggcuugacgcuagaauuuacuccgauccucuggcccucaaggaguuuaaagaguucgcugccgggcggaagucucugacacugaaucucaucaccgagaugggcagacuucccacauucaugacccagaagacgcgcgacgcgcuggauaaccuggccguucuccauaccgcugaagccggaggccgggcuuauaaucacgcccugagcgagcuuccggagacacuggaaacccuccugcugcucacacuucuggccaccgugacagggggaauuuuucuguuccucauguccggcagagggaucggaaagaugacccugggcaugugcugcaucauuacggcuucuauccuucugugguacgcgcagauucagccucauuggaucgccgcuagcauuauccucgaguuuuuccugaucguccugcucauucccgaacccgagaagcagcgcacaccucaagacaaccagcuuaccuauguggucaucgccauucugaccgugguugccgcuacaauggccaaugaaaugggcuuucuggagaaaaccaagaaagaccucgggcugggauccaucgcgacacagcagccggagagcaacauucuugauaucgaccugcggcccgccucugcuuggacgcucuacgccguggcuaccacauucgugaccccuaugcugagacacuccauugaaaauagcuccgucaacguuucucugacagccaucgcgaaucaagccaccgugcucaugggccuugggaagggauggccccugagcaaaauggauaucggcgugccucugcucgcuauuggguguuacucccaggucaaccccaucacgcugaccgccgcccuucugcuccugguggcccacuaugcuauuaucggaccuggccugcaggccaaggcgacacgggaggcccagaagcgcgcugccgcuggcauuaugaaaaauccgaccguugacgggaucacagugaucgaucucgaccccauuccuuacgaucccaaguuugaaaaacaacuuggacaggucaugcugcugauccucugcgugacccagguccugaugaugagaacgacaugggcccuuugugaggcccugacccucgcgacaggcccuauuucuacccugugggaagggaaccccggacgguucuggaauaccacaaucgcugugagcauggccaacauuuuucgcggcuccuaucuggcuggggccggacuccuuuucagcaucaugaagaauacgaccaacacaagacggggcaccggcaacaugggggagacacugggagagaaauggaagucucgccugaaugcccucggcaaauccgaauuucaaaucuacaaaaagagcgggauucaggagguugacagaacccuggcuaaagaaggaaucaagcggggcgagacggaucaucacgccgugucucgcggguccgcgaaacuuagaugguucgucgagcggaacauggugacaccggaaggaaagguuguggaccugggcugcggcagagggggauggagcuauuacuguggcgggcucaaaaauguccgcgaggugaagggacugaccaagggcgggccuggacaugaagaacccauucccaugucuaccuauggcuggaaccuggugcggcuccagagcggcguugaugucuuuuucaucccucccgaaaaaugcgacacacuucugugugauauuggggaguccucuccuaauccgaccguggaggccggaagaacacugcgcgugcucaaccuggucgaaaauuggcuuaacaauaacacgcaguucugcaucaagguucugaaucccuacaugccuagcgugaucgagaaaauggaagcucuccaacggaaguacggcggggcccuggugagaaacccccugucccgcaauagcacccacgagauguauugggucuccaacgcuucuggaaauauugugagcuccguuaacaugaucucucggaugcucauuaacagauuuacaaugcgccauaaaaaggccaccuacgaaccugacguggaccuuggcagcgggacacggaauaucggaauugaguccgagauccccaaccuggauauuaucggcaagagaaucgagaagauuaagcaggagcacgaaaccucuuggcacuaugaccaggaucauccguacaaaacgugggcguaucacggcagcuacgagaccaagcagacaggguccgccagcucuauggucaauggagugguucgccugcucaccaaaccuugggacgugcugcccacagucacccaaauggcuaugacagauaccacgccuuucggccagcagcggguguuuaaggaaaagguggacacaagaacccaggagcccaaagaggggaccaagaaacuuaugaagaucacagccgaauggcuguggaaagagcucggaaagaaaaagacgccucgcauguguaccagagaagaguucacacggaagguccgcuccaacgcugcccugggcgcuauuuuuaccgaugagaauaaauggaaaagcgccagagaagcgguugaggacucucgguucugggaacugguggauaaagagagaaaccuccaucuggaagggaagugcgagacauguguguauaauaugaugggaaaacgggagaagaaacuuggcgaauuuggcaaagccaaggggucccgcgcuaucugguacauguggcugggagccagauuccucgaguuugaagcucugggcuuccuuaacgaggaccacugguuuagccgggaaaauucucuguccggggucgagggagagggccuccacaaacugggguacauucugcgcgaugugagcaagaaagaaggcggagccauguaugccgacgacaccgcgggcugggauacaagaaucacccucgaggaccugaagaacgaagagaugguuacgaaucauauggaaggggagcacaagaaacuugcugaggccaucuucaagcugaccuaccaaaacaaagugguccgggugcagcgccccacaccgagaggaaccguuauggauauuaucucccggcgcgaccagagaggcagcgggcaagugggaacauauggccucaauaccuuuacgaacauggaagcccagcugauucggcagauggagggggaaggcgucuucaagaauauccagcaucuuacagugaccgaggagguugcugugcaaaacuggcuggcccgcgucggaagagaacggcucucucgcauggcuauuagcggcgaugacugcguggucaaaccucuggaugacagauucgccaacgcgcugacagcccucaaugauauggggaagauccggaaggacauccagcagugggagcccuccaaaggauggaacgauuggacccaggugcccuuuugcucucaccauuuccacgaacugauuaugaaggacggcagaguucuuguggucccuugucgcaaucaagaugagcugaucgggcgggcuagaauuagccagggagccggcuggucccuccgcgaaacggcuugccuggggaaaucuuacgcccagauguggagccuuauguauuuucaccggagagaccugcgccucgcggccaacgcuaucuguuccgccgugccgucucauugggugcccaccagccggacaaccugguccauucacgcuaagcaugaguggaugacaaccgaggacaugcugacaguuuggaauagaguguggauccgcgaaaacccuuggauggaggauaaaacccccgucgaaagcugggaggaaauuccuuaccugggcaagcgggaggaccaguggugcggaucucucaucggccugacguccagagccacaugggcuaagaauauccaagccgcgauuaaccaggugcgcagccuuaucgggaaugaggaauauaccgauuacaugcccucuaugaaacgguucagacgggaggaagaggaagccggaguucugugguga

SEQ ID NO: 20066 - RNA, 9876 nt, Artificial Sequence
  derived and/or modified CDS sequence (opt5) from DENV-2__FJ859028__SS-prME
agcgccggaaugaucauuaugcugauccccaccgucauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaagaauaaccgcgccguucaugcggauaugggcuauuggaucgagucugcccucaaugacaccuggaaaauugagaaggcuuccuucaucgaagugaaaaacugccacuggccuaagagccauacacuguggucuaacggcguccuggagagcgaaaugauuauccccaaaaaucuugccgggccggugucccagcacaacuaccggccuggauaccacacccagauugcuggccccuggcaucucgggaagcuggagauggauuucgacuuuugugauggaacgacaguggucguuaccgaagacugcggcaauagagggcccagccugcgcaccacaaccgccucuggaaagcucaucacggaguggugcugucgguccugcacacugccuccgcuuagauaucggggcgaggauggcuguugguacgggauggaaauucgcccccugaaagagaaggaagagaaccucgugaauagccuggugaccgccggacacggccaagucgacaacuucucccugggggugcuuggaauggcucucuuucuggaagagaugcugagaacacggguuggcaccaaacaugcgauccuccugguggccgucucuuucgugacacuuaucaccgggaauaugagcuuuaaggaucugggaagaguuguggucauggugggcgcuacgauggccgacgauauuggcauggggguuaccuaucucgcccugcuggcugccuucaaagugcgcccuacauuugcggcuggacuucugcuccggaagcugaccuccaaggagcucaugaugacaaccaucggcauuguccugcuuucucagagcacgauccccgaaacagugcuggagcucaccgacgcccuggcccuggggaugauggugcuuaaaauugucagaaacauggaaaaguaccagcuggcuguuacaaucauggccauccucugcgugccuaaugcggugauucugcagaacgcuuggaaagucuccuguaccauccucgccgugguuucugugagcccccugcuucugaccuccagccaacagaagacagauuggauuccucucgcccugacgaucaaaggacugaaucccaccgcuauuuuccuuacaacccugucucgcacaaacaagaaaagauccuggccgcucaaugaggccaucauggcugucggcauggugagcauccuggccucuucccuccugaagaacgacauuccuaugaccgggccccuuguugcgggaggccugcugacggugugcuauguccucacaggccggagcgccgaccuggaacuugagcgcgcuaccgaugugaagugggaggaccaggccgaaaucucuggguccagcccuauucuguccaucaccauuagcgaggauggaucuaugagcaucaaaaaugaagaggaggaacagacacucaccauucugaucagaacaggccuccuggucaucuccgggcuuuuucccauuucuaucccgauuacggcugccgccugguaccugugggaggugaagaaacaacgggcuggaguucugugggacgugccuucucccccucccaugggcaaggcggaacucgaggauggggccuaucgcaucaaacagaagggcauucugggcuacucccagaucggcgcuggggucuacaaggaaggaaccuuccacacaauguggcaugugaccagaggcgccguucuuaugcacaaagggaagcggaucgagcccuccugggccgacgugaaaaaggaucugauuagcuauggaggcggguggaaacucgagggagaauggaaggagggcgaagagguccaggugcuggcucucgaaccuggcaagaacccgcgcgccgugcaaacaaaacccgggcuguuuaagaccaacacgggaaccaucggcgcgguuucccuugacuucucuccugggacaagcggaucccccauuaucgauaaaaagggcaaagucguggggcuguacggaaauggcguggucaccagaagcggcgcuuaugugucugccauugcccagacagagaaguccaucgaggacaacccugaaaucgaggaugacauuuuucggaagcgcagacugaccaucauggaucuccaccccggggcuggaaaaacaaagcgguaccugccugccauuguuagagaagcgaucaaacgcggccuucggacgcugauucucgcuccgaccagaguggucgccgccgagauggaagaggcucugcgcgggcuccccauccgguaucagaccccugccauuagagcugagcauaccggacgcgaaaucguggaccugaugugucacgccaccuucacaaugcggcuucugagccccguuagagugccuaauuacaaccugaucauuauggacgaggcgcauuucacggaucccgccucuaucgcugcccgcggcuauauuuccacccgggucgaaaugggggaggcugccggcaucuuuaugacagccaccccgccuggaagcagagaccccuucccccaauccaaugcuccuauuaucgaugaggaacgggagauccccgaacgcucuuggaacagcggccacgagugggugacagacuuuaaggggaaaaccguuugguucgugccuuccauuaaggcgggaaaugauaucgccgcuugccucagaaagaacggcaaaaaggucauucagcugagccggaaaacguuugacucugaauacgugaagacacgcaccaaugauugggacuucguggucaccacagauaucuccgagaugggggccaacuuuaaagccgagagaguuauugacccgcggagauguaugaagcccgugauccuuaccgauggagaggaacgcgugauccuggcuggcccuaugcccgucacacauagcucugccgcgcagcggagagggcgcauuggccggaauccuaaaaacgaaaaugaccaguacaucuauaugggagagccccucgaaaacgacgaggauugcgcucacuggaaggaggccaagaugcugcuggacaauauuaacaccccggaaggcaucauuccuagcauguucgagcccgaaagagagaaaguggaugccaucgacggggaauaccgccuccggggagaggcuagaaagacguuuguugaucuuaugcgcagaggcgaccugccuguguggcuggccuauaaagucgcggccgaggggauuaacuacgcugaucggcgcugguguuucgacggaaucaagaauaaccaaauccucgaagagaauguggaaguugagauuuggacaaaagagggcgaaagaaagaagcugaaaccccgguggcuugaugcccgcaucuauuccgacccucuggcucucaaggaguuuaaagaguucgccgcugggagaaagucucugacccugaaccucauuacagagaugggccggcuucccaccuucaugacgcagaaaaccagagaugcccuggacaaucuggcggugcuccacacagccgaagcuggaggccgcgccuacaaccaugcucugagcgagcuuccggagacccuggaaacacuccugcugcucacccuucuggccacagucaccgggggaaucuuucuguuccucauguccggccgggggauuggaaagaugacgcugggcaugugcugcaucaucacagccucuauucuucugugguaugcucagauccagccucacuggauugcggccagcaucauucucgaguuuuuccugaucgugcugcucauccccgaacccgagaagcaaagaaccccucaggauaaucagcuuaccuacgucgugauugcuauccugacaguuguggccgccaccauggcuaacgaaaugggcuuucuggagaaaacaaagaaagaccucgggcugggauccauugccacgcagcaaccggagagcaauauccuugacauugaucugcgccccgcgucugccuggacccucuacgcuguggccacaaccuucgucacaccuaugcugcggcauuccaucgaaaacagcuccguuaaugugucucugaccgcuauugccaaccaggcgacggugcucaugggccuugggaagggauggccccugagcaaaauggacaucggcgucccucugcucgccaucggguguuauucccaggugaaucccauuacccugacagcugcccuucugcuccugguugcucacuacgccaucauuggaccuggccugcaggcuaaggccaccagagaggcgcaaaagcgggccgcugccggcaucaugaaaaacccgacaguggaugggauuaccgucaucgaccucgaucccaucccuuaugaccccaaguuugaaaaacagcuuggacaggugaugcugcugauucucugcgucacgcaagugcugaugaugcgcacaaccugggcucuuugugaggcccugacacucgccaccggcccuaucucuacccugugggaagggaaucccggaagauucuggaacacaacgauugcgguuagcauggcuaauaucuuucggggcuccuaccuggccggggcuggacuccuuuucagcauuaugaagaacaccacaaacacccgcagaggcacaggcaauaugggggagacccugggagagaaauggaagucucggcugaacgcccucggcaaauccgaauuucagaucuauaaaaagagcgggauccaggagguggaucgcacgcuggccaaagaaggaauuaagagaggcgagacagaccaccaugcugucucucggggguccgccaaacuucgcugguucguggagagaaauaugguuaccccggaaggaaagguggucgaucugggcugcggcagagggggauggagcuacuauuguggcgggcucaaaaacgugcgggaggugaagggacugaccaagggcgggccuggacacgaagaacccauccccaugucuacauacggcuggaaucugguucgccuccagagcggcgucgacguguuuuucauuccucccgaaaaaugcgauacccuucugugugacaucggggaguccucuccuaacccgacaguggaggcgggacggacgcugagaguccucaaucugguugaaaacuggcuuaauaacaauacccaauucugcauuaaggugcugaaccccuacaugccuagcgugaucgagaaaauggaagcccuccagcgcaaguauggcggggcucugguccggaauccccuguccagaaacagcacacaugagauguacuggguguccaaugccucuggaaacaucguuagcuccgugaacaugauuucucgcaugcucaucaaucgguuuaccaugagacacaaaaaggcuacauaugaaccugaugucgaccuuggcagcgggacccgcaacauuggaaucgaguccgagauucccaaucuggacaucauuggcaagcggaucgagaagaucaagcaggagcaugaaacgucuuggcacuacgaucaggaccacccguauaaaaccugggccuaccauggcagcuaugagacaaagcaaaccggguccgcgagcucuauggugaacggaguugugagacugcucacaaaaccuugggauguccugcccaccgugacacagauggccaugaccgacacgacaccuuucggccagcagcgcguguuuaaggaaaaggucgauacccggacccaagagcccaaagaggggacaaagaaacuuaugaagauuacggcugaauggcuguggaaagagcucggaaagaaaaagaccccuagaauguguacacgcgaagaguucaccagaaagguucgguccaaugccgcucugggcgccaucuuuacagacgagaacaaauggaaaagcgcucgcgaagccguggaggauucuagauucugggaacugguggacaaagagcggaaucuccaccuggaagggaagugcgagaccugugucuacaacaugaugggaaaaagagagaagaaacuuggcgaauuuggcaaagcgaaggggucccgggccauuugguacauguggcugggagcucgcuuccucgaguuugaagcccugggcuuccuuaaugaggaucauugguuuagcagagaaaacucucuguccgggguggagggagagggccuccacaaacugggguauauccugcgggacguuagcaagaaagaaggcggagcuauguacgccgaugacacagccggcugggacacccgcauuacgcucgaggaucugaagaaugaagagauggugaccaaccacauggaaggggagcauaagaaacuugcggaggcuaucuucaagcugacauaucagaauaaagucgugagaguucagcggcccaccccgcgcggaacagugauggacaucauuuccagacgggaucaacgcggcagcgggcaggucggaaccuacggccucaacacguuuacaaauauggaagcccagcugaucagacagauggagggggaaggcguguucaagaacauucaacaccuuaccguuacagaggagguggccguccagaacuggcuggcucgggugggacgcgaaagacucucucggauggccaucagcggcgacgauugcgucgugaaaccucuggacgaucgcuucgcuaaugcccugaccgcgcucaacgacauggggaagauuagaaaggauauccagcagugggagcccuccaaaggauggaaugacuggacgcaaguucccuuuugcucucaucacuuccaugaacugaucaugaaggauggccgggugcuugucgugccuuguagaaaccaggacgagcugauugggcgcgcccggaucagccagggagcuggcuggucccucagagaaaccgccugccuggggaaaucuuaugcucagauguggagccuuauguacuuucaccgccgggaucugagacucgccgcgaaugccauuuguuccgcugugccgucucacuggguucccacaagccgcaccacaugguccauccaugccaagcacgaguggaugaccacagaggacaugcugaccguguggaaccgggucuggauuagagaaaauccuuggauggaggacaaaacgcccguggaaagcugggaggaaaucccuuaucugggcaagcgcgaggaucaauggugcggaucucucauuggccugacaucccgggcuaccugggccaagaacauccagguugcuaucaaucaggugagaagccuuauugggaacgaggaauacaccgacuacaugcccucuaugaaacgcuuccggagagaggaagaggaagccggaguccugugguga

SEQ ID NO: 20067 - RNA, 9876 nt, Artificial Sequence
  derived and/or modified CDS sequence (opt5) from DENV-2__FJ410200__SS-prME
agcgccggcaugaucauuaugcugauccccaccgucauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucaacuuuugugauggaacgacagugaucgucaccgaagacugcggcaauagagggcccagccugcgcaccacaaccgccucuggaaagcucauuacggaguggugcugucgguccugcacacugccuccgcuuagauaucggggcgaggauggcuguugguacgggauggaaauccgcccccugaaagagaaggaagagaaccucguuaauagccuggugaccgccggacacggccaaguggacaacuucucccuggggguccuuggaauggcucucuuucuggaagagaugcugagaacacgggugggcaccaaacaugcgauccuccugguugccgugucuuucgucacacuuauuaccgggaauaugagcuuuaaggaucugggaagagugguugugauggucggcgcuacgaugaccgacgauaucggcaugggggugacauaucucgcccugcuggccgcuuucaaaguucgcccuaccuuugccgcgggacuucugcuccggaagcugacauccaaggagcucaugaugaccacgauuggcaucgugcugcuuucucagagcacaauucccgaaaccguccuggagcucacagacgcucuggcccuggggaugauggugcuuaaaaucgugagaaacauggaaaaguaccagcuggccgucaccaucauggcuauucucugcguuccuaaugccgugauccugcagaacgcguggaaaguguccuguaccauucucgcugucgugucuguuagcccccugcuucugacauccagccaacagaagacggauuggaucccucucgcccugaccauuaaaggacugaaucccacagccaucuuccuuaccacacugucucgcaccaacaagaaaagauccuggccgcucaaugaggcuaucauggccgugggcauggucagcauucuggcuucuucccuccugaagaacgacaucccuaugacggggccccuuguggccggaggccugcugacaguuugcuaugugcucaccggccggagcgcggaccuggaacuugagcgcgccaccgaugucaagugggaggaccaggcugaaauuucuggguccagcccuauccuguccauuacaaucagcgaggauggaucuaugagcauuaaaaaugaagaggaggaacagacccucacaauccugaucagaacgggccuccuggugauuuccgggcuuuuucccaucucuauuccgaucaccgccgcugccugguaccugugggaggucaagaaacaacgggccggagugcugugggacguuccuucucccccucccaugggcaaggcugaacucgaggauggggcguaucgcauuaaacagaagggaauccugggcuacucccagaucggcgccgggguguacaaggaaggaacauuccacaccauguggcaugucacaagaggcgcugugcuuaugcacaaagggaagcggauugagcccuccugggccgacguuaaaaaggaucugaucagcuauggaggcggguggaaacucgagggagaauggaaggagggcgaagaggugcagguccuggcccucgaaccuggcaagaacccgcgcgcugugcaaaccaaacccgggcuguuuaagacgaacaccggaacaauuggcgccgugucccuugacuucucuccugggaccagcggaucccccaucauugauaaaaagggcaaaguugucgggcuguacggaaauggcguggugacaagaagcggcgcguaugucucugcuaucgcccagaccgagaaguccaucgagaacaauccugaaauugaggacgauaucuuucggaagcgcagacugacaauuauggaccuccaccccggggccggaaaaacgaagcgguaccugccugcuaucgugagagaagccauuaaacgcggccuucggacccugauccucgcgccgacaagaguuguggcugccgagauggaagaggcccugcgcgggcuccccauucgguaucagaccccugcuaucagagccgagcauaccggacgcgaaaucgucgaucugaugugucacgcuacauucacgaugcggcuucugagccccgugagaguuccuaacuacaaucugauuaucauggacgaggcccauuucaccgaccccgcgucuauugccgcucgcggcuauaucuccacacggguggaaaugggggaggccgcuggcauuuuuaugaccgccacaccgccuggaagcagagaucccuucccccaauccaacgccccuaucaucgacgaggaacgggagauucccgaacgcucuuggaauagcggccacgagugggucaccgauuuuaaggggaaaacggugugguucguuccuuccaucaaggcuggaaacgacauugcggccugccucagaaagaauggcaaaaaggugauccagcugagccggaaaacauuugauucugaauacgucaagacccgcaccaacgacugggauuucguggugacaaccgacauuuccgagaugggggcuaauuuuaaagccgagagagucaucgauccgcggagauguaugaagcccguuauccuuacagacggagaggaacgcgugauucuggccggcccuaugcccgugacccauagcucugcugcccagcggagagggcgcaucggccggaacccuaaaaaugaaaacgaucaguacauuuauaugggagagccccucgaaaaugacgaggacugcgcgcacuggaaggaggcuaagaugcugcuggauaacaucaacacgccggaaggcauuaucccuagcauguucgagcccgaaagagagaaagucgacgccauugauggggaauaccgccuccggggagaggccagaaagacauuuguggaccuuaugcgcagaggcgaucugccuguuuggcuggcuuauaaaguggccgcggaggggaucaauuacgccgaccggcgcugguguuucgauggaaucaagaacaaucaaauucucgaagagaacauggaagucgagaucuggaccaaagagggcgaaagaaagaagcugaaaccccgguggcuugacgcucgcauuuauuccgauccucuggcccucaaggaguuuaaagaguucgcugccgggagaaagucucugacacugaaucucaucaccgagaugggccggcuucccacguucaugacccagaaaacaagagacgcucuggauaaccuggccgugcuccacaccgcggaagccggaggccgcgcuuacaaucaugcccugagcgagcuuccggagacacuggaaacccuccugcugcucacacuucuggcuaccguuacagggggaauuuuucuguuccucauguccggccgggggaucggaaagaugacacugggcaugugcugcaucauuaccgccucuauccuucugugguaugcccagauucagccucacuggaucgcugcgagcauuauccucgaguuuuuccugaucgugcugcucauucccgaacccgagaagcaaagaaccccucaggacaaccagcuuacauacgucgugaucgccauucugaccgucguggcugccacaauggccaaugaaaugggcuuucuggagaaaacgaagaaagaucucgggcugggauccaucgcuacccgccagccggagagcaacauucuugacaucgaccugcggcccgccucugcguggacacucuacgccguugcuaccacauucgugaccccuaugcugagacauuccauugaaaauagcuccgugaacgucucucugacggccaucgcuaaucaagccaccguucucaugggccuugggaagggauggccccugagcaaaauggauaucggcgugccucugcucgcgauuggguguuauucccaggugaaccccaucacacugaccgccgcccuucugcuccuggucgcccacuacgcuauuaucggaccuggccugcaggccaaggcuacacgggaggcccagaagcgcgcggccgcuggcauuaugaaaaauccgaccguggacgggaucacgguuaucgaucucgaccccauuccuuaugaucccaaguuugaaaaacaacuuggacaggugaugcugcugguccucugcgugacacagguccugaugaugagaaccacaugggcccuuugugaggcucugacccucgccaccggcccuaucucuacacugugggaagggaaccccggacgguucuggaauacgaccauugccgugagcauggcgaacaucuuucgcggcuccuaccuggcuggggccggacuccuuuucagcauuaugaagaacacaaccaauacaagacggggcaccggcaacaugggggagacgcugggagagaaauggaagucucgccugaaugcucucggcaaauccgaauuucaaaucuauaaaaagagcgggauccaggagguugacagaacacuggccaaagaaggaauuaagcggggcgagaccgaucaccaugccgugucucgcggguccgcuaaacuuagaugguucgucgagcggaacauggugaccccggaaggaaagguuguggaccugggcugcggcagagggggauggagcuacuauuguggcgggcucaaaaauguccgcgaggugaagggacugacaaagggcgggccuggacacgaagaacccauccccaugucuaccuacggcuggaaccuggugcggcuccagagcggcguugaugucuuuuucauuccucccgaaaaaugcgacacacuucugugugauaucggggaguccucuccuaauccgacgguggaggccggaagaacccugcgcgugcucaaccuggucgaaaauuggcuuaacaauaacacacaguucugcauuaagguucugaaucccuacaugccuagcgugaucgagaaaauggaagcgcuccaacggaaguauggcggggcccuggugagaaacccccugucccgcaauagcacccaugagauguacugggucuccaacgcuucuggaaacaucgugagcuccguuaauaugauuucucggaugcucaucaacagauuuacaaugcgccacaaaaaggccaccuaugaaccugacguggaucuuggcagcgggacgcggaauauuggaaucgaguccgagauucccaaccuggacaucauuggcaagagaaucgagaagaucaagcaggagcaugaaaccucuuggcacuacgaccaggaucacccguauaaaacaugggcuuaccauggcagcuaugagaccaagcagacaggguccgccagcucuauggucaauggagugguucgccugcucaccaaaccuugggacgugcugcccacagucacccaaauggcgaugacggauacaaccccuuucggccagcagcggguguuuaaggaaaagguggacaccagaacacaggagcccaaagaggggacgaagaaacuuaugaagauuaccgccgaauggcuguggaaagagcucggaaagaaaaagacaccucgcagauguacccgggaagaguucacacgcaaggucagauccaacgcugcccugggcgcuaucuuuaccgaugagaauaaauggaaaagcgcccgggaagcuguugaggacucuagauucugggaacugguggauaaagagcggaaccuccaccuggaagggaagugcgagacauguguguacaauaugaugggaaaacgcgagaagaaacuuggcgaauuuggcaaagccaagggguccagagcgauuugguacauguggcugggagcccgguuccucgaguuugaagcucugggcuuccuuaacgaggaccauugguuuagccgcgaaaauucucuguccggggucgagggagagggccuccacaaacugggguauauccugagagaugugagcaagaaagaaggcggagccauguacgcugacgauaccgccggcugggacacgcggauuacccucgaggaccugaagaacgaagagaugguuacaaaucacauggaaggggagcauaagaaacuugccgaggcgaucuucaagcugaccuaucaaaacaaagugguccgcgugcagagacccacaccgcggggaaccguuauggauaucauuucccgcagagaccagcggggcagcgggcaagugggaacguacggccucaauacauuuaccaacauggaagcucagcugauccgccagauggagggggaaggcgucuucaagaacauucagcaccuuacagugaccgaggagguugccgugaaaaauuggcuggccagagucggacgggaacgccucucuagaauggcuaucagcggcgaugacugcguggucaagccucuggaugaccgguucgccaacgcucugacggcccucaaugauauggggaagauuagaaaagacauccaacagugggagcccuccaagggauggaacgauuggacccaggugcccuuuugcucucaucacuuccaugaacugaucaugaaagacggccgcguucuuguggucccuugucggaaucaggaugagcugauugggagagcgcgcaucagccaaggagccggcuggucccuccgggaaacagcuugccuggggaagucuuaugcccagauguggagccuuauguacuuucacagacgcgaccugcggcucgcugccaacgcgauuuguuccgccgugccgucucacugggugcccaccagcagaacaaccugguccauccaugcuaaacacgaguggaugacaaccgaggauaugcugacgguuuggaaucgcguguggauucgggaaaacccuuggauggaggacaagacacccgucgaaagcugggaggaaaucccuuaucugggcaagagagaggaccaguggugcggaucucucauuggccugaccucccgcgccaccugggcuaaaaauauccaggccgcuaucaaccaagugcggagccuuauugggaaugaggaauacacagauuacaugcccucuaugaagagauuccggagagaggaagaggaagccggaguucugugguga

SEQ ID NO: 20068 - RNA, 9876 nt, Artificial Sequence
  derived and/or modified CDS sequence (opt5) from DENV-2__FJ410202__SS-prME
agcgccggcaugaucauuaugcugauccccacagugauggcuuuccaccugacgacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccgugggcaaggcccuccaucagguguucggggcuaucuauggcgccgcguuuucuggaguuagcuggaccaugaaaauucugaucggcgucauuaucacguggauugggaugaacucccgcagcacaucucuguccgugagccuugugcucgucggaaucgugacccuguaccugggcguuauggugcaggcugauucugggugugucguguccuggaagaauaaggagcucaaaugcggaagcggcaucuucauuaccgacaacguucacacauggaccgaacaguauaaguuucaaccugagucccccucuaaacuggccagcgccauccagaaggcucaggaagaggggauuuguggcauccgguccgugacaagacuugagaaucugauguggaaacagauuacgccggaacucaaccacauccuggccgagaaugaagucaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggaguuuucaccacaaacaucuggcugaaacuuaaagaaaagcaggacgcuuuuugugacuccaagcugaugagcgccgcuauuaaagauaaucgcgccgugcaugcggacaugggcuauuggaucgagucugcccucaacgauaccuggaagaucgagaaggcuagcuucauugaagucaagaauugccacuggccuaaaagccauacacuguggucuaacggcgugcuggagagcgaaaugaucauucccaagaaccuugccgggccggugucccaacacaauuaccggccuggauaccacacccagaucgcuggccccuggcaucucgggaagcuggagauggacuucgauuuuugugacggaacgacagucauuguuaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauucgcccccugaaggagaaagaagagaaucucgugaacagccuggugaccgccggacacggccaggucgauaauuucucccugggggugcuuggaauggcucucuuucuggaagagaugcugagaacacggguuggcaccaagcaugcgauccuccugguggccgucucuuucgugacacuuaucaccgggaacaugagcuuuaaagaccugggaagaguuguggucauggugggcgcuacgauggccgaugacauuggcauggggguuaccuaucucgcccugcuggcugccuucaaggugcgcccuacauuugcggcuggacuucugcuccggaagcugaccuccaaagagcucaugaugacaaccaucggcauuguccugcuuucucaaagcacgauccccgaaacagugcuggagcucaccgaugcccuggcccuggggaugauggugcuuaagauugucagaaauauggaaaaauaccagcuggcuguuacaaucauggccauccucugcgugccuaacgcggugauucugcagaaugcuuggaaggucuccuguaccauccucgccgugguuucugugagcccccugcuucugaccuccagccagcagaagaccgacuggauuccucucgcccugacgaucaagggacugaaccccaccgcuauuuuccuuacaacccugucucgcacaaauaaaaagagauccuggccgcucaacgaggccaucauggcugucggcauggugagcauccuggccucuucccuccugaagaaugacauuccuaugaccgggccccuuguugcgggaggccugcugacggugugcuauguccucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauucugaucagaacaggccuccuggucaucuccgggcuuuuucccauuucuaucccgauuacggcugccgccugguaccugugggaggugaaaaagcagcgggcuggaguucugugggaugugccuucucccccucccaugggcaaagcggaacucgaggacggggccuaucgcaucaagcaaaagggcauucugggauacucccagaucggcgcuggggucuacaaagaaggaaccuuccacacaauguggcaugugaccagaggcgccguucuuaugcacaaggggaaacggaucgagcccuccugggccgaugugaagaaagaccugauuagcuauggaggcggguggaagcucgagggagaauggaaggagggcgaagagguccaggugcuggcucucgaaccuggcaaaaauccgcgcgccgugcagacaaagcccgggcuguuuaaaaccaacacgggaaccaucggcgcgguuucccuugauuucucuccugggacaagcggaucccccauuaucgacaagaaaggcaaggucguggggcuguacggaaacggcguggucaccagaagcggcgcuuaugugucugccauugcccaaacagagaaguccaucgaggauaauccugaaaucgaggacgauauuuuucggaaacgcagacugaccaucauggaccuccaccccggggcuggaaagacaaaacgguaccugccugccauuguuagagaagcgaucaagcgcggccuucggacgcugauucucgcuccgaccagaguggucgccgccgagauggaagaggcucugcgcgggcuccccauccgguaucagaccccugccauuagagcugagcauaccggacgcgaaaucguggaccugaugugucacgccaccuucacaaugcggcuucugagccccguuagagugccuaacuacaaucugaucauuauggaugaggcgcauuucacggaccccgccucuaucgcugcccgcggcuauauuuccacccgggucgaaaugggggaggcugccggcaucuuuaugacagccaccccgccuggaagcagagaucccuucccccaguccaacgcuccuauuaucgacgaggaacgggagauccccgaacgcucuuggaauagcggccacgagugggugacagauuuuaaagggaagaccguuugguucgugccuuccauuaaggcgggaaacgacaucgccgcuugccuccgcaaaaauggcaagaaagucauucaacugagccggaagacguuugauucugaauacgugaaaacacgcaccaacgacugggauuucguggucaccacagacaucuccgagaugggggccaauuuuaaggccgagagaguuauugauccgcggagauguaugaaacccgugauccuuaccgacggagaggaacgcgugauccuggcuggcccuaugcccgucacacauagcucugccgcgcagcggagagggcgcauuggccggaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaaagagagaagguggacgccaucgauggggaauaccgccuccggggagaggcuagaaaaacguuuguugaccuuaugcgcagaggcgaucugccuguguggcuggccuauaaggucgcggccgaggggauuaacuacgcugaccggcgcugguguuucgauggaaucaaaaacaaucagauccucgaagagaacguggaaguugagguguggacaaaggagggcgaaagaaagaaacugaagccccgguggcuugacgcccgcauuuauuccgauccucuggcucucaaagaguuuaaggaguucgccgcugggagaaaaucucugacccugaaucucaucacagagaugggccggcuucccaccuucaugacgcaaaagaccagagacgcccuggauaaccuggcgguccuccacacagccgaagugggaggccgcgcuuacaaucaugcccugagcgagcuuccggagacccuggaaacacuccugcugcucacccuucuggcuacagucaccgggggaauuuuucuguuccucauguccggccgggggaucggaaagaugacgcugggcaugugcugcauuaucacagccucuauccuucugugguaugcccagauucagccucacuggaucgcugcgagcauuauccucgaguuuuuccugauugugcugcucauccccgaacccgagaaacagagaaccccucaagacaaccagcuuaccuacguugugaucgccauucugacaguggucgcugccaccauggccaaugaaaugggcuuucuggagaagaccaagaaggaccucgggcugggauccaucgcuacgcagcagccggagagcaacauucuugauaucgaccugcgccccgccucugcguggacccucuacgccguugcuacaaccuucgugacaccuaugcugcggcauuccauugaaaauagcuccgugaacgucucucugaccgccaucgcuaaucaagccacggugcucaugggccuugggaaaggauggccccugagcaagauggauauuggcguuccucugcucgcgaucggguguuauucccaggugaaccccaucacccugacagccgcccuucugcuccuggucgcccacuacgcuauuaucggaccuggccugcaggccaaggcuaccagagaggcccagaaacgggcggccgcuggcauuaugaagaauccgacaguggacgggaucaccgucauugaucucgaccccaucccuuaugaucccaaauuugaaaagcaacuuggacaggugaugcugcugauccucugcguuacacaggugcugaugaugcgcacaaccugggcccuuugugaggcucugacacucgccaccggcccuauuucuacccugugggaagggaaccccggaagauucuggaauacaacgaucgccgucagcauggcgaacauuuuucggggcuccuaccuggcuggggccggacuccuuuucagcaucaugaaaaauaccacaaacacccgcagaggcacaggcaacaugggggagacccugggagagaaguggaaaucucggcugaaugcucucggcaaguccgaauuucaaauuuauaagcgcagcgggauccaggagguggacagaacgcuggccaaagaaggaaucaagcggggcgagacagaucaccaugccguuucucgcggguccgcuaaacuuagaugguucguggagcggaacauggucaccccggaaggaaaggugguggaccugggcugcggcagagggggauggagcuacuauuguggcgggcucaaaaauguucgcgaggucaagggacugaccaagggcgggccuggacacgaagaacccauucccaugucuacauacggcuggaaccuggugcggcuccagagcggcguggaugucuuuuucaucccucccgaaaaaugcgacacccuucugugugauauuggggaguccucuccuaauccgacaguugaggccggaagaacgcugcgcgugcucaaccugguggaaaauuggcuuaacaauaacacccaguucugcaucaagguccugaaucccuacaugccuagcgugauugagaaaauggaagcgcuccaacggaaguauggcggggcccugguuagaaacccccugucccgcaauagcacacaugagauguacuggguguccaacgcuucuggaaauaucgucagcuccgugaacaugaucucucggaugcucauuaacagauuuaccaugcgccacaaaaaggccacauaugaaccugacguugaccuuggcagcgggacccggaauaucggaauugaguccgagauccccaaccuggauauuaucggcaagagaauugagaaaaucaagcaggagcaugaaacgucuuggcacuacgaccaggaucacccguauaaaaccugggcuuaccauggcagcuaugagacaaagcagaccggguccgccagcucuauggugaauggagucgugcgccugcucacaaaaccuugggacgugcugcccaccgucacacaaauggcgaugaccgauacgacaccuuucggccagcagcggguuuuuaaggaaaagguggacaccagaacccaggagcccaaagaggggacaaagaaacuuaugaagaucacggccgaauggcuguggaaagagcucggaaagaaaaagaccccucgcauguguacaagagaagaguucacccggaaggugcgcuccaacgcugcccugggcgcuauuuuuacagaugagaauaaauggaaaagcgccagagaagcugucgaggacucucgguucugggaacugguggauaaagagagaaaccuccaccuggaagggaagugcgagaccuguguuuacaauaugaugggaaaacgggagaagaaacuuggcgaauuuggcaaagccaaggggucccgcgcgaucugguacauguggcugggagccagauuccucgaguuugaagcucugggcuuccuuaacgaggaccauugguuuagccgggaaaauucucuguccgggguggagggagagggccuccacaaacugggguauauucugcgcgaugucagcaagaaagaaggcggagccauguacgcugacgacacagccggcugggauaccagaaucacgcucgaggaccugaagaacgaagagauggugaccaaucacauggaaggggagcauaagaaacuugccgaggcgauuuucaagcugacauaucaaaacaaaguugugcggguccagcgccccaccccgagaggaacagugauggauaucaucucccggcgcgaccagagaggcagcgggcaaguuggaaccuacggccucaauacguuuacaaacauggaagcucagcugauucggcagauggagggggaaggcguguucaagaauauccagcaccuuaccgucacagaggagguggccguccaaaacuggcuggcccgcgugggaagagaacggcucucucgcauggcuauuagcggcgaugacugcguugugaaaccucuggaugacagauucgccaacgcucugaccgcccucaaugauauggggaagauccggaaggacauucagcagugggagcccuccaaaggauggaacgauuggacgcagguccccuuuugcucucaucacuuccaugaacugaucaugaaggacggcagagugcuugugguuccuugucgcaaucaagaugagcugaucgggcgggcgagaauuagccagggagccggcuggucccuccgcgaaaccgcuugccuggggaaaucuuaugcccagauguggagccuuauguacuuucaccggagagaccugcgccucgcugccaacgcgaucuguuccgccgugccgucucacuggguccccacaagccggaccacaugguccauucaugcuaagcacgaguggaugaccacagaggacaugcugaccguguggaauagaguuuggauccgcgaaaacccuuggauggaggauaaaacgcccguggaaagcugggaggaaauuccuuaucugggcaagcgggaggaccaguggugcggaucucucaucggccugacauccagagccaccugggcuaagaauauucaagccgcuaucaaccagguccgcagccuuaucgggaaugaggaauacauugauuacaugcccucuaugaaacgguucagacgggaggaagaggaagccggagugcugugguga

SEQ ID NO: 20069 - RNA, 9876 nt, Artificial Sequence
  derived and/or modified CDS sequence (opt5) from DENV-2__FJ410208__SS-prME
agcgccggcaugaucauuaugcugauccccaccgucauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucaacuuuugugauggaacgacagugaucgucaccgaagacugcggcaauagagggcccagccugcgcaccacaaccgccucuggaaagcucauuacggaguggugcugucgguccugcacacugccuccgcuuagauaucggggcgaggauggcuguugguacgggauggaaauccgcccccugaaagagaaggaagagaaccucguuaauagccuggugaccgccggacacggccaaguggacaacuucucccuggggguccuuggaauggcucucuuucuggaagagaugcugagaacacgggugggcaccaaacaugcgauccuccugguugccgugucuuucgucacacuuauuaccgggaauaugagcuuuaaggaucugggaagagugguugugauggucggcgcuacgaugaccgacgauaucggcaugggggugacauaucucgcccugcuggccgcuuucaaaguucgcccuaccuuugccgcgggacuucugcuccggaagcugacauccaaggagcucaugaugaccacgauuggcaucgugcugcuuucucagagcacaauucccgaaaccguccuggagcucacagacgcucuggcccuggggaugauggugcuuaaaaucgugagaaacauggaaaaguaccagcuggccgucaccaucauggcuauucucugcguuccuaaugccgugauccugcagaacgcguggaaaguguccuguaccauucucgcugucgugucuguuagcccccugcuucugacauccagccaacagaagacggauuggaucccucucgcccugaccauuaaaggacugaaucccacagccaucuuccuuaccacacugucucgcaccaacaagaaaagauccuggccgcucaaugaggcuaucauggccgugggcauggucagcauucuggcuucuucccuccugaagaacgacaucccuaugacggggccccuuguggccggaggccugcugacaguuugcuaugugcucaccggccggagcgcggaccuggaacuugagcgcgccaccgaugucaagugggaggaccaggcugaaauuucuggguccagcccuauccuguccauuacaaucagcgaggauggaucuaugagcauuaaaaaugaagaggaggaacagacccucacaauccugaucagaacgggccuccuggugauuuccgggcuuuuucccaucucuauuccgaucaccgccgcugccugguaccugugggaggucaagaaacaacgggccggagugcugugggacguuccuucucccccucccaugggcaaggcugaacucgaggauggggcguaucgcauuaaacagaagggaauccugggcuacucccagaucggcgccgggguguacaaggaaggaacauuccacaccauguggcaugucacaagaggcgcugugcuuaugcacaaagggaagcggauugagcccuccugggccgacguuaaaaaggaucugaucagcuauggaggcggguggaaacucgagggagaauggaaggagggcgaagaggugcagguccuggcccucgaaccuggcaagaacccgcgcgcugugcaaaccaaacccgggcuguuuaagacgaacaccggaacaauuggcgccgugucccuugacuucucuccugggaccagcggaucccccaucauugauaaaaagggcaaaguugucgggcuguacggaaauggcguggugacaagaagcggcgcguaugucucugcuaucgcccagaccgagaaguccaucgaggacaacccugaaauugaggaugacaucuuucggaagcgcagacugacaauuauggaucuccaccccggggccggaaaaacgaagcgguaccugccugcuaucgugagagaagccauuaaacgcggccuucggacccugauccucgcgccgacaagaguuguggcugccgagauggaagaggcccugcgcgggcuccccauucgguaucagaccccugcuaucagagccgagcauaccggacgcgaaaucgucgaccugaugugucacgcuacauucacgaugcggcuucugagccccgugagaguuccuaauuacaaccugauuaucauggacgaggcccauuucaccgaucccgcgucuauugccgcucgcggcuauaucuccacacggguggaaaugggggaggccgcuggcauuuuuaugaccgccacaccgccuggaagcagagaccccuucccccaauccaaugccccuaucaucgaugaggaacgggagauucccgaacgcucuuggaacagcggccacgagugggucaccgacuuuaaggggaaaacggugugguucguuccuuccaucaaggcuggaaaugauauugcggccugccucagaaagaacggcaaaaaggugauccagcugagccggaaaacauuugacucugaauacgucaagacccgcaccaaugauugggacuucguggugacaaccgauauuuccgagaugggggcuaacuuuaaagccgagagagucaucgacccgcggagauguaugaagcccguuauccuuacagauggagaggaacgcgugauucuggccggcccuaugcccgugacccauagcucugcugcccagcggagagggcgcaucggccggaauccuaaaaacgaaaaugaccaguacauuuauaugggagagccccucgaaaacgacgaggauugcgcgcacuggaaggaggcuaagaugcugcuggacaauaucaacacgccggaaggcauuaucccuagcauguucgagcccgaaagagagaaagucgaugccauugacggggaauaccgccuccggggagaggccagaaagacauuuguggaucuuaugcgcagaggcgaccugccuguuuggcuggcuuauaaaguggccgcggaggggaucaacuacgccgaucggcgcugguguuucgacggaaucaagaauaaccaaauucucgaagagaauauggaagucgagaucuggaccaaagagggcgaaagaaagaagcugaaaccccgguggcuugaugcucgcauuuauuccgacccucuggcccucaaggaguuuaaagaguucgcugccgggagaaagucucugacacugaaccucaucaccgagaugggccggcuucccacguucaugacccagaaaacaagagaugcucuggacaaucuggccgugcuccacaccgcggaagccggaggccgcgcuuacaaccaugcccugagcgagcuuccggagacacuggaaacccuccugcugcucacacuucuggcuaccguuacagggggaauuuuucuguuccucauguccggccgggggaucggaaagaugacacugggcaugugcugcaucauuaccgccucuauccuucugugguaugcccagauucagccucacuggaucgcugcgagcauuauccucgaguuuuuccugaucgugcugcucauucccgaacccgagaagcaaagaaccccucaggauaaucagcuuacauacgucgugaucgccauucugaccgucguggcugccacaauggccaacgaaaugggcuuucuggagaaaacgaagaaagaccucgggcugggauccaucgcuacccgccagccggagagcaauauucuugacaucgaucugcggcccgccucugcguggacacucuacgccguugcuaccacauucgugaccccuaugcugagacauuccauugaaaacagcuccgugaaugucucucugacggccaucgcuaaccaagccaccguucucaugggccuugggaagggauggccccugagcaaaauggacaucggcgugccucugcucgcgauuggguguuauucccaggugaaucccaucacacugaccgccgcccuucugcuccuggucgcccacuacgcuauuaucggaccuggccugcaggccaaggcuacacgggaggcccagaagcgcgcggccgcuggcauuaugaaaaacccgaccguggaugggaucacgguuaucgaccucgaucccauuccuuaugaccccaaguuugaaaaacaacuuggacaggugaugcugcugguccucugcgugacacagguccugaugaugagaaccacaugggcccuuugugaggcucugacccucgccaccggcccuaucucuacacugugggaagggaaucccggacgguucuggaacacgaccauugccgugagcauggcgaauaucuuucgcggcuccuaccuggcuggggccggacuccuuuucagcauuaugaagaacacaaccaacacaagacggggcaccggcaauaugaucgagacgcugggggagaaauggaagucucgccugaacgcucucggaaaauccgaauuucaaaucuauaaaaagagcggcauucaggagguugauagaacacuggccaaagaagggaucaagcggggagagaccgaccaccaugccgugucucgcggcuccgcuaaacuuagaugguucgucgagcggaauauggugaccccggaagggaagguuguggaucugggaugcggcagaggcggguggagcuacuauuguggaggccucaaaaacguccgcgaggugaaggggcugacaaagggaggcccugggcacgaagaacccauucccaugucuaccuacggauggaaucuggugcggcuccagagcggcguugacgucuuuuucaucccucccgaaaaaugcgauacacuucugugugacauuggcgaguccucuccuaacccgacgguggaggccgggagaacccugcgcgugcucaaucuggucgaaaacuggcuuaauaacaauacacaguucugcaucaagguucugaaccccuacaugccuagcgugaucgagaaaauggaagcgcuccaacggaaguauggaggcgcccuggugagaaauccccugucccgcaacagcacccaugagauguacugggucuccaaugcuucugggaacauugugagcuccguuaacaugaucucucggaugcucauuaauagauuuacaaugcgccacaaaaaggccaccuaugaaccugauguggaccuuggaagcggcacgcggaacaucgggauugaguccgagauccccaaucuggacauuaucggaaagagaaucgagaagauuaagcaggagcaugaaaccucuuggcacuacgaucaggaccacccguauaaaacaugggcuuaccauggcagcuaugagaccaagcagacaggcuccgccagcucuauggucaacggggugguucgccugcucaccaaaccuugggaugugcugcccacagucacccaaauggcgaugacggacacaaccccuuucggacagcagcggguguuuaaggaaaagguggauaccagaacacaggagcccaaagagggcacgaagaaacuuaugaagaucaccgccgaauggcuguggaaagagcucgggaagaaaaagacaccucgcauguguaccagagaagaguucacacggaagguccgcuccaaugcugcccugggagcuauuuuuaccgacgagaacaaauggaaaagcgccagagaagcuguugaggauucucgguucugggaacugguggacaaagagagaaaucuccaccuggaaggcaagugcgagacauguguguacaacaugauggggaaacgggagaagaaacuuggagaauuuggcaaagccaagggcucccgcgcgaucugguacauguggcugggggccagauuccucgaguuugaagcucugggauuccuuaaugaggaucauugguuuagccgggaaaacucucuguccggcgucgagggggagggacuccacaaacugggcuauauucugcgcgacgugagcaagaaagaagggggcgccauguacgcugaugacaccgccggaugggacacgagaaucacccucgaggaucugaagaaugaagagaugguuacaaaccacauggaaggcgagcauaagaaacuugccgaggcgaucuucaagcugaccuaucaaaauaaagugguccgggugcagcgccccacaccgagagggaccguuauggacauuaucucccggcgcgaucagagaggaagcggccaaguggggacguacggacucaacacauuuaccaauauggaagcucagcugauucggcagauggagggcgaaggggucuucaagaacauccagcaccuuacagugaccgaggagguugccgugaaaaacuggcuggcccgcgucggcagagaacggcucucucgcauggcuauuagcggagacgauugcguggucaagccucuggacgauagauucgccaaugcucugacggcccucaacgacaugggcaagauccggaaagauauccaacagugggagcccuccaagggguggaaugacuggacccaggugcccuuuugcucucaucacuuccaugaacugauuaugaaagauggaagaguucuuguggucccuugucgcaaccaggacgagcugaucggccgggcgagaauuagccaaggggccggauggucccuccgcgaaacagcuugccugggcaagucuuaugcccagauguggagccuuauguacuuucaccggagagaucugcgccucgcugccaaugcgaucuguuccgccgugccgucucacugggugcccaccagccggacaaccugguccauucaugcuaaacacgaguggaugacaaccgaggacaugcugacgguuuggaacagaguguggauccgcgaaaauccuuggauggaggacaagacacccgucgaaagcugggaggaaauuccuuaucuggggaagcgggaggaucaguggugcggcucucucaucggacugaccuccagagccaccugggcuaaaaacauccaggccgcuauuaaucaagugcgcagccuuaucggcaacgaggaauacacagacuacaugcccucuaugaagcgguucagacgggaggaagaggaagccgggguucugugguga

SEQ ID NO: 20070 - RNA, 9876 nt, Artificial Sequence
  derived and/or modified CDS sequence (opt5) from DENV-2__FJ461305__SS-prME
agcgccggcaugaucauuaugcugauccccaccgugauggcuuuccaccugacaacgagaaauggggagccucauaugauuguuggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaaucgauaauuucucccugggggugcuuggaauggcucucuuucuggaagagaugcugaaaacaagagucggcaccaagcaugcgauucuccugguggccguuucuuucgugacacuuaucaccgggaacaugagcuuuaaagaccugggacgggucgugguuauggugggcgcuacgauggccgaugacauuggcaugggggucaccuaucucgcccugcuggcugccuucaaggugagaccuacauuugcggcuggacuucugcuccgcaagcugaccuccaaagagcucaugaugacaaccaucggcauuguucugcuuucucagagcacgauccccgaaacagugcuggagcucaccgaugcccuggcccuggggaugaugguccuuaagaucgugcggaauauggaaaaauaccagcuggcugugacaauuauggccauccucugcgucccuaacgcgguuauucugcagaaugcuuggaagguguccuguaccauccucgccguggucucugugagcccccugcuucugaccuccagccaacagaaaacagacuggauuccucucgcccugacgaucaagggacugaaccccaccgcuaucuuccuuacaacccugucuagaacaaauaaaaagcgcuccuggccgcucaacgaggccauuauggcuguuggcauggugagcauccuggccucuucccuccugaagaaugacauuccuaugaccgggccccuugucgcgggaggccugcugacggugugcuauguucucacaggcagaagcgccgaucuggaacuugagcgggcuaccgacgugaaaugggaggaucaggccgaaaucucuggguccagcccuauucuguccaucaccauuagcgaggacggaucuaugagcaucaagaacgaagaggaggaacagacacucaccauccugauucgcacaggccuccuggucaucuccgggcuuuuucccauuucuaucccgauuacggcugccgccugguaccugugggaggugaaaaagcaaagagcuggaguccugugggaugugccuucucccccucccaugggcaaagcggaacucgaggacggggccuaucggaucaagcagaagggaauccugggcuacucccagauuggcgcugggguuuacaaagaaggaaccuuccacacaauguggcaugugacccgcggcgccguccuuaugcacaaggggaaaagaaucgagcccuccugggccgaugugaagaaagaccugauuagcuauggaggcggguggaagcucgagggagaauggaaggagggcgaagagguucaggugcuggcucucgaaccuggcaaaaauccgcgggccguccaaacaaagcccgggcuguuuaaaaccaacacgggaaccaucggcgcggugucccuugauuucucuccugggacaagcggaucccccauuaucgacaagaaaggcaaggugguugggcuguacggaaacggcgucgugacccgcagcggcgcuuaugugucugccaucgcccagacagagaaguccauugaggauaauccugaaaucgaggacgauauuuuuagaaaacggcgccugaccaucauggaccuccaccccggggcuggaaagacaaaaagauaccugccugccauuguccgggaagcgaucaagagaggccuucgcacgcugauucucgcuccgacccgggugguugccgccgagauggaagaggcucugagagggcuccccauccgcuaucagaccccugccauccgggcugagcauaccggaagagaaauuguggaccugaugugucacgccaccuucacaaugcgccuucugagccccguccgggugccuaacuacaaucugaucauuauggaugaggcgcauuucacggaccccgccucuaucgcugccagaggcuauauuuccacccgcguugaaaugggggaggcugccggcaucuuuaugacagccaccccgccuggaagccgggaucccuucccccaauccaacgcuccuaucauugacgaggaaagagagauccccgaacggucuuggaauagcggccacgagugggugacagauuuuaaagggaagaccgucugguucgugccuuccauuaaggcgggaaacgacaucgccgcuugccuccgcaaaaauggcaagaaaguuauucagcugagcagaaagacguuugauucugaauacgugaaaacacggaccaacgacugggauuucgucgugaccacagacaucuccgagaugggggccaauuuuaaggccgagcgcgugaucgauccgagacgguguaugaaacccgucauucuuaccgacggagaagagagaguuauccuggcuggcccuaugcccgugacacauagcucugccgcgcagcgccgggggagaauuggccgcaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaacgggagaagguggacgccaucgauggggaauacagacuccgcggagaggcucggaaaacguuugucgaccuuaugagacgcggcgaucugccuguguggcuggccuauaagguugcggccgaggggaucaacuacgcugacagacggugguguuucgauggaauuaaaaacaaucaaauccucgaagagaacguggaagucgagauuuggacaaaggagggcgaacgcaagaaacugaagcccagauggcuugacgcccggaucuauuccgauccucuggcucucaaagaguuuaaggaguucgccgcugggcgcaaaucucugacccugaaucucauuacagagaugggcagacuucccaccuucaugacgcagaagacccgggacgcccuggauaaccuggcggugcuccacacagccgaagcuggaggcagagccuacaaucaugcucugagcgagcuuccggagacccuggaaacacuccugcugcucacccuucuggccacaguuaccgggggaaucuuucuguuccucauguccggccgcgggaucggaaagaugacgcugggcaugugcugcauuaucacagccucuauucuucugugguaugcucagauccagccucacuggauugcggccagcaucauccucgaguuuuuccugauugugcugcucauccccgaacccgagaaacaacggaccccucaggacaaccagcuuaccuacgucgugauugcuauccugacagucguggccgccaccauggcuaaugaaaugggcuuucuggagaagaccaagaaggaccucgggcugggauccauugccacgcagcaaccggagagcaacauccuugauauugaccugagacccgcgucugccuggacccucuacgcuguugccacaaccuucgugacaccuaugcugcgccauuccaucgaaaauagcuccgugaacgucucucugaccgcuaucgccaaucaggcgacgguucucaugggccuugggaaaggauggccccugagcaagauggauauuggcgugccucugcucgccaucggguguuauucccaggugaaccccauuacccugacagcugcccuucugcuccuggucgcucacuacgccaucauuggaccuggccugcaggcuaaggccacccgggaggcgcagaagcgggccgcugccggcaucaugaagaauccgacaguggacgggaucaccguuauugaucucgaccccaucccuuaugaucccaaauuugaaaagcagcuuggacaggugaugcugcugauucucugcgucacgcaagugcugaugaugcggacaaccugggcucuuugugaggcccugacacucgccaccggcccuaucucuacccugugggaagggaaccccggacgcuucuggaauacaacgauugcggucagcauggcuaacaucuuuagaggcuccuaccuggccggggcuggacuccuuuucagcaucaugaaaaauaccacaaacacccggcgcggcacaggcaacaugggggagacccugggagagaaguggaaaucuagacugaaugcccucggcaaguccgaauuucagauuuauaagaaaagcgggauccaggagguggaccggacgcuggccaaggaaggaauuaaacgcggcgagacagaucaccaugcuguuucuagaggguccgccaaacuucggugguucguggagcgcaacauggucaccccggaaggaaaagugguugaccugggcugcggcagagggggauggagcuacuauuguggcgggcucaagaaugugcgggaggucaagggacugaccaaaggcgggccuggacacgaagaacccauccccaugucuacauacggcuggaaccuggugagacuccagagcggcguggaugucuuuuucauuccucccgaaaagugcgacacccuucugugugauaucggggaguccucuccuaauccgacagucgaggcgggacgcacgcugcgggugcucaaccugguggaaaauuggcuuaacaauaacacccaauucugcaucaaaguccugaaucccuacaugccuagcguuauugagaagauggaagcccuccagagaaaauauggcggggcucuggugcgcaacccccugucccggaauagcacacaugagauguacuggguguccaacgccucuggaaauaucgucagcuccgugaacaugauuucuagaaugcucaucaaccgcuuuaccaugcggcacaagagagcuacauaugaaccugacguugaccuuggcagcgggacccgcaauauuggaaucgaguccgagauucccaaccuggauaucaucggcaagcggauugagaagaucaagcaggagcaugaaacgucuuggcacuacgaccaggaucacccguauaaaaccugggccuaccauggcagcuaugagacaaagcaaaccggguccgcgagcucuauggugaauggagucgugagacugcucacaaaaccuugggacguucugcccaccgugacacagauggccaugaccgauacgacaccuuucggccagcagcgcgucuuuaaggaaaagguggacacccggacccaagagcccaaagaggggacaaagaaacuuaugaagauuacggcugaauggcuguggaaagagcucggaaagaaaaagaccccuagaauguguacacgcgaagaguucaccagaaaggugcgguccaacgccgcucugggcgccaucuuuacagaugagaauaaauggaaaagcgcucgcgaagccgucgaggacucuagauucugggaacugguugauaaagagcggaaccuccaccuggaagggaagugcgagaccuguguguacaauaugaugggaaaaagagagaagaaacuuggcgaauuuggcaaagcgaaggggucccgggccauuugguacauguggcugggagcucgcuuccucgaguuugaagcccugggcuuccuuaacgaggaccauugguuuagcagagaaaauucucuguccgggguggagggagagggccuccacaaacugggguauauccugcgggaugucagcaagaaagaaggcggagcuauguacgccgacgacacagccggcugggauacccgcaucacgcucgaggaccugaagaacgaagagauggugaccaaucacauggaaggggagcauaagaaacuugcggaggcuauuuucaagcugacauaucagaacaaaguugugagaguccagcggcccaccccgcgcggaacagugauggauaucauuuccagacgggaccaacgcggcagcgggcagguuggaaccuacggccucaauacguuuacaaacauggaagcccagcugaucagacagauggagggggaaggcguguucaagaauauucaacaccuuaccgucacagaggagguggccguucagaacuggcuggcucgggugggacgcgaaagacucucucggauggccaucagcggcgaugacugcgucgugaaaccucuggaugaccgcuucgcuaacgcccugaccgcgcucaaugauauggggaagaucagaaaggacauucagcagugggagcccuccaaaggauggaacgauuggacgcaaguccccuuuugcucucaucacuuccaugaacugaucaugaaggacggccgggugcuuguugugccuuguagaaaucaggaugagcugauugggcgcgcccggaucagccagggagcuggcuggucccucagagaaaccgccugccuggggaaaucuuaugcucagauguggagccuuauguacuuucaccgccgggaccugagacucgccgcgaacgccauuuguuccgcugucccgucucacugggugcccacaagccgcaccacaugguccauccaugccaagcacgaguggaugaccacagaggacaugcugaccguguggaaucggguuuggauuagagaaaacccuuggauggaggauaaaacgcccguggaaagcugggaggaaaucccuuaucugggcaagcgcgaggaccaauggugcggaucucucaucggccugacaucccgggcuaccugggccaagaauauucaggcugccaucaaccaggucagaagccuuauugggaaugaggaauacaccgauuacaugcccucuaugaaacgcuuccggagagaggaagaggaagcgggagugcugugguga

SEQ ID NO: 20071 - RNA, 9876 nt, Artificial Sequence
  derived and/or modified CDS sequence (opt5) from DENV-2__FJ410215__SS-prME
agcgccggaaugaucauuaugcugauccccaccgugauggcuuuccaccugaccacgagaaauggggaaccucauaugauugucggaauccaggaaaagggcaaaucccugcuuuuuaagaccgaagacgggguuaauaugugcacgcugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcugccauggccgaugacaucggcaugggggugacguaucucgcucugcuggccgcguucaagguucgcccuaccuuugcugccggacuucugcuccggaagcugacauccaaagagcucaugaugaccacaauuggcaucgugcugcuuucucaaagcaccauucccgaaacgguccuggagcucacagaugcccuggcucuggggaugauggugcuuaagaucgugagaaauauggaaaaauaccagcuggccgucaccaucauggcgauucucugcguuccuaacgcugugauccugcagaaugccuggaagguguccuguacaauucucgccgucgugucuguuagcccccugcuucugaccuccagccagcagaaaaccgacuggaucccucucgcucugacaauuaagggacugaaccccacggccaucuuccuuaccacacugucucgcaccaauaaaaagagauccuggccgcucaacgaggcuaucauggccgugggcauggucagcauucuggcgucuucccuccugaagaaugacaucccuaugacagggccccuuguggccggaggccugcugaccguuugcuaugugcucacgggccggagcgcugaucuggaacuugagcgcgccacagacgucaaaugggaggaucaggcugaaauuucuggguccagcccuauccuguccauuaccaucagcgaggacggaucuaugagcauuaagaacgaagaggaggaacagacccucacaauccugaucagaaccggccuccuggugauuuccgggcuuuuucccaucucuauuccgaucacagccgccgcuugguaccugugggaggucaaaaagcagcgggcgggagugcugugggauguuccuucucccccucccaugggcaaagccgaacucgaggacggggcuuaucgcauuaagcaaaagggaauccugggcuacucccagaucggcgccgggguguacaaagaaggaacguuccacaccauguggcaugucacaagaggcgccgugcuuaugcacaaggggaaacggauugagcccuccugggcugauguuaagaaagaccugaucagcuauggaggcggguggaagcucgagggagaauggaaggagggcgaagaggugcagguccuggcccucgaaccuggcaaaaauccgcgcgcggugcagaccaagcccgggcuguuuaaaacaaacaccggaacgauuggcgcugugucccuugauuucucuccugggaccagcggaucccccaucauugacaagaaaggcaagguugucgggcuguacggaaacggcguggugacaagaagcggcgccuaugucucugccaucgcucaaaccgagaaguccaucgaggauaauccugaaauugaggacgauaucuuucggaaacgcagacugacaauuauggaccuccaccccggggccggaaagaccaaacgguaccugccugcgaucgugagagaagcuauuaagcgcggccuucggacacugauccucgccccgacgagaguuguggccgcugagauggaagaggcccugcgcgggcuccccauucgguaucagaccccugcuaucagagccgagcauacaggacgcgaaaucgucgaccugaugugucacgcgaccuucaccaugcggcuucugagccccgugagaguuccuaacuacaaucugauuaucauggaugaggcccauuucacagaccccgcuucuauugccgcucgcggcuauaucuccacgcggguggaaaugggggaggccgccggcauuuuuaugaccgcuacaccgccuggaagcagagaucccuucccccaguccaacgcgccuaucaucgacgaggaacgggagauucccgaacgcucuuggaauagcggccacgagugggucaccgauuuuaaagggaagacagugugguucguuccuuccaucaaggccggaaacgacauugcugccugccuccgcaaaaauggcaagaaagugauccaacugagccggaagaccuuugauucugaauacgucaaaacgcgcacaaacgacugggauuucguggugaccaccgacauuuccgagaugggggccaauuuuaaggcugagagagucaucgauccgcggagauguaugaaacccguuauccuuacagacggagaggaacgcgugauucuggccggcccuaugcccgugacccauagcucugcggcucagcggagagggcgcaucggccggaacccuaagaaugaaaacgaccaguacauuuauaugggagagccccucgaaaaugaugaggacugcgcccacuggaaggaggccaaaaugcugcuggauaacaucaauacaccggaaggcauuaucccuagcauguucgagcccgaaagagagaaggucgacgcuauugauggggaauaccgccuccggggagaggccagaaaaaccuuuguggaccuuaugcgcagaggcgaucugccuguuuggcuggcguauaagguggccgcugaggggaucaacuacgccgaccggcgcugguguuucgauggaaucaaaaacaaucagauucucgaagagaacgucgaaguggagaucuggacgaaggagggcgaaagaaagaaacugaagccccgguggcuugacgcucgcauuuauuccgauccucuggcccucaaagaguuuaaggaguucgcugccgggagaaaaucucugacacugaaucucaucaccgagaugggccggcuucccacauucaugacccaaaagacgagagacgcgcuggauaaccuggccguucuccacaccgcugaagccggaggccgcgcuuacaaucaugcccugagcgagcuuccggagacacuggaaacccuccugcugcucacacuucuggccaccgugacagggggaauuuuucuguuccucauguccggccgggggaucggaaagaugacccugggcaugugcugcaucauuacggcuucuauccuucugugguaugcgcagauucagccucacuggaucgccgcuagcauuauccucgaguuuuuccugaucguccugcucauucccgaacccgagaaacagagaacaccucaagacaaccagcuuaccuacguggucaucgccauucugaccgugguugccgcuacaauggccaaugaaaugggcuuucuggagaagaccaaaaaggacuucgggcucggauccaucgcgacacagcagccggagagcaacauucuggauaucgaccuucgccccgccucugcuuggacgcuguacgccguggcuaccacauuugugaccccuaugcuccggcauuccauugaaaauagcuccgucaacguuucucugacagccaucgcgaaucaagccaccgugcugaugggccucgggaaaggauggccccuuagcaagauggauaucggcgugccucugcuggcuauuggguguuauucccaggucaaccccaucacgcucaccgccgcucugcuucugcucguggcccacuacgcuauuaucggaccuggccugcaggccaaggcgacaagagaggcccagaaacgggcugccgcuggcauuaugaagaauccgaccguugacgggaucacagugaucgaucuggaccccauuccuuaugaucccaaauucgaaaagcaacucggacaggucaugcuucugauccugugcgugacccagguccucaugaugcgcacgacaugggcccugugugaggcccuuacccuggcgacaggcccuauuucuacccucugggaagggaaccccggaagauuuuggaauaccacaaucgcugugagcauggccaacauuuuccggggcuccuaccuggcuggggccggacugcucuuuagcaucaugaaaaauacgaccaacacacgcagaggcaccggcaacaucggggagacacuuggagagaaguggaaaucucggcugaaugcccugggcaaguccgaguuccaaaccuauaagaaaagcgggauucaggagguugaccgcacgcucgcuaaggaaggaaucaaaagaggcgagacagaucaccaugccgugucucggggguccgcgaagcugcgcugguuugucgagagaaacauggugaccccggaaggaaaaguuguggaccuuggcugcggcagagggggauggagcuacuauuguggcgggcugaagaauguccgggaggugaagggacucaccaaaggcgggccuggacacgaagaacccauucccaugucuacauacggcuggaaccuggugcgccugcagagcggcguugaugucuucuucaucccucccgaaaagugcgacacccuccuuugugauauuggggaguccucuccuaauccgacaguggaggccggacggacgcugagagugcugaaccucgucgaaaauuggcugaacaauaacacccaguuuugcaucaaaguucuuaaucccuacaugccuagcgugaucgagaagauggaagcucugcaacgcaaauauggcggggcccucgugcggaacccccuguccagaaauagcacacaugagauguacugggucuccaacgcuucuggaaauauugugagcuccguuaacaugaucucucgcaugcugauuaaccgguucaccaugagacacaagaaggccacauaugaaccugacguggaccucggcagcgggacccgcaauaucggaauugaguccgagauccccaaccuugauauuaucggcaaacggaucgaaaagauuaaacaggagcaugaaacgucuuggcacuacgaccaggaucacccguauaagaccugggcguaccauggcagcuaugagacaaaacagaccggguccgccagcucuauggucaauggagugguuagacugcugacaaagccuugggacgugcuccccaccgucacacaaauggcuaugaccgauacgacaccuuuuggccagcagcgcguguucaaggaaaaaguggacacccggacccaggagcccaaggaggggaccaaaaagcugaugaaaaucacggccgaauggcuuuggaaggagcugggcaaaaagaagaccccuagaauguguacacgcgaagaguuuaccagaaaaguccgguccaacgcugcccucggcgcuauuuucacagaugagaauaaguggaaaagcgcccgcgaagcgguugaggacucuagauuuugggaacugguggauaaggagcggaaccugcaccucgaagggaaaugcgagaccuguguguacaauaugaugggaaagagagagaagaaacugggcgaguucggcaaggccaaagggucccgggcuaucugguacauguggcuuggagcccgcuuucuggaguucgaagcucucggcuuucugaacgaggaccauugguucagcagagaaaauucucuuuccggggucgagggagagggccugcacaagcucggguauauucugcgggaugugagcaaaaaggaaggcggagccauguacgccgacgacacagcgggcugggauacccgcaucacgcuggaggaccucaagaacgaagagaugguuaccaaucacauggaaggggagcauaaaaagcuggcugaggccaucuuuaaacuuacauaucaaaacaagguggucagagugcagcggcccaccccgcgcggaacaguuauggauauuaucuccagacgggaccagcgcggcagcgggcaagugggaaccuacggccugaauacguucacaaacauggaagcccagcucauuagacagauggagggggaaggcgucuucaaaaauauccagcaccugaccgugacagaggagguugcugugcaaaacuggcuugcccgggucggacgcgaaagacugucucggauggcuauuagcggcgaugacugcguggucaagccucucgaugaccgcuuugccaacgcgcugaccgcccugaaugauauggggaagaucagaaaagacauccagcagugggagcccuccaagggauggaacgauuggacacaggugcccuucugcucucaucacuuucaugaacucauuaugaaagacggccggguucugguggucccuuguagaaaucaagaugagcuuaucgggcgcgcucggauuagccagggagccggcuggucccugagagaaaccgcuugccucgggaagucuuaugcccagauguggagccugauguacuuccaccgccgggaccuuagacuggcggccaacgcuaucuguuccgccgugccgucucacugggugcccacaagccgcaccacaugguccauucaugcuaaacacgaguggaugaccacagaggacaugcucaccguuuggaaucggguguggaucagagaaaacccuuggauggaggauaagacgcccgucgaaagcugggaggaaauuccuuaucugggcaagcgcgaggaccaguggugcggaucucugaucggccucacaucccgggccaccugggcuaaaaauauccaagccgcgauuaaccaggugagaagccugaucgggaaugaggaauacaccgauuacaugcccucuaugaagcgcuuucggagagaggaagaggaagccggaguucuuugguga

SEQ ID NO: 20072 - RNA, 9876 nt, Artificial Sequence
  derived and/or modified CDS sequence (opt5) from DENV-2__FJ461309__SS-prME
agcgccggaaugaucauuaugcugauccccacagugauggcuuuccaccugacaacgagaaauggggagccucauaugauugucggaauccaggaaaagggaaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugaaaacaagagugggcaccaagcaugcgauccuccugguugccgugucuuucgucacacuuauuaccgggaacaugagcuuuaaagaccugggacgggugguugugauggucggcgcuacgauggccgaugacaucggcaugggggugaccuaucucgcccugcuggcugccuucaagguuagaccuacauuugcggcuggacuucugcuccgcaagcugaccuccaaagagcucaugaugacaaccauuggcaucgugcugcuuucucagagcacgauucccgaaacaguccuggagcucaccgaugcccuggcccuggggaugauggugcuuaagaucgugcggaauauggaaaaauaccagcuggcugucacaaucauggccauucucugcguuccuaacgcggugauccugcagaaugcuuggaagguguccuguaccauucucgccgucgugucuguuagcccccugcuucugaccuccagccaacagaaaacagacuggaucccucucgcccugacgauuaagggacugaaccccaccgcuaucuuccuuacaacccugucuagaacaaauaaaaagcgcuccuggccgcucaacgaggccaucauggcugugggcauggucagcauucuggccucuucccuccugaagaaugacaucccuaugaccgggccccuuguggcgggaggccugcugacgguuugcuaugugcucacaggcagaagcgccgaucuggaacuugagcgggcuaccgacgucaaaugggaggaucaggccgaaauuucuggguccagcccuauccuguccauuaccaucagcgaggacggaucuaugagcauuaagaacgaagaggaggaacagacacucaccauccugauccgcacaggccuccuggugauuuccgggcuuuuucccaucucuauuccgaucacggcugccgccugguaccugugggaggucaaaaagcaaagagcuggagugcugugggauguuccuucucccccucccaugggcaaagcggaacucgaggacggggccuaucggauuaagcagaagggaauccugggcuacucccagaucggcgcugggguguacaaagaaggaaccuuccacacaauguggcaugucacccgcggcgccgugcuuaugcacaaggggaaaagaauugagcccuccugggccgauguuaagaaagaccugaucagcuauggaggcggguggaagcucgagggagaauggaaggagggcgaagaggugcagguccuggcucucgaaccuggcaaaaauccgcgggccgugcaaacaaagcccgggcuguuuaaaaccaacacgggaaccauuggcgcggugucccuugauuucucuccugggacaagcggaucccccaucauugacaagaaaggcaagguugucgggcuguacggaaacggcguggugacccgcagcggcgcuuaugucucugccaucgcccagacagagaaguccaucgaggauaauccugaaauugaggacgauaucuuuagaaaacggcgccugaccauuauggaccuccaccccggggcuggaaagacaaaaagauaccugccugccaucgugcgggaagcgauuaagagaggccuucgcacgcugauccucgcuccgacccggguuguggccgccgagauggaagaggcucugagagggcuccccauucgcuaucagaccccugccauccgggcugagcauaccggaagagaaaucgucgaccugaugugucacgccaccuucacaaugcgccuucugagccccgugcggguuccuaacuacaaucugauuaucauggaugaggcgcauuucacggaccccgccucuauugcugccagaggcuauaucuccacccgcguggaaaugggggaggcugccggcauuuuuaugacagccaccccgccuggaagccgggaucccuucccccaauccaacgcuccuaucaucgacgaggaaagagagauucccgaacggucuuggaauagcggccacgagugggucacagauuuuaaagggaagaccgugugguucguuccuuccaucaaggcgggaaacgacauugccgcuugccuccgcaaaaauggcaagaaagugauccagcugagcagaaagacguuugauucugaauacgucaaaacacggaccaacgacugggauuucguggugaccacagacauuuccgagaugggggccaauuuuaaggccgagcgcgucaucgauccgagacgguguaugaaacccguuauccuuaccgacggagaagagagagugauucuggcuggcccuaugcccgugacacauagcucugccgcgcagcgccgggggagaaucggccgcaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaacgggagaaggucgacgccauugauggggaauacagacuccgcggagaggcucggaaaacguuuguggaccuuaugagacgcggcgaucugccuguuuggcuggccuauaagguggcggccgaggggaucaacuacgcugacagacggugguguuucgauggaaucaaaaacaaucaaauucucgaagagaacgucgaaguggagaucuggacaaaggagggcgaacgcaagaaacugaagcccagauggcuugacgcccggauuuauuccgauccucuggcucucaaagaguuuaaggaguucgccgcugggcgcaaaucucugacccugaaucucaucacagagaugggcagacuucccaccuucaugacgcagaagacccgggacgcccuggauaaccuggcgguucuccacacagccgaagcuggaggcagagccuacaaucaugcucugagcgagcuuccggagacccuggaaacacuccugcugcucacccuucuggccacagugaccgggggaauuuuucuguuccucauguccggccgcgggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacaacggaccccucaggacaaccagcuuaccuacguggucaucgcuauucugacagugguugccgccaccauggcuaaugaaaugggcuuucuggagaagaccaagaaggaccucgggcugggauccaucgccacgcagcaaccggagagcaacauucuugauaucgaccugagacccgcgucugccuggacccucuacgcuguggccacaaccuucgugacaccuaugcugcgccauuccauugaaaauagcuccgucaacguuucucugaccgcuaucgccaaucaggcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaggccacccgggaggcgcagaagcgggccgcugccggcauuaugaagaauccgacaguugacgggaucaccgugaucgaucucgaccccauuccuuaugaucccaaauuugaaaagcagcuuggacaggucaugcugcugauccucugcgugacgcaaguccugaugaugcggacaaccugggcucuuugugaggcccugacacucgccaccggcccuauuucuacccugugggaagggaaccccggacgcuucuggaauacaacgaucgcggugagcauggcuaacauuuuuagaggcuccuaccuggccggggcuggacuccuuuucagcaucaugaaaaauaccacaaacacccggcgcggcacaggcaacaugggggagacccugggagagaaguggaaaucuagacugaaugcccucggcaaguccgaauuucagaucuauaagaaaagcgggauucaggagguugaccggacgcuggccaaggaaggaaucaaacgcggcgagacagaucaccaugcugugucuagaggguccgccaaacuucggugguucgucgagcgcaacauggugaccccggaaggaaaaguuguggaccugggcugcggcagagggggauggagcuacuauuguggcgggcucaagaauguccgggaggugaagggacugaccaaaggcgggccuggacacgaggaacccauucccaugucuacauacggcuggaaccuggugagacuccagagcggcguugaugucuuuuucaucccucccgaaaagugcgacacccuucugugugauauuggggaguccucuccuaauccgacaguggaggcgggacgcacgcugcgggugcucaaccuggucgaaaauuggcuuaacaauaacacccaauucugcaucaaaguucugaaucccuacaugccuagcgugaucgagaagauggaagcccuccagagaaaauauggcggggcucuggugcgcaacccccugucccggaauagcacacaugagauguacugggucuccaacgccucuggaaauauugugagcuccguuaacaugaucucuagaaugcucauuaaccgcuuuaccaugcggcacaagaaggcuacauaugaaccugacguggaccuuggcagcgggaccagaaauaucggaauugaguccgagauccccaaccuggauauuaucggcaaacgcaucgaaaagauuaaacaggagcaugaaacgucuuggcacuacgaccaggaucacccguauaagaccugggccuaccauggcagcuaugagacaaaacaaaccggguccgcgagcucuauggucaauggagugguucggcugcucacaaagccuugggacgugcugcccaccgucacacagauggccaugaccgauacgacaccuuucggccagcagagaguguuuaaggaaaaaguggacacccgcacccaagagcccaaggaggggaccaagaaacuuaugaaaaucacggcugaauggcuguggaaggagcucggcaaaaagaagaccccucggauguguacaagagaagaguucacccgcaaagucagauccaacgccgcucugggcgccauuuuuacagaugagaauaaguggaaaagcgcucgggaagccguugaggacgggcgcuucugggaacugguggauaaggagagaaaccuccaccuggaaggaaaaugcgagaccuguguguacaauaugaugggcaagcgggagaagaaacuuggcgaauuugggaaggcgaaaggaucuagagccaucugguacauguggcugggcgcucgguuccucgaguuugaagcccugggguuccuuaacgaggaccauugguuuucccgcgaaaauagccugucuggagucgagggcgaggggcuccacaagcugggcuauauucugagagauguguccaaaaaggaaggaggcgcuauguacgccgacgacacagccgggugggauacccggaucacgcucgaggaccugaagaacgaagagaugguuaccaaucacauggaaggagagcauaagaaacuugcggaggcuaucuucaaacugacauaucagaacaaagugguccgcgugcagagacccaccccgcggggcacaguuauggauauuaucagccgcagagaccaacggggguccggacaggugggcaccuacgggcucaauacguuuacaaacauggaagcccagcugauucgccagauggagggcgaaggagucuucaaaaauauccaacaccuuaccgugacagaggagguugccgugcagaacuggcuggcuagagucggccgggaacgccucagcagaauggccauuucuggggaugacugcguggucaagccucuggaugaccgguucgcuaacgcccugaccgcgcucaaugauaugggaaagauccgcaaagacauccagcagugggagcccagcaagggcuggaacgauuggacgcaagugcccuuuugcucccaucacuuccaugaacugauuaugaaagacgggagaguucuuguggucccuugucggaaucaggaugagcugaucggcagagcccgcauuucucagggcgcuggguggagccuccgggaaaccgccugccugggcaaguccuaugcucagauguggucucuuauguacuuucacagacgcgaccugcggcucgccgcgaacgccaucuguagcgcugugccgucccacugggugcccacaucuagaaccacauggagcauucaugccaaacacgaguggaugaccacagaggacaugcugaccguuuggaaucgcguguggauccgggaaaacccuuggauggaggauaagacgcccgucgaauccugggaggaaauuccuuaucugggaaagagagaggaccaauggugcggcagccucaucgggcugacaucucgcgcuaccugggccaaaaauauccaggcugccauuaaccaggugcggucccuuaucggaaaugaggaauacaccgauuacaugcccagcaugaagagauuccgccgggaggaagaggaagcgggcguucugugguga

SEQ ID NO: 20073 - RNA, 9876 nt, Artificial Sequence
  derived and/or modified CDS sequence (opt5) from DENV-2__FJ461311__SS-prME
agcgccggcaugaucauuaugcugauccccaccgugauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucaacuuuugugauggaacgacagugaucgucaccgaagacugcggcaauagagggcccagccugcgcaccacaaccgccucuggaaagcucauuacggaguggugcugucgguccugcacacugccuccgcuuagauaucggggcgaggauggcuguugguacgggauggaaauccgcccccugaaagagaaggaagagaaccucguuaauagccuggugaccgccggacacggccaaguggacaacuucucccuggggguccuuggaauggcucucuuucuggaagagaugcugagaacacgggugggcaccaaacaugcgauccuccugguugccgugucuuucgucacacuuauuaccgggaauaugagcuuuaaggaucugggaagagugguugugauggucggcgcuacgaugaccgacgauaucggcaugggggugacauaucucgcccugcuggccgcuuucaaaguucgcccuaccuuugccgcgggacuucugcuccggaagcugacauccaaggagcucaugaugaccacgauuggcaucgugcugcuuucucagagcacaauucccgaaaccguccuggagcucacagacgcucuggcccuggggaugauggugcuuaaaaucgugagaaacauggaaaaguaccagcuggccgucaccaucauggcuauucucugcguuccuaaugccgugauccugcagaacgcguggaaaguguccuguaccauucucgcugucgugucuguuagcccccugcuucugacauccagccaacagaagacggauuggaucccucucgcccugaccauuaaaggacugaaucccacagccaucuuccuuaccacacugucucgcaccaacaagaaaagauccuggccgcucaaugaggcuaucauggccgugggcauggucagcauucuggcuucuucccuccugaagaacgacaucccuaugacggggccccuuguggccggaggccugcugacaguuugcuaugugcucaccggccggagcgcggaccuggaacuugagcgcgccaccgaugucaagugggaggaccaggcugaaauuucuggguccagcccuauccuguccauuacaaucagcgaggauggaucuaugagcauuaaaaaugaagaggaggaacagacccucacaauccugaucagaacgggccuccuggugauuuccgggcuuuuucccaucucuauuccgaucaccgccgcugccugguaccugugggaggucaagaaacaacgggccggagugcugugggacguuccuucucccccucccaugggcaaggcugaacucgaggauggggcguaucgcauuaaacagaagggaauccugggcuacucccagaucggcgccgggguguacaaggaaggaacauuccacaccauguggcaugucacaagaggcgcugugcuuaugcacaaagggaagcggauugagcccuccugggccgacguuaaaaaggaucugaucagcuauggaggcggguggaaacucgagggagaauggaaggagggcgaagaggugcagguccuggcccucgaaccuggcaagaacccgcgcgcugugcaaaccaaacccgggcuguuuaagacgaacaccggaacaauuggcgccgugucccuugacuucucuccugggaccagcggaucccccaucauugauaaaaagggcaaaguugucgggcuguacggaaauggcguggugacaagaagcggcgcguaugucucugcuaucgcccagaccgagaaguccaucgaggacaacccugaaauugaggaugacaucuuucggaagcgcagacugacaauuauggaucuccaccccggggccggaaaaacgaagcgguaccugccugcuaucgugagagaagccauuaaacgcggccuucggacccugauccucgcgccgacaagaguuguggcugccgagauggaagaggcccugcgcgggcuccccauucgguaucagaccccugcuaucagagccgagcauaccggacgcgaaaucgucgaccugaugugucacgcuacauucacgaugcggcuucugagccccgugagaguuccuaauuacaaccugauuaucauggacgaggcccauuucaccgaucccgcgucuauugccgcucgcggcuauaucuccacacggguggaaaugggggaggccgcuggcauuuuuaugaccgccacaccgccuggaagcagagaccccuucccccaauccaaugccccuaucaucgaugaggaacgggagauucccgaacgcucuuggaacagcggccacgagugggucaccgacuuuaaggggaaaacggugugguucguuccuuccaucaaggcuggaaaugauauugcggccugccucagaaagaacggcaaaaaggugauccagcugagccggaaaacauuugacucugaauacgucaagacccgcaccaaugauugggacuucguggugacaaccgauauuuccgagaugggggcuaacuuuaaagccgagagagucaucgacccgcggagauguaugaagcccguuauccuuacagauggagaggaacgcgugauucuggccggcccuaugcccgugacccauagcucugcugcccagcggagagggcgcaucggccggaauccuaaaaacgaaaaugaccaguacauuuauaugggagagccccucgaaaacgacgaggauugcgcgcacuggaaggaggcuaagaugcugcuggacaauaucaacacgccggaaggcauuaucccuagcauguucgagcccgaaagagagaaagucgaugccauugacggggaauaccgccuccggggagaggccagaaagacauuuguggaucuuaugcgcagaggcgaccugccuguuuggcuggcuuauaaaguggccgcggaggggaucaacuacgccgaucggcgcugguguuucgacggaaucaagaauaaccaaauucucgaagagaauauggaagucgagaucuggaccaaagagggcgaaagaaagaagcugaaaccccgguggcuugaugcucgcauuuauuccgacccucuggcccucaaggaguuuaaagaguucgcugccgggagaaagucucugacacugaaccucaucaccgagaugggccggcuucccacguucaugacccagaaaacaagagaugcucuggacaaucuggccgugcuccacaccgcggaagccggaggccgcgcuuacaaccaugcccugagcgagcuuccggagacacuggaaacccuccugcugcucacacuucuggcuaccguuacagggggaauuuuucuguuccucauguccggccgggggaucggaaagaugacacugggcaugugcugcaucauuaccgccucuauccuucugugguaugcccagauucagccucacuggaucgcugcgagcauuauccucgaguuuuuccugaucgugcugcucauucccgaacccgagaagcaaagaaccccucaggauaaucagcuuacauacgucgugaucgccauucugaccgucguggcugccacaauggccaacgaaaugggcuuucuggagaaaacgaagaaagaccucgggcugggauccaucgcuacccgccagccggagagcaauauucuugacaucgaucugcggcccgccucugcguggacacucuacgccguugcuaccacauucgugaccccuaugcugagacauuccauugaaaacagcuccgugaaugucucucugacggccaucgcuaaccaagccaccguucucaugggccuugggaagggauggccccugagcaaaauggacaucggcgugccucugcucgcgauuggguguuauucccaggugaaucccaucacacugaccgccgcccuucugcuccuggucgcccacuacgcuauuaucggaccuggccugcaggccaaggcuacacgggaggcccagaagcgcgcggccgcuggcauuaugaaaaacccgaccguggaugggaucacgguuaucgaccucgaucccauuccuuaugaccccaaguuugaaaaacaacuuggacaggugaugcugcugguccucugcgugacacagguccugaugaugagaaccacaugggcccuuugugaggcucugacccucgccaccggcccuaucucuacacugugggaagggaaucccggacgguucuggaacacgaccauugccgugagcauggcgaauaucuuucgcggcuccuaccuggcuggggccggacuccuuuucagcauuaugaagaacacaaccaacacaagacggggcaccggcaauaugggggagacgcugggagagaaauggaagucucaacugaacgcucucggcaaauccgaauuucagaucuauaaaaagagcgggauccaggagguugaucgcacacuggccaaagaaggaauuaagagaggcgagaccgaccaccaugccgugucucggggguccgcuaaacuucgcugguucgucgagagaaauauggugaccccggaaggaaagguuguggaucugggcugcggcagagggggauggagcuacuauuguggcgggcucaaaaacguccgggaggugaagggacugacaaagggcgggccuggacacgaagaacccauccccaugucuaccuacggcuggaaucuggugcgccuccagagcggcguugacgucuuuuucauuccucccgaaaaaugcgauacacuucugugugacaucggggaguccucuccuaacccgacgguggaggccggacggacccugagagugcucaaucuggucgaaaacuggcuuaauaacaauacacaauucugcauuaagguucugaaccccuacaugccuagcgugaucgagaaaauggaagcgcuccagcgcaaguauggcggggcccuggugcggaauccccuguccagaaacagcacccaugagauguacugggucuccaaugcuucuggaaacaucgugagcuccguuaacaugauuucucgcaugcucaucaaucgguuuacaaugagacacaaaaaggccaccuaugaaccugauguggaccuuggcagcgggacgcgcaacauuggaaucgaguccgagauucccaaucuggacaucauuggcaagcggaucgagaagaucaagcaggagcaugaaaccucuuggcacuacgaucaggaccacccguauaaaacaugggcuuaccauggcagcuaugagaccaagcaaacaggguccgccagcucuauggucaacggagugguuagacugcucaccaaaccuugggaugugcugcccacagucacccagauggcgaugacggacacaaccccuuucggccagcagcgcguguuuaaggaaaagguggauacccggacacaagagcccaaagaggggacgaagaaacuuaugaagauuaccgccgaauggcuguggaaagagcucggaaagaaaaagacaccuagaauguguacccgcgaagaguucacaagaaagguccgguccaaugcugcccugggcgcuaucuuuaccgacgagaacaaauggaaaagcgcccgcgaagcuguugaggauucuagauucugggaacugguggacaaagagcggaaucuccaccuggaagggaagugcgagacauguguguacaacaugaugggaaaaagagagaagaaacuuggcgaauuuggcaaagccaaggggucccgggcgauuugguacauguggcugggagcccgcuuccucgaguuugaagcucugggcuuccuuaaugaggaucauugguuuagcagagaaaacucucuguccggggucgagggagagggccuccacaaacugggguauauccugcgggacgugagcaagaaagaaggcggagccauguacgcugaugacaccgccggcugggacacgcgcauuacccucgaggaucugaagaaugaagagaugguuacaaaccacauggaaggggagcauaagaaacuugccgaggcgaucuucaagcugaccuaucagaauaaaguggucagagugcagcggcccacaccgcgcggaaccguuauggacaucauuuccagacgggaucaacgcggcagcgggcaggucggaacguacggccucaacacauuuaccaauauggaagcucagcugaucagacagauggagggggaaggcgucuucaagaacauucaacaccuuacagugaccgaggagguugccgugaaaaacuggcuggcccgggucggacgcgaaagacucucucggauggcuaucagcggcgacgauugcguggucaagccucuggacgaucgcuucgccaaugcucugacggcccucaacgacauggggaagauuagaaaagauauccagcagugggagcccuccaagggauggaaugacuggacccaggugcccuuuugcucucaucacuuccaugaacugaucaugaaagauggccggguucuuguggucccuuguagaaaccaagacgagcugauugggcgcgcgcggaucagccagggagccggcuggucccucagagaaacagcuugccuggggaagucuuaugcccagauguggagccuuauguacuuucaccgccgggaucugagacucgcugccaaugcgauuuguuccgccgugccgucucacugggugcccaccagccgcacaaccugguccauccaugcuaaacacgaguggaugacaaccgaggacaugcugacgguuuggaaccggguguggauuagagaaaauccuuggauggaggacaagacacccgucgaaagcugggaggaaaucccuuaucugggcaagcgcgaggaucaguggugcggaucucucauuggccugaccucccgggccaccugggcuaaaaacauccaagccgcuaucaaucaggugagaagccuuauugggaacgaggaauacacagacuacaugcccucuaugaagcgcuuccggagagaggaagaggaagccggaguucugugguga

SEQ ID NO: 20074 - RNA, 9876 nt, Artificial Sequence
  derived and/or modified CDS sequence (opt5) from DENV-2__FJ410217__SS-prME
agcgccggcaugaucauuaugcugauccccaccgucauggcuuuccaccucacaacgagaaauggggaaccucauaugauugucggaauccaggaaaagggcaagagccugcuuuuuaagaccgaagacgggguuaauaugugcacacugauggccauggaucucggagaacugugugaagacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguauuguguccuggaagaauaaggagcucaaaugcggaagcggcaucuucgucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagccauaaccagacguuccugaucgacggcccugagaccgcggagugccccaauacaaacagagccuggaacucucucgaagucgaggauuauggguuuggaguguucaccacaaacauuuggcugcgccuuaaggaaaaacaggacgcuuuuugugacuccaagcugaugagcgccgcuaucaaggauaaucgggccguucacgcggacaugggcuacuggaucgagucugcccucaacgauaccuggaaaauugagaaggcuuccuucaucgaagugaaaaauugccauuggccuaagagccacacacuguggucuaacggcguccuggagagcgaaaugauuauccccaaaaaccuugccgggccggugucccaacacaauuauagaccuggauaccauacccagauugcuggccccuggcaccucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaccgcggcgaggacggcuguugguaugggauggaaaucagaccccugaaagagaaggaagagaaucucguuaacagccuggugaccgccggacauggccagguggauaauuucucccuggggguccuuggaauggcucucuuucuggaagagaugcugcggacaagagugggcaccaaacacgcgauccuccugguugccgugucuuucgucacacuuauuaccgggaacaugagcuuuaaggaccugggacgcgugguugugauggucggcgcuacgauggccgaugacaucggcaugggggugaccuaccucgcccugcuggcugccuucaaaguucggccuacauuugcggcuggacuucugcucagaaagcugaccuccaaggagcucaugaugacaaccauuggcaucgugcugcuuucucaaagcacgauucccgaaacaguccuggagcucaccgaugcccuggcccuggggaugauggugcuuaaaaucgugcgcaauauggaaaaguaucagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucuagaacaaauaagaaacgguccuggccgcucaacgaggccaucauggcugugggcauggucagcauucuggccucuucccuccugaagaaugacaucccuaugaccgggccccuuguggcgggaggccugcugacgguuugcuacgugcucacaggccgcagcgccgaucuggaacuugagagagcuaccgacgucaagugggaggaucaggccgaaauuucuggguccagcccuauccuguccauuaccaucagcgaggacggaucuaugagcauuaaaaacgaagaggaggaacagacacucaccauccugauccggacaggccuccuggugauuuccgggcuuuuucccaucucuauuccgaucacggcugccgccugguaucugugggaggucaagaaacagcgcgcuggagugcugugggauguuccuucucccccucccaugggcaaggcggaacucgaggacggggccuacagaauuaaacaaaagggaaucuucggcuauucccagaucggcgcugggguguacaaggaaggaaccuuucauacaauguggcacgucacccggggcgccgugcugaugcacaaagggaagcgcauugagcccuccugggccgauguuaaaaaggaccuuaucagcuacggaggcggguggaaacuggagggagaauggaaggagggcgaagaggugcagguccucgcucuggaaccuggcaagaauccgagagccgugcagacaaaacccgggcuguucaagaccaacacgggaaccauuggcgcggugucccuggauuuuucuccugggacaagcggaucccccaucauugacaaaaagggcaaaguugucgggcuuuauggaaacggcguggugacccggagcggcgcuuacgucucugccaucgcccaaacagagaaguccaucgaggauaauccugaaauugaggacgauaucuuccgcaagagacggcugaccauuauggaccugcaucccggggcuggaaaaacaaagagauaucucccugccaucgugcgcgaagcgauuaaacggggccugagaacgcuuauccuggcuccgacccgcguuguggccgccgagauggaagaggcucuccgggggcugcccauuagauaccagaccccugccauccgcgcugagcacaccggacgggaaaucgucgaccucaugugucaugccaccuucacaaugagacugcuuagccccgugcgcguuccuaacuauaaucugauuaucauggaugaggcgcacuuuacggaccccgccucuauugcugcccggggcuacaucuccaccagaguggaaaugggggaggcugccggcauuuucaugacagccaccccgccuggaagccgggaucccuuuccccaguccaacgcuccuaucaucgacgaggaacgcgagauucccgaaagaucuuggaauagcggccaugagugggucacagauuucaaggggaaaaccgugugguuuguuccuuccaucaaggcgggaaacgacauugccgcuugccugcggaagaauggcaaaaaggugauccaacucagccgcaaaacguucgauucugaauaugucaagacaagaaccaacgacugggauuuuguggugaccacagacauuuccgagaugggggccaauuucaaagccgagcgggucaucgauccgagacgcuguaugaagcccguuauccuggcugacggagaggaacgggugauucuugccggcccuaugcccgugacccacagcucugcggcucagagacgcgggcggaucggcagaaacccuaaaaaugaaaacgaccaguacauuuacaugggagagccccuggaaaaugaugaggacugcgcccacuggaaggaggccaagaugcuccuggauaacaucaauacaccggaaggcauuaucccuagcauguuugagcccgaacgcgagaaagucgacgcuauugauggggaauaucggcugagaggagaggcccgcaagaccuucguggaccucaugagacggggcgaucuuccuguuuggcuggcguacaaaguggccgcugaggggaucaacuaugccgaccgcagaugguguuuugauggaaucaagaacaaucagauucuggaagagaacgucgaaguggagaucuggacgaaagagggcgaacggaagaagcucaaaccccgcuggcuggacgcuagaauuuacuccgauccucuugcccugaaggaguucaaagaguucgcugccgggcggaagucucucacacugaaucugaucaccgagaugggcagacuccccacauuuaugacccagaagacgcgcgacgcgcuugauaaccuggccguucugcauaccgcugaagccggaggccgggcuuauaaucacgcccucagcgagcugccggagacacuugaaacccugcuccugcugacacuccuugccaccgugacagggggaauuuuccuguuucugauguccggcagagggaucggaaagaugacccucggcaugugcugcaucauuacggcuucuauccugcuuugguacgcgcagauucagccucauuggaucgccgcuagcauuauccuggaguucuuucucaucguccugcugauucccgaacccgagaagcagcgcacaccucaagacaaccagcucaccuauguggucaucgccauucuuaccgugguugccgcuacaauggccaaugaaaugggcuuccuggagaaaaccaagaaagaccuggggcucggauccaucgcgacacagcagccggagagcaacauucuggauaucgaccuucggcccgccucugcuuggacgcuguacgccguggcuaccacauuugugaccccuaugcucagacacuccauugaaaauagcuccgucaacguuucucugacagccaucgcgaaucaagccaccgugcugaugggccucgggaagggauggccccuuagcaaaauggauaucggcgugccucugcuggcuauuggguguuacucccaggucaaccccaucacgcucaccgccgcucugcuucugcucguggcccacuaugcuauuaucggaccuggccugcaggccaaggcgacacgggaggcccagaagcgcgcugccgcuggcauuaugaaaaauccgaccguugacgggaucacagugaucgaucuggaccccauuccuuacgaucccaaguucgaaaaacaacucggacaggucaugcuucugauccugugcgugacccagguccucaugaugagaacgacaugggcccugugugaggcccuuacccuggcgacaggcccuauuucuacccucugggaagggaaccccggacgguuuuggaauaccacaaucgcugugagcauggccaacauuuuccgcggcuccuaucuggcuggggccggacugcucuuuagcaucaugaagaauacgaccaacgccagacggggcacaggcaacaugggggagacccuuggagagaaauggaagucucgccugaaugcucugggcaaauccgaguuccaaaucuacaaaaagagcgggauucaggagguugacagaacacucgccaaagaaggaaucaagcggggcgagaccgaucaucacgcggugucucgcggguccgccaaacugagaugguuugucgagcggaacauggugacgccggaaggaaagguuguggaccuuggcugcggcagagggggauggagcuauuacuguggcgggcugaaaaauguccgcgaggugaagggacucacaaagggcgggccuggacaugaagaacccauucccaugucuaccuauggcuggaaccuggugcggcugcagagcggcguugaugucuucuucaucccucccgaaaaaugcgacacccuccuuugugauauuggggaguccucuccuaauccgacaguggaggcuggaagaacccugcgcgugcugaaccucgucgaaaauuggcugaacaauaacacacaguuuugcaucaagguucuuaaucccuacaugccuagcgugaucgagaaaauggaagcccugcaacggaaguacggcggggcucucgugagaaacccccugucccgcaauagcacgcacgagauguauugggucuccaacgccucuggaaauauugugagcuccguuaacaugaucucucggaugcugauuaacagauucaccaugcgccauaaaaaggcgacauacgaaccugacguggaccucggcagcgggacccggaauaucggaauugaguccgagauccccaaccuugauauuaucggcaagagaaucgagaagauuaagcaggagcacgaaacaucuuggcacuaugaccaggaucauccguacaaaaccugggccuaucacggcagcuacgagacgaagcagaccggguccgcuagcucuauggucaauggagugguucgccugcugacaaaaccuugggacgugcuccccaccgucacacaaauggccaugaccgauacaaccccuuuuggccagcagcggguguucaaggaaaagguggacacgagaacacaggagcccaaagaggggaccaagaaacugaugaagaucaccgcugaauggcuuuggaaagagcugggaaagaaaaagacaccucgcauguguacgagagaagaguuuacccggaagguccgcuccaacgccgcucucggcgccauuuucacagaugagaauaaauggaaaagcgcgagagaagccguugaggacucucgguuuugggaacugguggauaaagagagaaaccugcaucucgaagggaagugcgagaccuguguguauaauaugaugggaaaacgggagaagaagcugggcgaguucggcaaagcuaaggggucccgcgccaucugguacauguggcuuggagcuagauuucuggaguucgaagcccucggcuuucugaacgaggaccacugguucagccgggaaaauucucuuuccggggucgagggagagggccugcacaaacucggguacauucugcgcgaugugagcaagaaagaaggcggagccauguaugcggacgacacagcuggcugggauaccagaaucacacuggaggaccucaagaacgaagagaugguuaccaaucauauggaaggggagcacaagaaacuggccgaggccaucuuuaaacuuacguaccaaaacaaagugguccgggugcagcgccccaccccgagaggaacaguuauggauauuaucucccggcgcgaccagagaggcagcgggcaagugggaaccuauggccugaauacauucaccaacauggaagcucagcucauucggcagauggagggggaaggcgucuucaagaauauccagcaucugacggugacagaggagguugccgugcaaaacuggcuugcucgcgucggaagagaacggcugucucgcauggccauuagcggcgaugacugcguggucaaaccucucgaugacagauuugcgaacgcccugaccgcucugaaugauauggggaagauccggaaggacauccagcagugggagcccuccaaaggauggaacgauuggacacaggugcccuucugcucucaccauuuucacgaacucauuaugaaggacggcagaguucugguggucccuugucgcaaucaagaugagcuuaucgggcgggccagaauuagccagggagcuggcuggucccugcgcgaaaccgccugccucgggaaaucuuacgcgcagauguggagccugauguauuuccaccggagagaccuucgccuggccgcuaacgccaucuguuccgcugugccgucucauugggugcccacgagccggaccacaugguccauucacgccaagcaugaguggaugaccacagaggacaugcucaccguuuggaauagaguguggauccgcgaaaacccuuggauggaggauaaaacacccgucgaaagcugggaggaaauuccuuaccugggcaagcgggaggaccaguggugcggaucucugaucggccucaccuccagagcuacgugggccaagaauauccaagcggccauuaaccaggugcgcagccugaucgggaaugaggaauauacagauuacaugcccucuaugaaacgguuuagacgggaggaagaggaagcuggaguucuuugguga

SEQ ID NO: 20075 - RNA, 9876 nt, Artificial Sequence
  derived and/or modified CDS sequence (opt5) from DENV-2__FJ410219__SS-prME
agcgccggcaugaucauuaugcugauccccaccgugauggcuuuccaccucacaacgagaaacggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagagcaggacaagcgguuugugugcaagcauagcaugguggaucgcggcuggggcaauggguguggacuguucggcaaagggggaauugucaccugcgcuauguuuacaugcaagaaaaacauggaaggcaagaucguucagccugagaaucucgaauacacgauuguggugaccccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccuuauguccucuggcaaucugcucuuuaccggacaucugaagugccgccuuagaauggacaaacugcaacucaagggcaugagcuacuccauguguacagggaaguucaaaguggucaaggagauugcugagacccagcacggaaccaucgugauucggguucaguaugaaggcgaugggagccccugcaaaauccccuucgagaucauggaccuggaaaagagauacgugcugggacgccucauuacagucaacccuaucgugacggagaaagauucuccgguuaacauugaagcggagcccccuuuuggcgacuccuacaucauuaucgggguggagcccggccagcugaagcuuaauugguucaagaaaggaagcucuauuggccaaauguuugaaaccacaaugcggggggccaagagaauggcuauccugggagauaccgccugggacuucggcagccucgggggagucuuuacauccaucggcaaagcccugcaucagguguucggggcuauuuauggcgccgcguuuucuggagugagcuggaccaugaagauccugauuggcguuaucauuacguggaucgggaugaacucccgcagcacaucucuuuccgucagccucgugcuggugggaaucgucacccuguaccucggcgugaugguucaggcugauucuggguguguggucuccuggaaaaauaaggagcugaagugcggaagcggcauuuucaucaccgacaacgugcacacauggaccgaacaguauaaauuucaaccugagucccccucuaagcuugccagcgccauucagaaagcucaggaagaggggaucuguggcauucgguccguuacaagacuggagaaucucauguggaagcagaucacgccggaacugaaccacauccuggccgagaaugaagugaaacuuaccauuaugacaggagauaucaagggcauuaugcaagcugggaaacgcuuccuccggccucagcccaccgagcugaaguacucuuggaagacauggggaaaagccaagaugcugagcaccgaauccuauaaccagacguuucucaucgacggcccugagaccgcggagugccccaauacaaacagagccuggaauagccuggaagucgaggauuacggguucggaguguuuaccacaaacauuuggcuuaaacugaaggaaaaacaggacgcuuucugugacucuaagcucauguccgccgcuaucaaggauaaucgcgccguucaugcggacaugggcuauuggaucgagagcgcccugaacgauaccuggaaaauugagaaggcuucuuucaucgaagugaaaaauugccacuggccuaagucccauacacuguggagcaacggcguccuugagucugaaaugauuauccccaaaaaccucgccgggccggugagccaacacaauuaccggccuggauaccacacccagauugcuggccccuggcaucuggggaagcuggagauggacuuugauuucugugacggaacgacagugaucgucaccgaagauugcggcaacagagggcccucccuccgcaccacaaccgccagcggaaagcugauuacggaguggugcugucggucuugcacacuuccuccgcugagauaucggggcgaggacggcuguugguacgggauggaaauccgcccccucaaagagaaggaagagaaucugguuaacucccuggugaccgccggacacggccagguggauaauuuuagccuugggguccucggaauggcucuguuccuggaagagaugcucagaacacgggugggcaugaaacaugcgauccugcuuguugccguguccuuugucacccugauuacagggaacaugucuuucaaggaccucggaagagugguugugauggucggcgcuaccaugacggaugacaucggcaugggggugaccuaucuggcccugcuugccgcuuuuaaaguucgcccuacauucgccgcgggacugcuccugcggaagcucaccagcaaggagcugaugaugauuacaaucggcauugugcuucugucccaaucuaccauccccgaaacgguccucgagcugacagaugcucuggcccuugggaugauggugcugaaaaucgugagaaauauggaaaaguaccagcucgccgucaccauuauggcuauccugugcguuccuaacgccgugauucuccagaaugcguggaaagugagcuguacaauccuggcugucguguccguuucuccccuucugcucaccagcucccagcaaaagaccgacuggauuccucuggcccugacaaucaaaggacuuaaccccacggccaucuuucugaccacacucagccgcaccaauaagaaaagaucuuggccgcugaacgaggcuauuauggccgugggcauggucuccauccucgcuagcucucugcuuaagaaugacauuccuaugacagggccccugguggccggaggccugcucaccguuugcuaugugcugacgggccgguccgcggaucuugaacuggagcgcgucacagacgugaagugggaggaucaggccgaaaucagcgggucuuccccuauucucagcaucaccauuuccgaggacggaagcaugucuaucaaaaacgaagaggaggaacagacccugacaauccucauuagaaccggccugcuugucaucagcgggcuguuccccauuuccaucccgauuacagcugccgcuugguaccugugggaggugaagaaacagcgggccggaguucucugggaugugccuucucccccucccaugggcaaggccgaacuggaggacggggcuuaucgcaucaaacaaaagggaauccuuggcuacagccagauuggcgcgggggucuacaaggaaggaacguuucacaccauguggcaugugacaagaggcgccguucugaugcacaaagggaagcggaucgagcccuccugggcugaugugaaaaaggaccucauuucuuauggaggcggguggaaacuggagggagaauggaaggagggcgaagagguccaggugcucgcccuggaaccuggcaagaauccgcgcgccgugcagaccaaacccgggcuuuucaagacaaacaccggaacgaucggcgcuguuagccuggauuuuuccccugggaccucuggaagccccauuaucgacaaaaagggcaaagucguggggcuguacggaaacggcguggucacaagauccggcgccuaugugagcgcgaucgcucaaaccgagaagucuauugaggauaauccugaaaucgaggacgauauuuuccggaagcgcagacucacaaucauggaccugcaccccggggccggaaaaaccaagcgguaccuuccugccauuguuagagaagcuaucaaacgcggccugcggacacucauucuggccccgacgagaguggucgcggcugagauggaagaggcccuccgcgggcugcccauccgguaucagaccccugccaucagagcugagcauacaggacgcgaaauuguggaccuuaugugucacgccaccuucaccaugcggcugcugucccccguuagagugccuaacuacaaucucaucauuauggaugaggcucauuuuacagaccccgccagcaucgcggcccgcggcuauauuucuacgcgggucgaaaugggggaggcugccggcaucuucaugaccgcuacaccgccuggauccagagaucccuuuccccagagcaacgccccuaucauugacgaggaacgggagauccccgaacgcuccuggaauucuggccacgagugggugaccgauuucaaggggaaaacaguuugguuugugccuagcauuaaggccggaaacgacaucgcugcgugccugagaaagaauggcaaaaaggucauucaacuuucccggaaaaccuucgauagcgaauacgugaagacgcgcacaaacgacugggauuuuguggucaccaccgacaucucugagaugggggccaauuucaaagcugagagaguuaucgauccgcggagauguaugaagcccgugauucugacagacggagaagagcgcgugauccucgccggcccuaugcccgucacccauuccagcgccgcucagcggagagggcgcauuggccggaacccuaaaaaugaaaacgaccaguacaucuauaugggagagccccuggaaaaugaugaggacugcgcccacuggaaggaggcgaagaugcugcucgauaacauuaauacaccggaaggcaucauuccuucuauguuugagcccgaaagagagaaaguggacgcuaucgauggggaauaccgccuucggggagaggccagaaagaccuucguugaccugaugcgcagaggcgaucugccuguguggcucgccuauaaagucgcugccgaggggaucaacuacgcggaccggcgcugguguuuugauggaauuaagaacaaucagauccuggaagagaacguggaaguugagauuuggacgaaagagggcgaaagaaagaagcuuaaaccccgguggcuggacgcccgcaucuauagcgauccucucgcucugaaggaguucaaagaauucgccgcugggagaaagucccugacacucaaucuuauuaccgagaugggccggcugcccacauuuaugacccaaaaaacgagagacgcccuggauaaccucgcugugcugcacaccgccgaagcgggaggccgcgccuacaaucaugcucuuucugagcugccggagacacucgaaacccugcugcuccuuacacugcuggccaccgucacagggggaaucuuccucuuucugaugagcggccgggggaucggaaagaugacccuuggcaugugcugcauuaucacggcuuccauucugcucugguaugcccagauccagccucacuggauugccgcuucuaucauccuggaguucuuucugauugugcuccuuauccccgaacccgagaagcagagaacaccucaagacaaccagcugaccuacgucgugauugcgauccugaccguuguggccgcuacaauggccaaugaaaugggcuuccucgagaaaaccaagaaagaccuggggcuuggaagcauugccacacagcagccggaguccaacauccuggauauugaccuccgccccgcuagcgccuggacgcuguacgcgguggccaccacauuugucaccccuaugcugcggcauucuaucgaaaauuccagcguuaacgugucccucacagcuaucgccaaucaagcuaccgugcuuaugggccuggggaagggauggccccugucuaaaauggauauuggcgucccucuccuggccaucggguguuauagccaggugaaccccauuacgcuuaccgcggcccugcuccugcugguugcucacuacgccaucauuggaccuggccuccaggcuaaggccacaagagaggcucagaagcgggccgcggccggcaucaugaaaaauccgaccguggacgggaucacagucauugaucuugaccccaucccuuaugaucccaaguucgaaaaacaacugggacaggugaugcugcucauucugugcgucacccaggugcuuaugaugcgcacgacaugggcucugugugaggcccucacccuggcuacaggcccuaucuccacccugugggaagggaaccccggaagauuuuggaauaccacaauugccguuucuauggccaacaucuuccggggcagcuaccucgcgggggcuggacuucuguuuuccaucaugaagaauacgaccaacacacgcagaggcaccggcaacaugggggagacacugggagagaaauggaagagccggcucaaugcccugggcaaaucugaauuccaaauuuauaagaaguccgggauccaggagguggaccgcacccuugcuaaagaaggaauuaagagaggcgagacggaucaccaugccgucagccgggggucugccaaacugcgcugguuuguggagagaaacaugguuacaccggaaggaaagguggucgaccucggcugcggccgggggggaugguccuacuauuguggcgggcugaaaaaugugagagaggugaagggacugaccaagggcgggccuggacacgaagagcccauccccaugagcaccuacggcuggaaccucguucgccuucagucuggcgucgauguguucuucauuccucccgaaaaaugcgacacacugcugugugauaucggggagagcuccccuaauccgaccguggaggcuggacggacacucagaguccugaaccuuguugaaaauuggcugaacaauaacacgcaguuuugcaucaaggugcucaaucccuacaugccuucugugauugagaaaauggaagcccugcaacgcaaguauggcggggcgcugguccggaacccccucagcagaaauuccacccaugagauguacugggugagcaacgccuccggaaauaucguuucuagcgugaacaugauuucccgcaugcuuaucaaccgguucacaaugagacacaaaaaggcuaccuaugaaccugacgucgaccugggcucugggacacgcaauauuggaaucgagagcgagauucccaaccuggauaucaucggcaagcggauugaaaaaaucaagcaggagcaugaaaccuccuggcacuacgaccaggaucacccguauaaaacgugggccuaccauggcucuuaugagaccaagcagacagggagcgcuuccagcauggugaauggaguugugagacuccugaccaaaccuugggacguccuucccacagugacccaaauggccaugacagauaccacgccuuuuggccagcagcgcguguucaaggaaaaggucgacacacggacccaggagcccaaagaggggaccaagaaacugaugaagauuacagcggaauggcucuggaaagagcugggaaagaaaaagacgccuagaauguguacccgcgaagaguuuacaagaaagguucggucuaacgccgcucugggcgccaucuucaccgaugagaauaaauggaaguccgcucgcgaagccguggaggacagcagauuuugggaacucguggauaaagagcggaaccugcaccuugaagggaagugcgagacaugugucuacaauaugaugggaaaaagagagaagaagcugggcgaauucggcaaagcuaaggggucucgggccauuugguacauguggcucggagcgcgcuuucuggaguucgaagcccuuggcuuucugaacgaggaccauugguucuccagagaaaauagccucucugggguggagggagagggccugcacaaacugggguauauccuccgggauguuuccaagaaagaaggcggagcuauguacgccgacgacaccgcuggcugggauacacgcaucacccuggaggaccuuaagaacgaagagauggugacgaaucacauggaaggggagcauaagaaacuggccgaggccauuuuuaagcucaccuaucaaaacaaagucgugagaguucagcggcccacaccgcgcggaaccgugauggauaucauuagcagacgggaccagcgcggcuccgggcaagucggaacauacggccugaauaccuucacgaacauggaagcgcagcuuaucagacagauggagggggaaggcguguucaagaauauucagcaccugacaguuaccgaggagguggcugucaaaaacuggcucgcccgggugggacgcgaaagacugagccggauggccaucucuggcgaugacugcgucgugaagccucuggaugaccgcuuugcuaacgcccucacagcucugaaugauauggggaagaucagaaaagacauucaacagugggagcccagcaagggauggaacgauuggacccagguucccuucugcucccaucacuuucaugaacuuaucaugaaagacggccgggugcuggucgugccuuguagaaaucaggaugagcucauugggcgcgcccggaucucucaaggagcgggcuggagccugagagaaacggccugccuugggaaguccuaugcucagauguggucucugauguacuuccaccgccgggaccucagacuggccgcuaacgccauuuguagcgcggugccgucccacuggguucccaccucucgcacaaccuggagcauccaugccaaacacgaguggaugacaaccgaggacaugcugacaguguggaaucgggucuggauuagagaaaacccuuggauggaggauaagacccccguggaauccugggaggaaaucccuuaucucggcaagcgcgaggaccaguggugcggaagccugaucggccuuacgucucgggcuacaugggccaaaaauauucaggcugccaucaaccaaguuagaucccugauugggaaugaggaauacaccgauuacaugcccagcaugaagcgcuuucggagagaggaagaggaagcuggagugcucugguga

SEQ ID NO: 20076 - RNA, 9876 nt, Artificial Sequence
  derived and/or modified CDS sequence (opt5) from DENV-2__FJ461314__SS-prME
agcgccggcaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggacccugaagauccugauuggcguuaucauuacguggaucgggaugaacucccgcagcacaucucuuuccgucagccucgugcuggugggaaucgucacccuguaccucggcgugaugguucaggcugauucuggguguguggucuccuggaaaaauaaggagcugaagugcggaagcggcauuuucaucaccgacaacgugcacacauggaccgaacaauauaaauuucagccugagucccccucuaaacuugccagcgccauucagaaagcucaggaagaggggaucuguggcauucgguccguuacaagacuggagaaucucauguggaagcaaaucacgccggaacugaaccacauccuggccgagaaugaagugaaacuuaccauuaugacaggagauaucaagggcauuaugcaggcugggaaacgcucucuccggccucagcccaccgagcugaaguacagcuggaagacauggggaaaagccaagaugcuguccaccgaaagcuauaaccagacguuccucaucgacggcccugagaccgcggagugccccaauacaaacagagccuggaacucucuggaagucgaggauuacggguuuggaguguucaccacaaacauuuggcuuaaacugaaggaaaaacaagacgcuuuuugugacuccaagcucaugagcgccgcuaucaaggauaaucgcgccguucaugcggacaugggcuauuggaucgagucugcccugaacgauaccuggaaaauugagaaggcuuccuucaucgaagugaaaaauugccacuggccuaagagccauacacuguggucuaacggcguccuugagagcgaaaugauuauccccaaaaaccucgccgggccggugucccagcacaauuaccggccuggauaccacacccagauugcuggccccuggcaucuggggaagcuggagauggacuucgauuuuugugacggaacgacagugaucgucaccgaagauugcggcaacagagggcccagccuccgcaccacaaccgccucuggaaagcugauuacggaguggugcugucgguccugcacacuuccuccgcugagauaucggggcgaggacggcuguugguacgggauggaaauccgcccccucaaagagaaggaagagaaucugguuaacagccuggugaccgccggacacggccaaguggauaauuucucccuugggguccucggaauggcucuguuucuggaagagaugcucagaacacgggugggcaccaaacaugcgauccugcuuguugccgugucuuucgucacacugauuaccgggaacaugagcuuuaaggaccucggaagagugguugugauggucggcgcuacgauggccgaugacaucggcaugggggugaccuaucuggcccugcuugcugccuucaaaguucgcccuacauuugcggcuggacugcuccugcggaagcucaccuccaaggagcugaugaugacaaccauuggcaucgugcuucugucucagagcacgauucccgaaacaguccucgagcugaccgaugcccuggcccuugggaugauggugcugaaaaucgugagaaauauggaaaaguaccagcucgcugucacaaucauggccauucugugcguuccuaacgcggugauccuccagaaugcuuggaaaguguccuguaccauucuggccgucgugucuguuagcccccuucugcucaccuccagccaacagaagacagacuggaucccucuggcccugacgauuaaaggacuuaaccccaccgcuaucuuccugacaacccucucucgcacaaauaagaaaagauccuggccgcugaacgaggccaucauggcugugggcauggucagcauucucgccucuucccugcuuaagaaugacaucccuaugaccgggccccugguggcgggaggccugcucacgguuugcuaugugcugacaggccggagcgccgaucuugaacuggagcgcgcuaccgacgucaagugggaggaucaggccgaaauuucuggguccagcccuauccucuccauuaccaucagcgaggacggaucuaugagcauuaaaaacgaagaggaggaacagacacugaccauccucaucagaacaggccugcuugugauuuccgggcuguuucccaucucuauuccgaucacggcugccgccugguaccugugggaggucaagaaacaacgggcuggagugcucugggauguuccuucucccccucccaugggcaaggcggaacuggaggacggggccuaucgcauuaaacagaagggaauccuuggcuacucccagaucggcgcugggguguacaaggaaggaaccuuccacacaauguggcaugucaccagaggcgccgugcugaugcacaaagggaagcggauugagcccuccugggccgauguuaaaaaggaccucaucagcuauggaggcggguggaaacuggagggagaauggaaggagggcgaagaggugcagguccucgcucuggaaccuggcaagaauccgcgcgccgugcaaacaaaacccgggcuuuuuaagaccaacacgggaaccauuggcgcggugucccuggauuucucuccugggacaagcggaucccccaucauugacaaaaagggcaaaguugucgggcuguacggaaacggcguggugaccagaagcggcgcuuaugucucugccaucgcccagacagagaaguccaucgaggauaauccugaaauugaggacgauaucuuucggaagcgcagacucaccauuauggaccugcaccccggggcuggaaaaacaaagcgguaccuuccugccaucgugagagaagcgauuaaacgcggccugcggacgcucauccuggcuccgaccagaguuguggccgccgagauggaagaggcucuccgcgggcugcccauucgguaucagaccccugccaucagagcugagcauaccggacgcgaaaucgucgaccuuaugugucacgccaccuucacaaugcggcugcugagccccgugagaguuccuaacuacaaucucauuaucauggaugaggcgcauuucacggaccccgccucuauugcugcccgcggcuauaucuccacccggguggaaaugggggaggcugccggcauuuuuaugacagccaccccgccuggaagcagagaucccuucccccaauccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccugagaaagaauggcaaaaaggugauccagcuuagccggaaaacguuugauucugaauacgucaagacacgcaccaacgacugggauuucguggugaccacagacauuuccgagaugggggccaauuuuaaagccgagagagucaucgauccgcggagauguaugaagcccguuauccugaccgacggagaggaacgcgugauucucgcuggcccuaugcccgugacacauagcucugccgcgcagcggagagggcgcaucggccggaacccuaaaaaugaaaacgaccaguacauuuauaugggagagccccuggaaaaugaugaggacugcgcucacuggaaggaggccaagaugcugcucgauaacaucaauaccccggaaggcauuaucccuagcauguucgagcccgaaagagagaaagucgacgccauugauggggaauaccgccuucggggagaggcuagaaagacguuuguggaccugaugcgcagaggcgaucugccuguuuggcucgccuauaaaguggcggccgaggggaucaacuacgcugaccggcgcugguguuucgauggaaucaagaacaaucaaauucuggaagagaacgucgaaguggagaucuggacaaaagagggcgaaagaaagaaacuuaaaccccgguggcuggacgcccgcauuuauuccgauccucucgcucugaaggaguuuaaagaguucgccgcugggagaaagucucugacccucaaucuuaucacagagaugggccggcugcccaccuucaugacgcagaaaaccagagacgcccuggauaaccucgcgguucugcacacagccgaagcuggaggccgcgccuacaaucaugcucuuagcgagcugccggagacccucgaaacacugcugcuccuuacccugcuggccacagugaccgggggaauuuuucucuuccugauguccggccgggggaucggaaagaugacgcuuggcaugugcugcaucauuacagccucuauccugcucugguaugcucagauucagccucacuggaucgcggccagcauuauccuggaguuuuuccugaucguccuccuuauucccgaacccgagaagcaaagaaccccucaggacaaccagcugaccuacguggucaucgcuauucugacagugguugccgccaccauggcuaaugaaaugggcuuucucgagaaaacaaagaaagaccuggggcuuggauccaucgccacgcagcaaccggagagcaacauucuggauaucgaccuccgccccgcgucugccuggacccuguacgcuguggccacaaccuucgugacaccuaugcugcggcauuccauugaaaauagcuccgucaacguuucucucaccgcuaucgccaaucaggcgacggugcuuaugggccuggggaagggauggccccugagcaaaauggauaucggcgugccucuccuggccauuggguguuauucccaggucaaccccaucacccuuacagcugcccugcuccugcugguggcucacuacgccauuaucggaccuggccuccaggcuaaggccaccagagaggcgcaaaagcgggccgcugccggcauuaugaaaaauccgacaguugacgggaucaccgugaucgaucuugaccccauuccuuaugaucccaaguuugaaaaacagcugggacaggucaugcugcucauccugugcgugacgcaaguccuuaugaugcgcacaaccugggcucugugugaggcccucacacuggccaccggcccuauuucuacccugugggaagggaaccccggaagauucuggaauacaacgaucgcggugagcauggcuaacauuuuucggggcuccuaccucgccggggcuggacuucuguucagcaucaugaagaauaccacaaacacccgcagaggcacaggcaacaugggggagacccugggagagaaauggaagucucggcucaauacgcugggcaaauccgaauuucagaucuauaaaaagagcgggauucaggagguugaccgcacacuugccaaagaaggaaucaagagaggcgagaccgaucaccaugccgugucucggggguccgcuaaacugcgcugguucgucgagagaaacauggugaccccggaaggaaagguuguggaccucggcugcggcagagggggauggagcuacuauuguggcgggcugaaaaauguccgggaggugaagggacugacaaagggcgggccuggacacgaagaacccauucccaugucuaccuacggcuggaaccucgugcgccuucagagcggcguugaugucuuuuucaucccucccgaaaaaugcgacacacugcugugugauauuggggaguccucuccuaauccgacgguggaggccggacggacccucagagugcugaaccuugucgaaaauuggcugaacaauaacacacaauucugcaucaagguucucaaucccuacaugccuagcgugaucgagaaaauggaagcgcugcagcgcaaguauggcggggcccuggugcggaacccccucuccagaaauagcacccaugagauguacugggucuccaacgcuucuggaaauauugugagcuccguuaacaugaucucucgcaugcuuauuaaccgguuuacaaugagacacaaaaaggccaccuaugaaccugacguggaccugggcagcgggacgcgcaauaucggaauugaguccgagauccccaaccuggauauuaucggcaagcggaucgagaagauuaagcaggagcaugaaaccucuuggcacuacgaccaggaucacccguauaaaacaugggcuuaccauggcagcuaugagaccaagcaaacaggguccgccagcucuauggucaauggagugguuagacuccugaccaaaccuugggacgugcuucccacagucacccagauggcgaugacggauacaaccccuuucggccagcagcgcguguuuaaggaaaagguggacacccggacacaagagcccaaagaggggacgaagaaacugaugaagaucaccgccgaauggcucuggaaagagcugggaaagaaaaagacaccuagaauguguacccgcgaagaguucacaagaaagguccgguccaacgcugcccugggcgcuauuuuuaccgaugagaauaaauggaaaagcgcccgcgaagcuguugaggacucuagauucugggaacucguggauaaagagcggaaccugcaccuugaagggaagugcgagacauguguguacaauaugaugggaaaaagagagaagaagcugggcgaauuuggcaaagccaaggggucccgggcgaucugguacauguggcucggagcccgcuuccuggaguuugaagcucuuggcuuccugaacgaggaccauugguuuagcagagaaaauucucucuccggggucgagggagagggccugcacaaacugggguauauucuccgggaugugagcaagaaagaaggcggagccauguacgcugacgacaccgccggcugggauacgcgcaucacccuggaggaccuuaagaacgaagagaugguuacaaaucacauggaaggggagcauaagaaacuggccgaggcgaucuucaagcucaccuaucagaacaaaguggucagagugcagcggcccacaccgcgcggaaccguuauggauauuaucuccagacgggaccaacgcggcagcgggcaggucggaacguacggccugaauacauuuaccaacauggaagcucagcuuauuagacagauggagggggaaggcgucuucaagaauauccaacaccugacagugaccgaggagguugccgugcagaacuggcucgcccgggucggacgcgaaagacugucucggauggcuauuagcggcgaugacugcguggucaaaccucuggaugaccgcuucgccaacgcucucacggcccugaaugauauggggaagaucagaaaggacauccagcagugggagcccuccaaaggauggaacgauuggacccaagugcccuuuugcucucaucacuuccaugaacuuauuaugaaggacggccggguucugguggucccuuguagaaaucaggaugagcucaucgggcgcgcgcggauuagccagggagccggcuggucccugagagaaacagcuugccuugggaaaucuuaugcccagauguggagccugauguacuuucaccgccgggaccucagacuggcugccaacgcgaucuguuccgccgugccgucucacugggugcccaccagccgcacaaccugguccauucaugcuaagcacgaguggaugacaaccgaggacaugcugacgguuuggaaucggguguggaucagagaaaacccuuggauggaggauaaaacacccgucgaaagcugggaggaaauuccuuaucucggcaagcgcgaggaccaauggugcggaucucugaucggccuuaccucccgggccaccugggcuaagaauauccaggccgcuauuaaccaggugagaagccugaucgggaaugaggaauacacagauuacaugcccucuaugaaacgcuuccggagagaggaagaggaagccggaguucucugguga

SEQ ID NO: 20077 - RNA, 9876 nt, Artificial Sequence
  derived and/or modified CDS sequence (opt5) from DENV-2__FJ410221__SS-prME
agcgccggaaugaucauuaugcugauccccaccgugauggcuuuccaccugaccacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaaugaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucggaggggucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuaucauggccgaugacauuggcaucggggugacguaucucgcccugcuggcugccuucaagguucgcccuaccuuugcggcuggacuucugcuccggaagcugacauccaaagagcucaugaugaccacaauuggcaucgugcugcuuucucaaagcaccauccccgaaacgguccuggagcucacagaugcccuggcccuggggaugauggugcuuaagauugugagaaauauggaaaaauaccagcuggcugucaccaucauggccauucucugcguuccuaacgcggugauccugcagaaugcuuggaagguguccuguacaauucucgccgucgugucuguuagcccccugcuucugaccuccagccagcagaagaccgacuggaucccucucgcccugacaaucaagggacugaaccccacggcuauuuuccuuaccacacugucucgcaccaauaaaaagagauccuggccgcucaacgaggccaucauggcugugggcauggucagcauucuggccucuucccuccugaagaaugacaucccuaugacagggccccuuguggcgggaggccugcugaccguuugcuaugugcucacgggccggagcgccgaucuggaacuugagcgcgcuacagacgucaaaugggaggaucaggccgaaauuucuggguccagcccuauccuguccauuaccaucagcgaggacggaucuaugagcaucaagaacgaagaggaggaacagacccucacaauucugaucagaaccggccuccuggugauuuccgggcuuuuucccaucucuauuccgaucacagcugccgccugguaccugugggaggucaaaaagcagcgggcuggagugcugugggauguuccuucucccccucccaugggcaaagcggaacucgaggacggggccuaucgcaucaagcaaaaggggauucugggcuacucccagaucggcgcugggguguacaaagaaggaacguuccacaccauguggcaugucacaagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagaccaagcccgggcuguuuaaaacaaacaccggaacgauuggcgcggugucccuugauuucucuccugggaccagcggaucccccaucaucgacaagaaaggcaagguugucgggcuguacggaaacggcguggugacaagaagcggcgcuuaugucucugccauugcccaauccgaaaagagcaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacccugauccucgcuccgacaagaguuguggccgccgagauggaagaggcucugcgcgggcuccccauccgguaucagacgccugccauuagagucgagcauaccggacgcgaaaucguggaccugaugugucacgcuacauucaccaugcggcuucugucucccguuagagugccuaacuacaaucugauuaucauggaugaggcccauuucaccgaccccgcguccauugccgcucgcggcuauaucagcacacgggucgaaaugggggaggccgcuggcaucuuuaugacggccaccccgccuggauccagagaucccuucccccagucuaacgccccuauuaucgacgaggaacgggagauucccgaacgcagcuggaacuccggccacgagugggugacagauuuuaaagggaagaccguuugguucgugccuagcaucaaggcuggaaacgacauugcggccugccuccgcaaaaauggcaagaaagucauccaacugucucggaagacauuugauuccgaauacgugaaaacccgcacgaacgacugggauuucguggucacaaccgacaucagcgagaugggggcuaauuuuaaggccgagagaguuauugauccgcggagauguaugaaacccgugauccuuaccgacggagaggaacgcgugauucuggccggcccuaugcccgucacacauucuagcgcugcccagcggagagggcgcaucggccggaacccuaagaaugaaaacgaccaguacauuuauaugggagagccccucgaaaaugaugaggacugcgcgcacuggaaggaggcuaaaaugcugcuggauaacaucaauaccccggaaggcauuaucccuuccauguucgagcccgaaagagagaagguggacgccaucgauggggaauaccgccuccggggagaggccagaaaaacauuuguugaccuuaugcgcagaggcgaucugccuguguggcuggcuuauaaggucgccgcggaggggauuaacuacgccgaccggcgcugguguuucgauggaaucaaaaacaaucagauucucgaagagaacguggaaguugagaucuggaccaaggagggcgaaagaaagaaacugaagccccgguggcuugacgcucgcauuuauucugauccucuggcccucaaagaguuuaaggaguucgcugccgggagaaaaagccugacgcugaaucucaucacagagaugggccggcuucccaccuucaugacacaaaagaccagagacgcucuggauaaccuggccgugcuccacacggcggaagccggaggccgcgcuuacaaucaugcccuguccgagcuuccggagacccuggaaacacuccugcugcucacccuucuggcuacagucaccgggggaaucuuucuguuccucaugucuggccgggggauuggaaagaugacacugggcaugugcugcaucauuaccgccagcauccuucugugguaugcccagauucagccucacuggaucgcugcguccaucauucucgaguuuuuccugaucgugcugcucauucccgaacccgagaaacagagaacgccucaagacaaccagcuuacauacgucgugaucgccauucugaccguuguggcugccaccauggccaaugaaaugggcuuucuggagaagaccaagaaggaccucgggcugggaagcaucgcuacccagcagccggagucuaacauucuugauaucgaccugcgccccgccuccgcguggacacucuacgccguggcuacgaccuucgucacaccuaugcugcggcauagcaucgaaaauuccucuguuaacgugagccugaccgccauugcuaaucaagccacagugcucaugggccuugggaaaggauggccccuguccaagauggauaucggcgucccucugcucgcgauuggguguuauucucaggugaaccccaucacccugacggccgcccuucugcuccugguugcccacuacgcuauuaucggaccuggccugcaggccaaggcuaccagagaggcccagaaacgggcggccgcuggcaucaugaagaauccgacaguggacgggauuaccgucaucgaucucgaccccauuccuuaugaucccaaauuugaaaagcaacuuggacaggugaugcugcugauccucugcgucacacaggugcugaugaugcgcaccacgugggcccuuugugaggcucugacacucgccaccggcccuauuagcacacugugggaagggaaccccggaagauucuggaauaccaccaucgccguuuccauggcgaacaucuuucggggcagcuaccuggcuggggccggacuccuuuucucuauuaugaaaaauacaacgaacacccgcagaggcacaggcaacaucggggagacccugggagagaaguggaaaucccggcugaaugcucucggcaagagcgaauuucaaauuuauaagaaaucugggauccaggagguggaccgcacacuggccaaggaaggaauuaaaagaggcgagaccgaucaccaugccgucucccgggggagcgcuaaacuucgcugguucguggagagaaacaugguuacgccggaaggaaaaguggucgaccugggcugcggcagagggggauggucuuacuauuguggcgggcucaagaaugugcgggaggugaagggacugacaaaaggcgggccuggacacgaggaacccauccccaugagcaccuacggcuggaaccugguucgccuccaguccggcgucgauguguuuuucaucccucccgaaaagugcgacacccuucugugugauauuggggagucuagcccuaauccgacaguggaggccggacggacccugagaguccucaaccugguugaaaauuggcuuaacaauaacacacaguucugcaucaaagugcugaaucccuacaugccuuccgugauugagaagauggaagcgcuccaacgcaaauauggcggggcccugguccggaacccccugagcagaaauuccacgcaugagauguacugggugucuaacgcuagcggaaauaucguuuccucugugaacaugauuagccgcaugcucaucaaccgguuuaccaugagacacaagaaggccacauaugaaccugacgucgaccuuggcuccgggacccgcaaugugggaauugagucugagauccccaaccuggauaucauuggcaaacggaucgaaaagauuaaacaggagcaugaaacaagcuggcacuacgaccaggaucacccguauaagaccugggcuuaccauggcuccuaugagacgaaacagaccgggagcgccucuuccaugguuaauggaguggucagacugcucacaaagccuugggacgugcugcccaccgugacacaaauggcgaugaccgauacaaccccuuucggccagcagcgcgucuuuaaggaaaaaguugacacgcggacacaggagcccaaggaggggaccaagaaacuuaugaaaaucaccgccgaauggcuguggaaagagcucggcaagaagaagacaccuagaauguguacgcgcgaagaguucaccagaaaagugcggagcaacgcugcccugggcgcuauuuuuacagaugagaauaaguggaaaucugcccgcgaagcuguggaggacuccagauucugggaacuggucgauaaggagcggaaccuccaccuggaagggaaaugcgagaccuguguguacaauaugaugggaaagagagagaagaaacuuggcgaauuuggcaaggccaaagggagccgggcgaucugguacauguggcugggagcccgcuuccucgaguuugaagcucugggcuuccuuaacgaggaccauugguuuucuagagaaaauucccugagcgggguugagggagagggccuccacaagcugggguauauccugcgggauguguccaaaaaggaaggcggagccauguacgcugacgacacagccggcugggauacccgcauuacacucgaggaccugaagaacgaagagauggucaccaaucacauggaaggggagcauaagaaacuugccgaggcgaucuucaaacugacguaucaaaacaaagugguuagagugcagcggcccaccccgcgcggaacagucauggauauuaucagcagacgggaccagcgcggcucugggcaagugggaaccuacggccucaauacauuuaccaacauggaagcucagcugauuagacagauggagggggaaggcguuuucaaaaauauccagcaccuuacggugacagaggaggucgccgugcaaaacuggcuggcccgggucggacgcgaaagacucagccggauggcuaucuccggcgaugacugcgugguuaagccucuggaugaccgcuucgccaacgcucugaccgcccucaaugauauggggaagauuagaaaagacauccagcagugggagcccucuaagggauggaacgauuggacacaggugcccuuuugcagccaucacuuccaugaacugauuaugaaagacggccggguccuuguggugccuuguagaaaucaagaugagcugaucgggcgcgcgcggauuucccagggagccggcuggucucucagagaaaccgcuugccugggaaagagcuaugcccagauguggucccuuauguacuuucaccgccgggaccugagacucgcugccaacgcgaucuguucugccguuccgagccacugggugcccacgucccgcaccacauggagcauucaugcuaaacacgaguggaugaccacagaggacaugcugaccgucuggaaucggguguggaucagagaaaacccuuggauggaggauaagacacccguugaaucuugggaggaaaucccuuaucugggcaagcgcgaggaccaguggugcggaucccucauuggccugaccagccgggccacgugggcuaaaaauauccaagccgcuauuaaccaggugagaucucuuaucgggaaugaggaauacacagauuacaugcccuccaugaagcgcuuccggagagaggaagaggaagccggaguccugugguga

SEQ ID NO: 20078 - RNA, 9876 nt, Artificial Sequence
  derived and/or modified CDS sequence (opt5) from DENV-2__FJ547064__SS-prME
agcgccggaaugaucauuaugcugauccccaccgugauggcuuuccaccugacgacgcggaauggggagccucauauggucguuggcauucaggaaaagggaaagagccugcuuuuuaagaccgaggacggggugaauaugugcacgcugauggccauggaucucggagaacugugugaggacaccaucacauacaagugcccgcuucugcggcaaaacgaacccgaggauauugacuguuggugcaauucuaccagcacaugggugaccuauggcacguguaccacaaccggggagcaccgcagagaaaagcgguccgucgcgcucgugccucauguuggaaugggacuggagacacgcaccgaaacguggaugucuagcgagggcgcuuggaaacacgcccagagaaucgagacauggauccugcggcaucccggguucaccauuauggccgcuauccucgccuacacaauuggaaccacccacuuucagcgcgugcugaucuucauucuucugacagcugucgccccuuccaugacgaugagaugcaucggcauuucuaaccgggauuuuguggaagggguuagcggaggcuccuggguggacaucguccucgagcacgggagcugugugaccacaauggcgaagaauaagcccacccuggauuucgaacuuaucaaaacagaggccaagcagccugcuacccugcgcaaauauugcauugaagccaagcucacgaacacaaccaccgagucuagauguccgacacaaggagagcccucccugaaagaagaacaggacaagcgguuugugugcaagcauagcauggucgaucgcggcuggggcaauggguguggacuguucggcaaagggggaaucguuaccugcgcuauguuuacaugcaagaaaaacauggaaggcaagauugugcagccugagaaucucgaauacacgaucguggucacaccccacucuggggaggagcaugccgugggaaacgacacaggcaaacacggccaggaaauuaagguuaccccucaauccagcaucacagaggcggaacugaccggguauggaacggugaccauggaguguucucccagaacaggccuugauuucaaugaaaugguccugcuccagauggagaacaaagccuggcuggugcaccggcagugguuucuugaccugccgcucccuuggcugcccggggcugauaagcaggaguccaauuggauccaaaaggaaacccugguuacauucaaaaacccucaugccaagaaacaggacguggucgugcucggaagccaggagggcgcuaugcacaccgcccugacgggggccacagaaauucaaauguccucuggcaaucuucuguuuaccggacaucucaagugccgccugagaauggacaaacuucagcugaagggcaugagcuacuccauguguacagggaaguucaaagucgugaaggagaucgcugagacccagcacggaaccauuguuauccgggugcaguaugaaggcgaugggagccccugcaaaauucccuucgagaucauggaccucgaaaagagauacguccugggacgccugaucacagugaacccuauuguuacggagaaagauucuccggugaacaucgaagcggagcccccuuuuggcgacuccuacauuaucauuggggucgagcccggccaacucaagcugaauugguucaagaaaggaagcucuaucggccagauguuugaaaccacaaugagaggggccaagagaauggcuauucuuggagauaccgccugggacuucggcagccucggcgggguguuuacauccaucgggaaagcccuccaucagguguucggggcuaucuauggcgccgcguuuucuggaguuagcuggaccaugaagauucugaucggcgucauuaucacguggauugggaugaacucccgcagcacaucucuguccgugagccuugugcucgucggaaucgugacccuguaccugggcguuauggugcaggcugauucugggugugucguguccuggaaaaauaaggagcucaagugcggaagcggcaucuucauuaccgacaacguucacacauggaccgaacaauauaaauuucagccugagucccccucuaagcuggccagcgccauccagaaagcucaggaagaggggauuuguggcauccgguccgugacaagacuugagaaucugauguggaagcaaauuacgccggaacucaaccacauccuggccgagaaugaagucaaacugaccaucaugacaggagauauuaagggcaucaugcaggcugggaaacgcucucuucggccucagcccaccgagcucaaguacagcuggaagacauggggaaaagccaagaugcuguccaccgaaagcuauaaccagacguuccugauugacggcccugagaccgcggagugccccaauacaaacagagccuggaacucucucgaaguggaggauuacggguuuggaguuuucaccacaaacaucuggcugaaacuuaaggaaaaacaagacgcuuuuugugacuccaagcugaugagcgccgcuauuaaggauaaucgcgccgugcaugcggacaugggcuauuggaucgagucugcccucaacgauaccuggaaaaucgagaaggcuuccuucauugaagucaaaaauugccacuggccuaagagccauacacuguggucuaacggcgugcuggagagcgaaaugaucauucccaaaaaccuugccgggccggugucccagcacaauuaccggccuggauaccacacccagaucgcuggccccuggcaucucgggaagcuggagauggacuucgauuuuugugacggaacgacagucauuguuaccgaagauugcggcaacagagggcccagccugcgcaccacaaccgccucuggaaagcucaucacggaguggugcugucgguccugcacacugccuccgcuuagauaucggggcgaggacggcuguugguacgggauggaaauucgcccccugaaagagaaggaagagaaucucgugaacagccuggugaccgccggacacggccaagucgauaauuucucccugggggugcuuggaauggcucucuuucuggaagagaugcugagaacacggguuggcaccaaacaugcgauccuccugguggccgucucuuucgugacacuuaucaccgggaacaugagcuuuaaggaccugggaagaguuguggucauggugggcgcuacgaugaccgaugacauuggcauggggguuacauaucucgcccugcuggccgcuuucaaagugcgcccuaccuuugccgcgggacuucugcuccggaagcugacauccaaggagcucaugaugaccacgaucggcauuguccugcuuucucagagcacaauccccgaaaccgugcuggagcucacagaugcucuggcccuggggaugauggugcuuaaaauugucagaaauauggaaaaguaccagcuggccguuaccaucauggcuauccucugcgugccuaacgccgugauucugcagaaugcguggaaagucuccuguaccauccucgcugugguuucugugagcccccugcuucugacauccagccaacagaagacggacuggauuccucucgcccugaccaucaaaggacugaaccccacagccauuuuccuuaccacacugucucgcaccaauaagaaaagauccuggccgcucaacgaggcuaucauggccgucggcauggugagcauccuggcuucuucccuccugaagaaugacauuccuaugacggggccccuuguugccggaggccugcugacagugugcuauguccucaccggccggagcgcggaucuggaacuugagcgcgccaccgacgugaagugggaggaucaggcugaaaucucuggguccagcccuauucuguccaucacaauuagcgaggacggaucuaugagcaucaaaaacgaagaggaggaacagacccucacaauucugaucagaacgggccuccuggucaucuccgggcuuuuucccauuucuaucccgauuaccgccgcugccugguaccugugggaggugaagaaacaacgggccggaguucugugggaugugccuucucccccucccaugggcaaggcugaacucgaggacggggcguaucgcaucaaacagaagggcauucugggcuacucccagaucggcgccggggucuacagagaaggaacauuccacaccauguggcaugugacacggggcgcuguucuuaugcacaaggggaaacgcaucgagcccuccugggccgaugugaagaaagaccugauuagcuauggaggcggguggaagcucgagggagaauggaaagagggcgaagagguccaggugcuggcccucgaaccuggcaagaauccgagagcugugcaaaccaagcccgggcuguuuaaaacgaacaccggaacaaucggcgccguuucccuugauuucucuccugggaccagcggaucccccauuaucgacaagaaaggcaaggucguggggcuguacggaaacggcguggucacacggagcggcgcguaugugucugcuauugcccagaccgagaaauccaucgaggauaauccugaaaucgaggacgauauuuuucgcaagagacggcugacaaucauggaccuccaccccggggccggaaagacgaaaagauaccugccugcuauuguucgcgaagccaucaagcggggccuuagaacccugauucucgcgccgacacgcguggucgcugccgagauggaagaggcccugcgggggcuccccaucagauaucagaccccugcuauucgcgccgagcauaccggacgggaaaucguggaccugaugugucacgcuacauucacgaugagacuucugagccccguucgcgugccuaacuacaaucugaucauuauggaugaggcccauuucaccgaccccgcgucuaucgccgcucggggcuauauuuccacaagagucgaaaugggggaggccgcuggcaucuuuaugaccgccacaccgccuggaagccgggaucccuucccccaauccaacgccccuauuaucgacgaggaacgcgagauccccgaaagaucuuggaauagcggccacgagugggugaccgauuuuaaagggaagacgguuugguucgugccuuccauuaaagcuggaaacgacaucgucgcgugccuccggaagaauggcaagaaagugauucagcugagccgcaagacauuugauucugaauacgugaaaaccagaaccaacgacugggauuucgucguuacaaccgacaucuccgagaugggggccaauuuuaaggcugagcgggugauugauccgagacgcuguaugaaacccgugauccuuacagacggagaggaacgggucauccuggccggcccuaugcccgugacccauagcucugccgcucagagacgcgggcggauuggcagaaacccuaagaaugaaaacgaccaguacaucuauaugggagagccccucgaaaaugaugaggacugcgcccacuggaaagaggcgaagaugcugcuggauaacauuaauacgccggaaggcaucauuccuagcauguucgagcccgaacgcgagaagguugacgcuaucgauggggaauaccggcucagaggagaggcccgcaaaacauuuguggaccuuaugagacggggcgaucugccugucuggcuggccuauaagguggcugccgaggggauuaacuacgcggaccgcagaugguguuucgauggaaucaaaaacaaucaaauccucgaagagaacguugaaguggagauuuggaccaaggagggcgaacggaaaaagcugaagccccgcuggcuugacgccagaaucuauuccgauccucuggcucucaaagaguuuaaggaguucgccgcugggcggaaaucucugacacugaaucucauuaccgagaugggcagacuucccacguucaugacccagaagacacgcgacgcccuggauaaccuggcuguccuccacaccgccgaagcgggaggccgggccuacaaucaugcucugagcgagcuuccggagacacuggaaacccuccugcugcucacacuucuggccaccgugacagggggaaucuuucuguuccucauguccggcagagggauuggaaaaaugacacugggcaugugcugcaucaucaccgcuucuauucuucugugguaugcccagauccagccucacuggauugccgcuagcaucauucucgaguuuuuccugaucguccugcucauccccgaacccgagaagcaacgcaccccucaggacaaccagcuuacauacgugguuauugcgauccugaccgugguggccgcuacaauggccaaugaaaugggcuuucuggagaagacgaaaaaggaccucgggcugggauccauugccacccagcaaccggagagcaacauccuugauauugaccugcggcccgcuucugccuggacacucuacgcggucgccaccacauucguuaccccuaugcugagacauuccaucgaaaauagcuccgugaacgugucucugacggcuauugccaaucaggcuaccguccucaugggccuugggaaaggauggccccugagcaagauggauaucggcgugccucugcucgccaucggguguuauucccagguuaaccccauuacacugaccgcggcccuucugcuccugguggcucacuacgccaucauuggaccuggccugcaggcuaaagccacacgggaggcucaaaagcgcgccgcggccggcaucaugaagaauccgaccgucgacgggauuacggugaucgaucucgaccccaucccuuaugaucccaaauuugaaaagcagcuuggacaggucaugcugcugauucucugcgugacacaaguucugaugaugagaaccacaugggcucuuugugaggcccugacccucgcuaccggcccuaucucuacacugugggaagggaaccccggacgguucuggaauacgaccauugccgugagcauggccaacaucuuucgcggcuccuaccuggcgggggcuggacuccuuuucagcauuaugaaaaauacaaccaacacaagacggggcaccggcaacaugggggagacgcugggagagaaguggaaaucucgccugaaugcccucggcaaguccgaauuucagaucuauaaaaagagcgggauccaggaggucgacagaacacuggcuaaggaaggaauuaaacggggcgagaccgaucaccaugccgugucucgcggguccgccaaacuuagaugguucguugagcggaacauggugaccccggaaggaaaagucguggaccugggcugcggcagagggggauggagcuacuauuguggcgggcucaagaaugugcgcgagguuaaaggacugacaaagggcgggccuggacacgaggaacccauccccaugucuaccuacggcuggaaccugguccggcuccagagcggcguggauguguuuuucauuccucccgaaaagugcgacacacuucugugugauaucggggaguccucuccuaauccgacggucgaggcuggaagaacccugcgcguucucaaccugguggaaaauuggcuuaacaauaacauucaauucugcaucaaagugcugaaucccuacaugccuagcgucaucgagaagauggaagcccuccagcggaaauauggcggggcgcuggugagaaacccccugucccgcaauagcacacaugagauguacuggguuuccaacgccucuggaaauauugugagcuccgucaacaugaucucucggaugcucauuaacagauuuaccaugcgccacaagaaagcuacauaugaaccugacguggaccuuggcagcgggacccggaauaucggaacggaguccgagauucccaaccuggauaucauuggcaagagaaucgaaaagaucaaacaggagcaugaaaccucuuggcacuacgaccaggaucacccguauaagacaugggccuaccauggcagcuaugagaccaaacaaacaggguccgcuagcucuaugguuaauggagugguccgccugcucaccaagccuugggacgugcugcccauggugacacagauggccaugaccgauacgacaccuuucggccagcagcgggucuuuaaagaaaagguugacaccagaacccaagagcccaaggaggggaccaagaaacuuaugaaaauuacggcggaauggcuguggaaggagcucggcaagaagaaaaccccucgcauguguacaagagaagaguucacccggaaggugcgcuccaacgccgcucugggcgccaucuuuacagaugagaauaaguggaaaagcgcuagagaagccguggaggacucucgguucugggaacuggucgauaaggagagaaaccuccaccuggaagggaaaugcgagaccuguguguacaauaugaugggaaagcgggagaagaaacuuggcgaauuuggcaaagcuaaagggucccgcgccauuugguacauguggcugggagcgagauuccucgaguuugaagcccugggcuuccuuaacgaggaccauugguuuagccgggaaaauucucuguccgggguugagggagagggccuccacaagcugggguauauccugcgcgaugugagcaaaaaggaaggcggagcuauguacgccgacgacacagcuggcugggauaccagaauuacgcucgaggaccugaaaaacgaagagauggucaccaaucacauggaaggggagcauaagaaacuugccgaggccaucuucaaacugacauaucagaacaaggugguucgggugcagcgccccaccccgagaggaacagucauggauaucauuucccggcgcgaccaaagaggcagcggacaggugggaaccuacggccucaauacguuuacaaacauggaagcgcagcugauccggcagauggagggggaaggcguuuucaaaaauauucaacaccuuaccgugacagaggaggucgcugugaagaacuggcuggcccgcgucggaagagaacggcucucucgcauggccaucagcggcgaugacugcgugguuaaaccucuggaugacagauucgcuaacgcccugaccgcucucaaugauauggggaagauucggaaggacauccagcagugggagcccuccaaaggauggaacgauuggacacaggugcccuuuugcucucaucacuuccaugaacugaucaugaaggacggcagaguccuuguggugccuugucgcaaucaagaugagcugauugggcgggccagaaucagccagggagcgggcuggucccuccgcgaaaccgccugccuggggaaaucuuaugcucagauguggagccuuauguacuuucaccggagagaccugcgccucgccgcuaacgccauuuguuccgcgguuccgucucacugggugcccacaagccggaccacaugguccauccaugccaagcacgaguggaugaccacagaggacaugcugaccgucuggaauagaguguggauucgcgaaaacccuuggauggaggauaaaacgcccguugaaagcugggaggaaaucccuuaucugggcaagcgggaggaccaguggugcggaucucucauuggccugacauccagagcuaccugggccaagaauauccaagcugccaucaaccaggugcgcagccuuauugggaaugaggaauacaccgauuacaugcccucuaugaaacgguucagacgggaggaagaggaagcuggaguccugugguga

SEQ ID NO: 20079 - RNA, 9876 nt, Artificial Sequence
  derived and/or modified CDS sequence (opt5) from DENV-2__FJ410223__SS-prME
agcgccggcaugaucauuaugcugauccccaccgucauggcuuuccaccugacaacgagaaauggggagccucauaugauugucggaauccaggaaaagggcaagucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggagaacauggggaaaggccaaaaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaagaaaagcaagacgcuuuuugugacuccaaacugaugagcgccgcuaucaaggauaaucgggccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccagcacaauuacagaccuggauaccacacccagauugcuggccccuggcaucucgggaaacuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaggagaaagaagagaaucucguuaacagccuggugaccgccggacacggccaaguggauaauuucucccuggggguccuuggaauggcucucuuucuggaagagaugcugcggacaagagugggcaccaagcaugcgauccuccugguugccgugucuuucgucacacuuauuaccgggaacaugagcuuuaaagaccugggacgcgugguugugauggucggcgcuacgauggccgaugacaucggcaugggggugaccuaucucgcccugcuggcugccuucaagguucggccuacauuugcggcuggacuucugcucagaaaacugaccuccaaggagcucaugaugacaaccauuggcaucgugcugcuuucucagagcacgauucccgaaacaguccuggagcucaccgaugcccuggcccuggggaugauggugcuuaagaucgugcgcaauauggaaaaauaccagcuggcugucacaaucauggccauucucugcguuccuaacgcggugauccugcagaaugcuuggaagguguccuguaccauucucgccgucgugucuguuagcccccugcuucugaccuccagccaacagaaaacagacuggaucccucucgcccugacgauuaagggacugaaccccaccgcuaucuuccuuacaacccugucuagaacaaauaaaaagcgguccuggccgcucaacgaggccaucauggcugugggcauggucagcauucuggccucuucccuccugaaaaaugacaucccuaugaccgggccccuuguggcgggaggccugcugacgguuugcuaugugcucacaggccgcagcgccgaucuggaacuugagagagcuaccgacgucaagugggaggaucaggccgaaauuucuggguccagcccuauccuguccauuaccaucagcgaggacggaucuaugagcauuaagaacgaagaggaggaacagacacucaccauccugauccggacaggccuccuggugauuuccgggcuuuuucccaucucuauuccgaucacggcugccgccugguaccugugggaggucaaaaagcaacgcgcuggagugcugugggauguuccuucucccccucccaugggcaaagcggaacucgaggacggggccuauagaauuaagcagaaaggaauccugggcuacucccagaucggcgcugggguguacaaggaaggaaccuuccacacaauguggcaugucacccggggcgccgugcuuaugcacaaggggaaacgcauugagcccuccugggccgauguuaagaaagaccugaucagcuauggaggcggguggaagcucgagggagaauggaaagagggcgaagaggugcagguccuggcucucgaaccuggcaagaauccgagagccgugcaaacaaagcccgggcuguuuaaaaccaacacgggaaccauuggcgcggugucccuugauuucucuccugggacaagcggaucccccaucauugacaagaaaggcaagguugucgggcuguacggaaacggcguggugacccggagcggcgcuuaugucucugccaucgcccagacagagaaauccaucgaggauaauccugaaauugaggacgauaucuuucgcaagaagagacugaccauuauggaccuccaccccggggcuggaaaaacaaagcgguaccugccugccaucgugagagaagcgauuaaacgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaauccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccucagaaagaauggcaaaaaggugauccagcugagccggaaaacguuugauucugaauacgucaagacacgcaccaacgacugggauuucguggugaccacagacauuuccgagaugggggccaauuuuaaagccgagagagucaucgauccgcggagauguaugaagcccguuauccuuaccgacggagaggaacgcgugauucuggcuggcccuaugcccgugacacauagcucugccgcgcagcggagagggcgcaucggccggaacccuaaaaaugaaaacgaccaguacauuuauaugggagagccccucgaaaaugaugaggacugcgcucacuggaaggaggccaagaugcugcuggauaacaucaauaccccggaaggcauuaucccuagcauguucgagcccgaaagagagaaagucgacgccauugauggggaauaccgccuccggggagaggcuagaaagacguuuguggaccuuaugcgcagaggcgaucugccuguuuggcuggccuauaaaguggcggccgaggggaucaacuacgcugaccggcgcugguguuucgauggaaucaagaacaaucaaauucucgaagagaacgucgaaguggagaucuggacaaaagagggcgaaagaaagaagcugaaaccccgguggcuugacgcccgcauuuauuccgauccucuggcucucaaggaguuuaaagaguucgccgcugggagaaagucucugacccugaaucucaucacagagaugggccggcuucccaccuucaugacgcagaaaaccagagacgcccuggauaaccuggcgguucuccacacagccgaagcuggaggccgcgccuacaaucaugcucugagcgagcuuccggagacccuggaaacacuccugcugcucgcccuucuggccaccgugacagggggaauuuuucuguuccucauguccggccgggggaucggaaagaugacccugggcaugugcugcaucauuacggcuucuauccuucugugguaugcgcagauucagccucacuggaucgccgcuagcauuauccucgaguuuuuccugaucguccugcucauucccgaacccgagaagcaaagaacaccucaggacaaccagcuuaccuacguggucaucgccauucugaccgugguugccgcuacaauggccaaugaaaugggcuuucuggagaaaaccaagaaagaccucgggcugggauccaucgcgacacagcaaccggagagcaacauucuugauaucgaccugcgccccgccucugcuuggacgcucuacgccguggcuaccacauucgugaccccuaugcugcggcauuccauugaaaauagcuccgucaacguuucucugacagccaucgcgaaucaggccaccgugcucaugggccuugggaagggauggccccugagcaaaauggauaucggcgugccucugcucgcuauuggguguuauucccaggucaaccccaucacgcugaccgccgcccuucugcuccugguggcccacuacgcuauuaucggaccuggccugcaggccaaggcgacaagagaggcccaaaagcgggcugccgcuggcauuaugaaaaauccgaccguugacgggaucacagugaucgaucucgaccccauuccuuaugaucccaaguuugaaaaacagcuuggacaggucaugcugcugauccucugcgugacccaaguccugaugaugcgcacgacaugggcccuuugugaggcccugacccucgcgacaggcccuauuucuacccugugggaagggaaccccggaagauucuggaauaccacaaucgcugugagcauggccaacauuuuucggggcuccuaccuggcuggggccggacuccuuuucagcaucaugaagaauacgaccaacacacgcagaggcaccggcaacaugggggagacacugggagagaaauggaagucucggcugaaugcccucggcaaauccgaauuucagaucuauaaaaagagcgggauucaggagguugaccgcacccuggcuaaagaaggaaucaagagaggcgagacggaucaccaugccgugucucggggguccgcgaaacuucgcugguucgucgagagaaacauggugacaccggaaggaaagguuguggaccugggcugcggcagagggggauggagcuacuauuguggcgggcucaaaaauguccgggaggugaagggacugaccaagggcgggccuggacacgaggaacccauucccaugucuaccuacggcuggaaccuggugcgccuccagagcggcguugaugucuuuuucaucccucccgaaaaaugcgacacacuucugugugauauuggggaguccucuccuaauccgaccguggaggccggacggacacugagagugcucaaccuggucgaaaauuggcuuaacaauaacacgcaauucugcaucaagguucugaaucccuacaugccuagcgugaucgagaaaauggaagcucuccagcgcaaguauggcggggcccuggugcggaacccccuguccggaaaucucaaaaacgagauguacugggucagcaaugcuuccggcaacauugugucuagcguuaacaugaucuccagaaugcuuauuaaucgcuuuaccaugcggcauaagaaggccacauaugaaccugacguggaccuggggucuggaaccagaaacaucggcauugagagcgagacacccaaucuggauaucauuggcaaacgcaucgaaaagaucaaacaggagcacgaaaccuccuggcauuacgaccaggaucacccguauaagacgugggcguaccacgggucuuaugagaccaaacaaacaggaagcgccuccagcauggucaacggcgugguucggcuccugaccaagccuugggacgugcuucccacagucacccagauggcuaugacagauaccacgccuuucgggcagcagagaguguuuaaggaaaaaguggacacacgcacccaagagcccaaggagggaaccaaaaagcugaugaaaauuacagccgaauggcucuggaaggagcugggcaaaaagaagacgccucggauguguaccagagaagaguucacacgcaaagucagaucuaaugcugcccugggggcuaucuuuaccgaugagaacaaguggaaauccgcccgggaagcgguugaggacagccgcuucugggaacucguggauaaggagagaaaucugcaucuugaaggaaaaugcgagacauguguguacaacaugaugggcaagcgggagaagaaacugggcgaauuugggaaggccaaaggaucuagagcuauuugguacauguggcucggcgcccgguuccuggaguuugaagcucuuggguuccugaaugaggaccacugguuuucccgcgaaaacagccucucuggagucgagggcgaggggcugcauaagcugggcuauauccucagagauguguccaaaaaggaaggaggcgccauguacgccgacgacaccgcggggugggauacacggauuacccuggaggaccuuaagaaugaagagaugguuacgaaccacauggaaggagagcacaaaaagcuggcugaggccaucuucaaacucaccuaucagaauaaggugguccgcgugcagagacccacaccgcggggcaccguuauggauaucauuagccgcagagaccaacggggguccggacaggugggcacauacgggcugaacaccuuuacgaauauggaagcccagcuuauccgccagauggagggcgaaggagucuucaaaaacauucaacaucugacagugaccgaggagguugcugugcagaacuggcucgccagagucggccgggaacgccugagcagaauggcuaucucuggggaugacugcguggucaagccucuggaugaccgguucgccaaugcgcucacagcccugaacgauaugggaaagauucgcaaagacauccagcagugggagcccagcaagggcuggaaugauuggacccaagugcccuuuugcucccaccauuuccacgaacuuaucaugaaagacgggagaguucugguggucccuugucggaaccaggaugagcucauuggacgggcucgcaucucucagggcgccggguggagccugcgggaaacggcuugccuuggcaaguccuaugcccagauguggucucugauguacuuucauagacgcgaccuccggcugguggcgaaugccauuuguagcgcugugccgucccacuggguucccaccucuagaacaaccuggagcauccacgccaaacaugaguggaugacaaccgaggacaugcugacaguguggaaccgcgucuggauucgggaaaauccuuggauggaggauaagacccccguggaauccugggaggaaaucccuuaucucggaaagagagaggaccaauggugcggcagccugauugggcuuacgucucgcgcuacaugggccaaaaacauccaggcugccaucaaucagguucggucccugauuggaaacgaggaauacaccgauuacaugcccagcaugaagagauuccgccgggaggaagaggaagcgggcgugcucugguga

SEQ ID NO: 20080 - RNA, 9876 nt, Artificial Sequence
  derived and/or modified CDS sequence (opt5) from DENV-2__FJ410224__SS-prME
agcgccggaaugaucauuaugcugauccccaccgugauggcuuuccaccugaccacgagaaacggggagccucauaugauugugggaauccaggaaaagggcaagucccugcuuuuuaagaccgaggacgggguuaauaugugcacgcugauggccauggaucucggagaacugugugaggacaccgugacauacaagugcccgcuucugcggcaaaacgaacccgaggauauugacuguuggugcaauucuaccagcacaugggugaccuauggcacguguaccacaaccggggagcacagacgggaaaagcgguccgucgcgcucgugccucauguuggaaugggccuggagacacgcaccgaaacguggaugucuagcgagggcgcuuggaaacacgcccagagaaucgagacauggauccugcggcaucccggguucaccauuauggccgcuauccucgccuacacaauuggaaccacccacuuucagcgcgugcugaucuucauucuucugacagcugucgccccuuccaugacgaugagaugcaucggcauuucuaaccgggauuuuguggaagggguuagcggaggcuccuggguggacaucguccucgagcacgggagcugugugaccacaauggcgaagaauaagcccacccuggauuucgaacuuaucaaaacagaggccaagcagccugcuacccugcgcaaauauugcauugaagccaagcucacgaacacaaccaccgagucuagauguccgacacaaggagagcccucccugaaagaagaacaagacaagcgguuugugugcaagcauagcauggucgaucgcggcuggggcaauggguguggacuguucggcaaagggggaaucguuaccugcgcuauguuuacaugcaagaaaaacauggaaggcaagauugugcagccugagaaucucgaauacacgaucguggucacaccccacucuggggaggagcaugccgugggaaacgacacaggcaaacacggcaaggaaauuaaaguuaccccucaguccagcaucacagaggcggaacugaccggguauggaacggugaccauggaguguucucccagaacaggccuugauuucaaugaaaugguccugcuccaaauggagaacaaggccuggcuggugcaccggcagugguuucuugaccugccgcucccuuggcugcccggggcugauaagcaggaguccaauuggauccagaaagaaacccugguuacauucaagaacccucaugccaaaaagcaagacguggucgugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugaaagagaucgcugagacccagcacggaaccauuguuauccgggugcaguaugaaggcgaugggagccccugcaagauucccuucgagaucauggaccucgagaagcgguacguccugggacgccugaucacagugaacccuauuguuacggagaaggauucuccggugaacaucgaagcggagcccccuuuuggcgacuccuacauuaucauuggggucgagcccggccagcucaagcugaauugguucaaaaagggaagcucuaucggccaaauguuugaaaccacaaugagaggggccaaaagaauggcuauucuuggagauaccgccugggacuucggcagccucgggggaguguuuacauccaucggcaaggcccuccaucagguguucggggcuaucuauggcgccgcguuuucuggaguuagcuggaccaugaaaauucugaucggcgucauuaucacguggauugggaugaacucccgcagcacaucucuguccgugagccuugugcucgucggaaccgugacccuguaccugggcguuauggugcaggcugauucugggugugucguguccuggaaguccaaggagcucaaaugcggauccggcaucuucaucacagacaauguucacaccuggacagaacaguauaaguuucaaccugagucucccagcaaacuggccuccgccauucagaaggcucaggaagaggggaucuguggcauucggucugugacgagacuugagaaccugauguggaaacagaucaccccggaacucaaucacauucuggccgagaacgaagucaagcugacaaucaugaccggagauaucaaaggcauuaugcaagcugggaagcgcagccuucggccucagcccacagagcucaaguacuccuggaaaaccuggggaaaggccaaaaugcugagcacggaaucuuauaaucagaccuuccugaucgacggcccugagacagcggagugccccaacaccaauagagccuggaacucccucgaaguggaggauuacggguuuggaguuuucacaaccaauauuuggcugaaacuuaaagaaaagcaggacgcuuuuugugacagcaagcugaugucugccgcuaucaaagauaaccgcgccgugcaugcggacaugggcuauuggauugaguccgcccucaaugauacauggaagaucgagaaagcuagcuucaucgaagucaagaacugccacuggccuaaaucucauacccuguggagcaauggcgugcuggaguccgaaaugauuauccccaagaaccuugccgggccggugagccaacacaacuaccggccuggauaccacacgcagauugcuggccccuggcaucucgggaagcuggagauggacuucgauuuuugugacggaacaaccgucaucguuaccgaagauugcggcaauagagggcccucucugcgcacaaccacggccuccggaaaacucauuacagaguggugcugucggagcugcacccugccuccgcuuagauaucggggcgaggacggcuguugguacgggauggaaauccgcccccugaaggagaaagaagagaaccucgucaauucccuggugacagccggacacggccaggucgauaacuucucucugggggugcuuggaauggcucucuuucuggaagagaugcugagaacccggguuggcacaaagcaugcgauucuccugguggccgucagcuucgugacccuuaucacggggaauauguccuuuaaagaccugggaagaguuguggucauggugggcgcuaccauggccgaugacaucggcauggggguuacauaucucgcccugcuggcugccuucaaggugcgcccuaccuuugcggcuggacuucugcuccggaagcugacaucuaaagagcucaugaugaccacgauuggcaucguccugcuuagccaauccacaauucccgaaaccgugcuggagcucacagaugcccuggcccuggggaugauggugcuuaagaucgucagaaacauggaaaaauaccagcuggcuguuaccauuauggccauccucugcgugccuaaugcggugauccugcagaacgcuuggaaggucucuuguaccauucucgccgugguuagcgugagcccccugcuucugacaagcucucagcagaagacggacuggaucccucucgcccugaccauuaagggacugaaucccacagcuaucuuccuuaccacacugucccgcaccaacaaaaagagaagcuggccgcucaaugaggccauuauggcugucggcauggugucuauccuggccuccagccuccugaagaacgacaucccuaugacggggccccuuguugcgggaggccugcugacagugugcuauguccucaccggccggucugccgaucuggaacuugagcgcgcuaccgacgugaaaugggaggaucaggccgaaauuuccgggagcuccccuauccugagcauuacaaucucugaggacggaagcauguccauuaagaaugaagaggaggaacagacccucacaauccugauuagaacgggccuccuggucaucucugggcuuuuucccaucagcauuccgaucaccgcugccgccugguaccugugggaggugaaaaagcagcgggcuggaguucugugggaugugccuucucccccucccaugggcaaagcggaacucgaggacggggccuaucgcauuaagcaaaagggaauccugggcuacagccagauuggcgcuggggucuacaaagaaggaacauuccacaccauguggcaugugacaagaggcgccguucuuaugcacaaggggaaacggaucgagcccagcugggccgaugugaagaaagaccugaucuccuauggaggcggguggaagcucgagggagaauggaaggagggcgaagagguccaggugcuggcucucgaaccuggcaaaaacccgcgcgccgugcagaccaagcccgggcuguuuaaaacgaauaccggaacaauuggcgcgguuucucuugauuucagcccugggaccuccggaagccccaucauugacaagaaaggcaaggucguggggcuguacggaaacggcguggucacaagaucuggcgcuuauguguccgccaucgcccaaaccgaaaagagcauugaggauaacccugaaaucgaggacgauaucuuucggaaacgcagacugacaauuauggaccuccaccccggggcuggaaagacgaaacgguaccugccugccaucguuagagaagcgauuaagcgcggccuucggacccugauccucgcuccgacaagaguggucgccgccgagauggaagaggcucugcgcgggcuccccauucgguaucagaccccugccaucagagcugagcauaccggacgcgaaauuguggaccugaugugucacgccacauucacgaugcggcuucugucucccguuagagugccuaauuacaaccugaucaucauggaugaggcgcauuucaccgaccccgccuccauugcugcccgcggcuauaucagcacacgggucgaaaugggggaggcugccggcauuuuuaugaccgccacaccgccuggauccagagaucccuucccccagucuaaugcuccuaucauugacgaggaacgggagauccccgaacgcagcuggaacuccggccacgagugggugaccgauuuuaaagggaagacgguuugguucgugccuagcaucaaggcgggaaaugacauugccgcuugccuccgcaaaaacggcaagaaagucauccaacugucucggaagacauuugauuccgaauacgugaaaacccgcaccaaugacugggauuucguggucacaaccgacauuagcgagaugggggccaacuuuaaggccgagagaguuaucgauccgcggagauguaugaaacccgugauucuuacagacggagaggaacgcgugauccuggcuggcccuaugcccgucacccauucuagcgccgcgcagcggagagggcgcaucggccggaauccuaagaacgaaaaugaccaguacauuuauaugggagagccccucgaaaacgaugaggacugcgcucacuggaaggaggccaaaaugcugcuggauaauaucaacacgccggaaggcauuaucccuuccauguucgagcccgaaagagagaagguggacgccauugauggggaauaccgccuccggggagaggcuagaaaaacauuuguugaccuuaugcgcagaggcgaucugccuguguggcuggccuauaaggucgcggccgaggggaucaauuacgcugaccggcgcugguguuucgauggaauuaaaaacaaccagauccucgaagagaauguggaaguugagaucuggaccaaggagggcgaaagaaagaaacugaagccccgguggcuugacgcccgcauuuauucugauccucuggcucucaaagaguuuaaggaguucgccgcugggagaaaaagccugacacugaaccucaucaccgagaugggccggcuucccacguucaugacccaaaagacaagagacgcccuggauaaucuggcggugcuccacaccgccgaagcuggaggccgcgccuacaaccaugcucuguccgagcuuccggagacacuggaaacccuccugcugcucacacuucuggccaccgucacagggggaauuuuucuguuccucaugucuggccgggggaucggaaagaugacacugggcaugugcugcauuaucaccgccagcauccuucugugguaugcucagauucagccucacuggaucgcggccuccauuauccucgaguuuuuccugauugugcugcucauccccgaacccgagaaacagagaaccccucaagacaaucagcuuacauacgucgugaucgcuauucugaccguuguggccgccacaauggcuaacgaaaugggcuuucuggagaagacgaaaaaggaccucgggcugggaagcaucgccacccagcagccggagucuaauauucuugauaucgaccugcgccccgcguccgccuggacacucuacgcuguggccaccacauucgucaccccuaugcugcggcauagcauugaaaacuccucuguuaaugugagccugacggcuaucgccaaccaagcgaccgugcucaugggccuugggaaaggauggccccuguccaagauggauauuggcgucccucugcucgccaucggguguuauucucaggugaaucccaucacacugaccgcugcccuucugcuccugguugcucacuacgccauuaucggaccuggccugcaggcuaaggccacaagagaggcgcagaaacgggccgcugccggcauuaugaagaacccgaccguggacgggaucacggucauugaucucgaccccaucccuuaugaucccaaauuugaaaagcaacuuggacaggugaugcugcugauccucugcgucacacaggugcugaugaugcgcaccacaugggcucuuugugaggcccugacccucgccaccggcccuauuagcacacugugggaagggaaucccggaagauucuggaacacgaccaucgcgguuuccauggcuaauauuuuucggggcagcuaccuggccggggcuggacuccuuuucucuaucaugaaaaacacaaccaauacacgcagaggcaccggcaacauuggggagacgcugggagagaaguggaaaucccggcugaacgcccucggcaagagcgaauuucaaacauauaagaaaucugggauccaggagguggaccgcacccuggccaaggaaggaaucaaaagaggcgagaccgaucaccaugcugucucccgggggagcgccaaacuucgcugguucguggagagaaauaugguuacaccggaaggaaaaguggucgaccugggcugcggcagagggggauggucuuacuauuguggcgggcucaagaacgugagagaggugaagggacugaccaaaggcgggccuggacacgaggaacccauucccaugagcacauacggcuggaaucugguucgccuccaguccggcgucgauguguuuuucaucccucccgaaaagugcgacacgcuucugugugauauuggggagucuagcccuaacccgaccguggaggcgggacggacacugagaguccucaaucugguugaaaacuggcuuaauaacaauacccaguucugcaucaaagugcugaaccccuacaugccuuccgugauugagaagauggaagcccuccaacgcaaauauggcggggcucugguccggaauccccugagcagaaacuccacacaugagauguacugggugucuaaugccagcggaaacaucguuuccucugugaauaugaucagccgcaugcucauuaaccgguuuaccaugagacacaagaaggcuacguaugaaccugacgucgaccuuggcuccgggacccgcaacaucggaauugagucugagauccccaaucuggauauuaucggcaaacggauugaaaagaucaaacaggagcaugaaacaagcuggcacuacgaccaggaucacccguauaagaccugggccuaccauggcuccuaugagacaaaacagaccgggagcgcgucuuccauggugaacggaguugugagacugcucacaaagccuugggacguccugcccaccgugacgcaaauggccaugacagauaccaccccuuucggccagcagcgcguguuuaaggaaaaagucgacacacggacgcaggagcccaaggaggggaccaagaaacuuaugaaaaucacagcugaauggcuguggaaagagcucggcaagaagaagaccccuagaauguguacacgcgaagaguucaccagaaaaguucggagcaaugccgcucugggcgccauuuuuacagaugagaacaaguggaaaucugcucgcgaagccguggaggacuccagauucugggaacugguggauaaggagcggaaucuccaccuggaagggaaaugcgagaccugugucuacaacaugaugggaaagagagagaagaaacuuggcgaauuuggcaaggcgaaagggagccgggccaucugguacauguggcugggagcucgcuuccucgaguuugaagcccugggcuuccuuaaugaggaccauugguuuucuagagaaaacucccugagcgggguggagggagagggccuccacaagcugggguauauucugcgggauguuuccaaaaaggaaggcggagcuauguacgccgacgacacggccggcugggauacccgcaucacacucgaggaccugaagaaugaagagauggugaccaaccacauggaaggggagcauaagaaacuugcggaggcuauuuucaaacugacauaucaaaauaaagucgugagaguucagcggcccaccccgcgcggaacggugauggauaucaucagcagacgggaccagcgcggcucugggcaagucggaacauacggccucaacaccuuuacaaauauggaagcccagcugauuagacagauggagggggaaggcguguucaaaaacauccagcaccuuaccguuacggaggagguggccguccaaaauuggcuggcucgggugggacgcgaaagacucagccggauggccauuuccggcgaugacugcgucgugaagccucuggaugaccgcuucgcuaacgcccugaccgcgcucaacgauauggggaagaucagaaaagacauucagcagugggagcccucuaagggauggaaugauuggacacagguucccuuuugcagccaucacuuccaugaacugaucaugaaagacggccgggugcuugucgugccuuguagaaaccaagaugagcugaucgggcgcgcccggauuucccagggagcuggcuggucucucagagaaaccgccugccuggggaaguccuaugcucagauguggucccuuauguacuuucaccgccgggaccugagacucgccgcgaaugccaucuguucugcugugccgagccacuggguucccacaucccgcaccacauggagcauucaugccaaacacgaguggaugaccacggaggacaugcugacaguguggaaccgggucuggaucagagaaaauccuuggauggaggauaagacccccguggaaucuugggaggaaauuccuuaucugggcaagcgcgaggaccaguggugcggaucccucaucggccugaccagccgggcuacaugggccaaaaacauucaagcugccaucaaucagguuagaucucuuaucgggaacgaggaauacaccgauuacaugcccuccaugaagcgcuuccggagagaggaagaggaagcgggagugcugugguga

SEQ ID NO: 20081 - RNA, 9876 nt, Artificial Sequence
  derived and/or modified CDS sequence (opt5) from DENV-2__FJ461321__SS-prME
uccgcuggaaugaucauuaugcugauccccacagugauggcuuuccaccugacaacgagaaauggggagccucauaugauugucggaauccaggaaaagggcaagucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuuccgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcauuccgucggaaacgacacaggcaaacacggcauggaaaucaaggugaccccucagagcucuaucacagaggccgaacugaccggguauggaacgguuaccauggaguguucccccagaacaggccuugauuucaaugaaauggugcugcuccaaauggagaacaaagcguggcugguccaccggcagugguuucuugaccugccgcucccuuggcugcccggggccgauaagcaggagagcaauuggauucagaaggaaacccuggugacauucaaaaacccucaugcuaagaaacaagacguugugguccucggaucccaggagggcgccaugcacaccgcucugacgggggccacagaaauccagaugucuagcggcaaucuucuguuuaccggacaucucaagugccgccugagaauggacaaacuucaacugaagggcauguccuacagcauguguacagggaaguucaaaguggucaaggagauugccgagacccagcacggaaccaucgugauucggguucaguaugaaggcgaugggucucccugcaaaauccccuucgagaucauggaccucgaaaagagauacgugcugggacgccugauuacagucaacccuaucgugacggagaaagauuccccgguuaacauugaagcugagcccccuuuuggcgacagcuacaucauuaucgggguggagcccggccagcucaagcugaauugguucaagaaaggaucuagcauuggccaaauguuugaaaccacaaugagaggggcgaagagaauggccauccuuggagauaccgcuugggacuucggcucccucgggggagucuuuacaucuaucggcaaagcccuccaucagguguucggggccauuuauggcgcugccuuuagcggaguguccuggaccaugaagauccugauuggcguuaucauuacguggaucgggaugaacagccgcucuacaucccugagcgucucucuugugcucgugggaaucgucacccuguaccugggcgugaugguucaggcggauuccggguguguggucagcuggaaaaauaaggagcucaagugcggauccggcauuuucaucaccgacaacgugcacacauggaccgaacaguauaaauuucaaccugagucucccagcaagcuggcuuccgccauucagaaagcccaggaagaggggaucuguggcauucggucuguuacaagacuugagaaucugauguggaagcagaucacgccggaacucaaccacauccuggcugagaaugaagugaaacugaccauuaugacaggagauauccgcggcauuaugcaagccgggaagcggagccuuagaccucagcccaccgagcucaaauacuccuggaagacauggggaaaggcuaaaaugcugagcaccgaaucuuauaaccagacguuccugaucgacggcccugagaccgccgagugccccaauacaaaccgcgcguggaacucccucgaagucgaggauuacggguuuggaguguucaccacaaacauuuggcugaaacuuaaagaaaagcaggacgccuuuugugacagcaaacugaugucugcugccaucaaggauaaucgggcuguucaugccgacaugggcuauuggaucgaguccgcgcucaacgauaccuggaagauugagaaagccagcuucaucgaagugaagaauugccacuggccuaaaucucauacacuguggagcaacggcguccuggaguccgaaaugauuauccccaagaaccuugcugggccggugagccaacacaauuacagaccuggauaccacacccagauugccggccccuggcaucucgggaaacuggagauggacuucgauuuuugugacggaacgacagugaucgucaccgaagauugcggcaaccgcgggcccucucugcggaccacaaccgcuuccggaaagcucauuacggaguggugcuguagaagcugcacacugccuccgcuucgguaucgcggcgaggacggcuguugguacgggauggaaaucagaccccugaaggagaaagaagagaaucucguuaacucccuggugaccgccggacacggccagguggauaauuucucucuggggguccuuggaauggcccucuuucuggaagagaugcugcggacaagagugggcaccaagcaugcuauccuccugguugcggugagcuucgucacacuuauuaccgggaacauguccuuuaaagaccugggacgcgugguugugauggucggcgccacgauggcugaugacaucggcaugggggugaccuaucucgcccugcuggccgcuuucaagguucggccuacauuugccgcgggacuucugcucagaaaacugaccucuaaggagcucaugaugacaaccauuggcaucgugcugcuuagccaauccacgauucccgaaacaguccuggagcucaccgaugcucuggcccuggggaugauggugcuuaagaucgugcgcaauauggaaaaauaccagcuggccgucacaaucauggcuauucucugcguuccuaacgccgugauccugcagaaugcguggaaggugucuuguaccauucucgcugucgugagcguuagcccccugcuucugaccagcucucagcagaagacggacuggaucccucucgcccugacgauuaagggacugaaccccaccgccaucuuccuuacaacccuguccagaacaaauaaaaagcggagcuggccgcucaacgaggcuaucauggccgugggcauggucucuauucuggcuuccagccuccugaaaaaugacaucccuaugaccgggccccuuguggccggaggccugcugacgguuugcuaugugcucacaggccgcucugcggaucuggaacuugagagagccaccaacgucaagugggaggaccaggcugaaauuuccgggagcuccccuauccugagcauuaccaucucugaggauggaagcauguccauuaagaaugaagaggaggaacagacacucaccauccugauccggacaggccuccuggugauuucugggcuuuuucccaucagcauuccgaucacggccgcugccugguaccugugggaggucaaaaagcagcgcgccggagugcugugggacguuccuucucccccucccaugggcaaagcugaacucgaggauggggcguauagaauuaagcaaaaaggaauccugggcuacagccagaucggcgccgggguguacaaggaaggaaccuuccacacaauguggcaugucacccggggcgcugugcuuaugcacaaggggaaacgcauugagcccagcugggccgacguuaagaaagaucugaucuccuauggaggcggguggaagcucgagggagaauggaaagagggcgaagaggugcagguccuggcccucgaaccuggcaagaacccgagagcugugcagacaaagcccgggcuguuuaaaaccaacacgggaaccauuggcgccgugucucuugacuucagcccugggacauccggaagccccaucauugauaagaaaggcaagguugucgggcuguacggaaauggcguggugacccggucuggcgcguaugucuccgcuaucgcccaaacagagaaaagcaucgaggacaacccugaaauugaggaugacaucuuucgcaagagacggcugaccauuauggaucuccaccccggggccggaaagacaaaaagauaccugccugcuaucgugcgcgaagccauuaagcggggccuuagaacgcugauccucgcgccgacccgcguuguggcugccgagauggaagaggcccugcgggggcuccccauuagauaucagaccccugcuauccgcgccgagcauaccggacgggaaaucgucgaccugaugugucacgcuaccuucacaaugagacuucugucucccgugcgcguuccuaauuacaaccugauuaucauggacgaggcccauuucacggaucccgcguccauugccgcucggggcuauaucagcaccagaguggaaaugggggaggccgcuggcauuuuuaugacagccaccccgccuggaucccgggaccccuucccccagucuaaugccccuaucaucgaugaggaacgcgagauucccgaaagaagcuggaacuccggccacgagugggucacagacuuuaaagggaagaccgugugguucguuccuagcaucaaagcuggaaaugauauugcggccugccuccggaagaacggcaagaaagugauccaacugucucgcaagacguuugacuccgaauacgucaaaacaagaaccaaugauugggacuucguggugaccacagauauuagcgagaugggggcuaacuuuaaggccgagcgggucaucgacccgagacgcuguaugaaacccguuauccuuaccgauggagaggaacgggugauucuggccggcccuaugcccgugacacauucuagcgcugcccagagacgcgggcggaucggcagaaauccuaagaacgaaaaugaccaguacauuuauaugggagagccccucgaauccgacgaggauugcgcgcacuggaaagaggcuaagaugcugcuggacaacaucaauaccccggaaggcauuaucccuucuauguucgagcccgaacgcgagaaggucgaugccauugacggggaauaccggcucagaggagaggcccgcaaaacguuuguggaucuuaugagacggggcgaccugccuguuuggcuggcuuauaagguggccgcggaggggaucaacuacgccgaucgcagaugguguuucgacggaaucaaaaacaaucagauucucgaagagaacgucgaaguggagaucuggacaaaggagggcgaacggaaaaagcugaagccccgcuggcuugaugcuagaauuuauagcgacccucuggcccucaaagaguuuaaggaguucgcugccgggcggaaaucccugacccugaaucucaucacagagaugggcagacuucccaccuucaugacgcaaaagacccgcgaugcucuggacaaccuggccguucuccacacagcggaagccggaggccgggcuuacaaucaugcccugucugagcuuccggagacccuggaaacacuccugcugcucacccuucuggcuacagugaccgggggaauuuuucuguuccucaugagcggcagagggaucggaaaaaugacgcugggcaugugcugcaucauuacagccuccauccuucugugguaugcccagauucagccucacuggaucgcugcgagcauuauccucgaguuuuuccugaucguccugcucauucccgaacccgagaagcagcgcaccccucaagauaaccagcuuaccuacguggucaucgccauucugacagugguugcugccaccauggccaaugaaaugggcuuucuggagaagaccaagaaggaccucgggcugggaucuaucgcuacgcagcagccggaguccaacauucuugacaucgaucugcggcccgccagcgcguggacccucuacgccguggcuacaaccuucgugacaccuaugcugagacauuccauugaaaauucuagcgucaacguuucccugaccgccaucgcuaaucaagccacggugcucaugggccuugggaaaggauggccccugucuaagauggacaucggcgugccucugcucgcgauuggguguuauagccaggucaaccccaucacccugacagccgcccuucugcuccugguggcccacuacgcuauuaucggaccuggccugcaggccaaagcuacccgggaggcccagaagcgcgcggccgcuggcauuaugaagaauccgacaguugaugggaucaccgugaucgaccucgaucccauuccuuaugaccccaaauuugaaaagcaacuuggacaggucaugcugcugauccucugcgugacgcagguccugaugaugagaacaaccugggcccuuugugaggcucugacacucgccaccggcccuauuuccacccugugggaagggaaccccggacgguucuggaauacaacgaucgccgugagcauggcgaacauuuuucgcggcucuuaccuggcuggggccggacuccuuuucuccaucaugaaaaauaccacaaacaccagacggggcacaggcaacaucggggagacccugggagagaaguggaaaagccgccugaaugcucucggcaagucugaauuucaaauuuauaaaaaguccgggauccaggagguugauagaacgcuggccaaggaaggaauuaaacggggcgagacagaccaccaugccgugagccgcgggucugcuaaacuuagaugguucgucgagcggaacauggugaccccggaaggaaaaguuguggaucugggcugcggcagagggggauggagcuacuauuguggcgggcucaagaauguccgcgaggugaaaggacugaccaagggcgggccuggacacgaggaacccauccccauguccacauacggcuggaaccuggugcggcuccagucuggcguugacgucuuuuucauuccucccgaaaagugcgauacccuucugugugacaucggggagagcuccccuaauccgacaguggaggccggaagaacgcugcgcgugcucaaccuggucgaaaauuggcuuaacaauaacacccaguucugcaucaaaguucugaaucccuacaugccuagcgugauugagaagauggaagcgcuccaacggaaauauggcggggcccuggugagaaacccccugucccgcaauucuacacaugagauguacugggucagcaacgcuuccggaaauaucgugucuagcguuaacaugauuucccggaugcucaucaacagauuuaccaugcgccacaagaaagccacauaugaaccugauguggaccuuggcucugggacccggaauauuggaaucgagagcgagauucccaaccuggacaucaucggcaagagaauugaaaagaucaaacaggagcaugaaacguccuggcacuacgaucaggaccacccguauaagaccugggcuuaccauggcagcuaugagacaaaacagaccgggucugccuccagcauggucaauggagugguucgccugcucacaaagccuugggaugugcugcccaccgucacacaaauggcgaugaccgacacgacaccuuucggccagcagcggguguuuaaagaaaagguggauaccagaacccaggagcccaaggaggggaccaagaaacuuaugaaaauuacggccgaauggcuguggaaggagcucggcaagaagaaaaccccucgcauguguacaagagaagaguucacccggaagguccgcucuaacgcugcccugggcgcuaucuuuacagacgagaauaaguggaaauccgccagagaagcuguugaggauagccgguucugggaacugguggacaaggagagaaaccuccaccuggaagggaaaugcgagaccuguguguacaauaugaugggaaagcgggagaagaaacuuggcgaauuuggcaaagccaaagggucucgcgcgauuugguacauguggcugggagccagauuccucgaguuugaagcucugggcuuccuuaacgaggaucauugguuuucccgggaaaauagccuguccggggucgagggagagggccuccacaagcugggguauauccugcgcgacgugagcaaaaaggaaggcggagccauguacgcugaugacacagccggcugggacaccagaaucacgcucgaggaucugaaaaacgaagagaugguuaccaaucacauggaaggggagcauaagaaacuugccgaggcgauuuucaaacugacauaucaaaacaaggugguccgggugcagcgccccaccccgagaggaacaguuauggacaucauuucucggcgcgaucagagaggcagcgggcaagugggaaccuacggccucaauacguuuacaaacauggaagcucagcugauccggcagauggagggggaaggcgucuucaaaaauauucagcaccuuaccgugacagaggagguugccgugcauaacuggcuggcccgcgucggaagagaacggcucucccgcauggcuaucucuggcgacgauugcguggucaagccucuggacgauagauucgccaacgcucugaccgcccucaaugacauggggaaaauccggaaggauauucaacagugggagcccagcaagggauggaacgacuggacacaggugcccuuuugcucccaccauuuccacgaacugaucaugaaagauggccggauucuuguugugccuugucgcaaucaggacgagcugaucgggcgggcgagaauuucucaaggagccggcuggagccuccgcgaaaccgcuugccuggggaaguccuaugcccagauguggucucuuauguacuuucaccggagagaucugcgccucgcugccaacgcgaucuguagcgccgucccgucccauugggugcccacaagccggaccacauggucuauucacgcuaaacaugaguggaugaccacagaggacaugcugaccguguggaauagaguuuggauccgcgaaaacccuuggauggaggacaagacgcccguggaauccugggaggaaaucccuuaucugggcaaacgggaggaucaguggugcggaagccucauuggccugacaucuagagccaccugggcuaagaauauccaggccgcuauuaaccaaguccgcucccuuaucgggaaugaggaauacaccgacuacaugcccagcaugaagcgguucagacgggaggaagaggaagccggagugcugugguga

SEQ ID NO: 20082 - RNA, 9876 nt, Artificial Sequence
  derived and/or modified CDS sequence (opt5) from DENV-2__FJ410228__SS-prME
agcgccggcaugaucauuaugcugauccccaccgugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauauccgcggcauuaugcaagcugggaagcggucucuuagaccucagcccaccgagcucaaauacagcuggaagacauggggaaaggccaaaaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaagaaaagcaggacgcuuuuugugacuccaaacugaugagcgccgcuaucaaggauaaucgggccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuacagaccuggauaccacacccagauugcuggccccuggcaucucgggaaacuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaggagaaagaagagaaucucguuaacagccuggugaccgccggacacggccagguggauaauuucucccuggggguccuuggaauggcucucuuucuggaagagaugcugcggacaagagugggcaccaagcaugcgauccuccugguugccgugucuuucgucacacuuauuaccgggaacaugagcuuuaaagaccugggacgcgugguugugauggucggcgcuacgauggccgaugacaucggcaugggggugaccuaucucgcccugcuggcugccuucaagguucggccuacauuugcggcuggacuucugcucagaaaacugaccuccaaggagcucaugaugacaaccauuggcaucgugcugcuuucucaaagcacgauucccgaaacaguccuggagcucaccgaugcccuggcccuggggaugauggugcuuaagaucgugcgcaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagaccgacuggaucccucucgcccugacgauuaagggacugaaccccaccgcuaucuuccuuacaacccugucuagaacaaauaaaaagcgguccuggccgcucaacgaggccaucauggcugugggcauggucagcauucuggccucuucccuccugaaaaaugacaucccuaugaccgggccccuuguggcgggaggccugcugacgguuugcuaugugcucacaggccgcagcgccgaucuggaacuugagagagcuaccgacgucaagugggaggaucaggccgaaauuucuggguccagcccuauccuguccauuaccaucagcgaggacggaucuaugagcauuaagaacgaagaggaggaacagacacucaccauccugauccggacaggccuccuggugauuuccgggcuuuuucccaucucuauuccgaucacggcugccgccugguaccugugggaggucaaaaagcagcgcgcuggagugcugugggauguuccuucucccccucccaugggcaaagcggaacucgaggacggggccuauagaauuaagcaaaaaggaauccugggcuacucccagaucggcgcugggguguacaaggaaggaaccuuccacacaauguggcaugucacccggggcgccgugcuuaugcacaaggggaaacgcauugagcccuccugggccgauguuaagaaagaccugaucagcuauggaggcggguggaagcucgagggagaauggaaagagggcgaagaggugcagguccuggcucucgaaccuggcaagaauccgagagccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugacccggagcggcgcuuaugucucugccaucgcccaaacagagaaauccaucgaggauaauccugaaauugaggacgauaucuuucgcaagagacggcugaccauuauggaccuccaccccggggcuggaaagacaaaaagauaccugccugccaucgugcgcgaagcgauuaagcggggccuuagaacgcugauccucgcuccgacccgcguuguggccgccgagauggaagaggcucugcgggggcuccccauuagauaucagaccccugccauccgcgcugagcauaccggacgggaaaucgucgaccugaugugucacgccaccuucacaaugagacuucugagccccgugcgcguuccuaacuacaaucugauuaucauggaugaggcgcauuucacggaccccgccucuauugcugcccggggcuauaucuccaccagaguggaaaugggggaggcugccggcauuuuuaugacagccaccccgccuggaagccgggaucccuucccccaguccaacgcuccuaucaucgacgaggaacgcgagauucccgaaagaucuuggaauagcggccacgagugggucacagauuuuaacgggaaaaccgugugguucguuccuuccaucaaggcgggaaaugacauugccgcuugccuccggaaaaacggcaagaaggugauccaacugagccgcaaaacguuugauucugaauacgucaagacaagaaccaaugacugggauuucguggugaccacagacauuuccgagaugggggccaacuuuaaagccgagcgggucaucgauccgagacgcuguaugaagcccguuauccuuaccgacggagaggaacgggugauucuggcuggcccuaugcccgugacacauagcucugccgcgcagagacgcgggcggaucggcagaaauccuaaaaacgaaaaugaccaguacauuuauaugggagagccccucgaaaacgaugaggacugcgcucacuggaaggaggccaaaaugcugcuggauaauaucaacaccccggaaggcauuaucccuagcauguucgagcccgaacgcgagaaggucgacgccauugauggggaauaccggcucagaggagaggcucgcaagacguuuguggaccuuaugagacggggcgaucugccuguuuggcuggccuauaaaguggcggccgaggggaucaacuacgcugaccgcagaugguguuucgauggaaucaagaauaaccagauucucgaagagaaugucgaaguggagaucuggacaaaagagggcgaacggaagaaacugaagccccgcuggcuugacgccagaauuuauuccgauccucuggcucucaaggaguuuaaagaguucgccgcugggcggaagucucugacccugaaccucaucacagagaugggcagacuucccaccuucaugacgcagaagacccgcgacgcccuggauaaucuggcgguucuccacacagccgaagcuggaggccgggccuacaaccaugcucugagcgagcuuccggagacccuggaaacacuccugcugcucacccuucuggccacagugaccgggggaauuuuucuguuccucauguccggcagagggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacagcgcaccccucaagacaaucagcuuaccuacguggucaucgcuauucugacagugguugccgccaccauggcuaacgaaaugggcuuucuggagaagacaaagaaagaccucgggcugggauccaucgccacgcagcagccggagagcaauauucuugauaucgaccugcggcccgcgucugccuggacccucuacgcuguggccacaaccuucgugacaccuaugcugagacauuccauugaaaacagcuccgucaauguuucucugaccgcuaucgccaaccaagcgacggugcucaugggccuugggaagggauggccccugagcaaaauggauaucggcgugccucugcucgccauuggguguuauucccaggucaaucccaucacccugacagcugcccuucugcuccugguggcucacuacgccauuaucggaccuggccugcaggcuaaggccacccgggaggcgcagaaacgcgccgcugccggcauuaugaagaacccgacaguugacgggaucaccgugaucgaucucgaccccauuccuuaugaucccaaguuugaaaaacaacuuggacaggucaugcugcugauccucugcgugacgcagguccugaugaugagaacaaccugggcucuuugugaggcccugacacucgccaccggcccuauuucuacccugugggaagggaaucccggacgguucuggaacacaacgaucgcggugagcauggcuaauauuuuucgcggcuccuaccuggccggggcuggacuccuuuucagcaucaugaagaacaccacaaacaccagacggggcacaggcaauaucggggagacccugggagagaaauggaagucucgccugaacgcccucggcaaauccgaauuucaaauuuauaagaaaagcgggauccaggagguugacagaacgcuggccaaggaaggaauuaagcggggcgagacagaucaccaugcugugucucgcggguccgccaaacuuagaugguucgucgagcggaauauggugaccccggaaggaaagguuguggaccugggcugcggcagagggggauggagcuacuauuguggcgggcucaaaaacguccgcgaggugaagggacugaccaaaggcgggccuggacacgaggaacccauccccaugucuacauacggcuggaaucuggugcggcuccagagcggcguugaugucuuuuucauuccucccgaaaagugcgacacccuucugugugauaucggggaguccucuccuaacccgacaguggaggcgggaagaacgcugcgcgugcucaaucuggucgaaaacuggcuuaauaacaauacccaguucugcaucaagguucugaaccccuacaugccuagcgugauugagaaaauggaagcccuccaacggaaguauggcggggcucuggugagaaauccccugucccgcaacagcacacaugagauguacugggucuccaaugccucuggaaacaucgugagcuccguuaacaugauuucucggaugcucaucaauagauuuaccaugcgccacaaaaaggcuacauaugaaccugacguggaccuuggcagcgggacccggaacauuggaaucgaguccgagauucccaaucuggauaucaucggcaaaagaauugaaaagaucaagcaggagcaugaaacgucuuggcacuacgaccaggaucacccguauaaaaccugggccuaccauggcagcuaugagacaaagcagaccggguccgcgagcucuauggucaacggagugguucgccugcucacaaaaccuugggacgugcugcccaccgucacacaaauggccaugaccgauacgacaccuuucggccagcagcggguguuuaaggaaaaaguggacaccagaacccaggagcccaaggaggggacaaagaaacuuaugaagauuacggcugaauggcuguggaaagagcucggaaagaaaaagaccccucgcauguguacaagagaagaguucacccggaaaguccgcuccaaugccgcucugggcgccaucuuuacagaugagaacaaguggaaaagcgcuagagaagccguugaggacucucgguucugggaacugguggauaaagagagaaaucuccaccuggaagggaagugcgagaccuguguguacaacaugaugggaaaacgggagaagaaacuuggcgaauuuggcaaggcgaaggggucccgcgccauuugguacauguggcugggagcuagauuccucgaguuugaagcccugggcuuccuuaaugaggaccauugguuuagccgggaaaacucucuguccggggucgagggagagggccuccacaaacugggguauauccugcgcgaugugagcaagaaagaaggcggagcuauguacgccgacgacacagccggcugggauaccagaaucacgcucgaggaccugaagaaugaagagaugguuaccaaccacauggaaggggagcauaagaaacuugcggaggcuauuuucaaacugacauaucaaaauaaagugguccgggugcagcgccccaccccgagaggaacaguuauggauaucauuucccggcgcgaccagagaggcagcgggcaagugggaaccuacggccucaacacguuuacaaauauggaagcccagcugauccggcagauggagggggaaggcgucuucaagaacauucagcaccuuaccgugacagaggagguugccgugcauaacuggcuggcucgcgucggaagagaacggcucucucgcauggccaucagcggcgaugacugcguggucaaaccucuggaugacagauucgcuaaugcccugaccgcgcucaacgauauggggaagauccggaaagacauucaacagugggagcccuccaagggauggaaugauuggacgcaaguccccuuuugcucucaccauuuccacgaacugaucaugaaggacggccggauucuuguugugccuugucgcaaccaggaugagcugaucgggcgggccagaauuagccaaggagcuggcuggucccuccgcgaaaccgccugccuggggaaaucuuaugcucagauguggagccuuauguacuuucaccggagagaccugcgccucgccgcgaaugccaucuguuccgcugucccgucucauugggugcccacaagccggaccacaugguccauucacgccaagcaugaguggaugaccacagaggacaugcugaccguguggaacagaguuuggauccgcgaaaauccuuggauggaggauaaaacgcccguggaaagcugggaggaaaucccuuaucugggcaagcgggaggaccaguggugcggaucucucauuggccugacauccagagcuaccugggccaaaaacauccaggcugccauuaaucaaguccgcagccuuaucgggaacgaggaauacaccgauuacaugcccucuaugaagcgguucagacgggaggaagaggaagcgggagugcugugguga

SEQ ID NO: 20083 - RNA, 9876 nt, Artificial Sequence
  derived and/or modified CDS sequence (opt5) from DENV-2__FJ410233__SS-prME
agcgccggcaugaucauuaugcugauccccaccgucauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucaacuuuugugauggaacgacagugaucgucaccgaagacugcggcaauagagggcccagccugcgcaccacaaccgccucuggaaagcucauuacggaguggugcugucgguccugcacacugccuccgcuuagauaucggggcgaggauggcuguugguacgggauggaaauccgcccccugaaagagaaggaagagaaccucguuaauagccuggugaccgccggacacggccaaguggacaacuucucccuggggguccuuggaauggcucucuuucuggaagagaugcugagaacacgggugggcaccaaacaugcgauccuccugguugccgugucuuucgucacacuuauuaccgggaauaugagcuuuaaggaucugggaagagugguugugauggucggcgcuacgaugaccgacgauaucggcaugggggugacauaucucgcccugcuggccgcuuucaaaguucgcccuaccuuugccgcgggacuucugcuccggaagcugacauccaaggagcucaugaugaccacgauuggcaucgugcugcuuucucagagcacaauucccgaaaccguccuggagcucacagacgcucuggcccuggggaugauggugcuuaaaaucgugagaaacauggaaaaguaccagcuggccgucaccaucauggcuauucucugcguuccuaaugccgugauccugcagaacgcguggaaaguguccuguaccauucucgcugucgugucuguuagcccccugcuucugacauccagccaacagaagacggauuggaucccucucgcccugaccauuaaaggacugaaucccacagccaucuuccuuaccacacugucucgcaccaacaagaaaagauccuggccgcucaaugaggcuaucauggccgugggcauggucagcauucuggcuucuucccuccugaagaacgacaucccuaugacggggccccuuguggccggaggccugcugacaguuugcuaugugcucaccggccggagcgcggaccuggaacuugagcgcgccaccgaugucaagugggaggaccaggcugaaauuucuggguccagcccuauccuguccauuacaaucagcgaggauggaucuaugagcauuaaaaaugaagaggaggaacagacccucacaauccugaucagaacgggccuccuggugauuuccgggcuuuuucccaucucuauuccgaucaccgccgcugccugguaccugugggaggucaagaaacaacgggccggagugcugugggacguuccuucucccccucccaugggcaaggcugaacucgaggauggggcguaucgcauuaaacagaagggaauccugggcuacucccagaucggcgccgggguguacaaggaaggaacauuccacaccauguggcaugucacaagaggcgcugugcuuaugcacaaagggaagcggauugagcccuccugggccgacguuaaaaaggaucugaucagcuauggaggcggguggaaacucgagggagaauggaaggagggcgaagaggugcagguccuggcccucgaaccuggcaagaacccgcgcgcugugcaaaccaaacccgggcuguuuaagacgaacaccggaacaauuggcgccgugucccuugacuucucuccugggaccagcggaucccccaucauugauaaaaagggcaaaguugucgggcuguacggaaauggcguggugacaagaagcggcgcguaugucucugcuaucgcccagaccgagaaguccaucgaggacaacccugaaauugaggaugacaucuuucggaagcgcagacugacaauuauggaucuccaccccggggccggaaaaacgaagcgguaccugccugcuaucgugagagaagccauuaaacgcggccuucggacccugauccucgcgccgacaagaguuguggcugccgagauggaagaggcccugcgcgggcuccccauucgguaucagaccccugcuaucagagccgagcauaccggacgcgaaaucgucgaccugaugugucacgcuacauucacgaugcggcuucugagccccgugagaguuccuaauuacaaccugauuaucauggacgaggcccauuucaccgaucccgcgucuauugccgcucgcggcuauaucuccacacggguggaaaugggggaggccgcuggcauuuuuaugaccgccacaccgccuggaagcagagaccccuucccccaauccaaugccccuaucaucgaugaggaacgggagauucccgaacgcucuuggaacagcggccacgagugggucaccgacuuuaaggggaaaacggugugguucguuccuuccaucaaggcuggaaaugauauugcggccugccucagaaagaacggcaaaaaggugauccagcugagccggaaaacauuugacucugaauacgucaagacccgcaccaaugauugggacuucguggugacaaccgauauuuccgagaugggggcuaacuuuaaagccgagagagucaucgacccgcggagauguaugaagcccguuauccuuacagauggagaggaacgcgugauucuggccggcccuaugcccgugacccauagcucugcugcccagcggagagggcgcaucggccggaauccuaaaaacgaaaaugaccaguacauuuauaugggagagccccucgaaaacgacgaggauugcgcgcacuggaaggaggcuaagaugcugcuggacaauaucaacacgccggaaggcauuaucccuagcauguucgagcccgaaagagagaaagucgaugccauugacggggaauaccgccuccggggagaggccagaaagacauuuguggaucuuaugcgcagaggcgaccugccuguuuggcuggcuuauaaaguggccgcggaggggaucaacuacgccgaucggcgcugguguuucgacggaaucaagaauaaccaaauucucgaagagaauauggaagucgagaucuggaccaaagagggcgaaagaaagaagcugaaaccccgguggcuugaugcucgcauuuauuccgacccucuggcccucaaggaguuuaaagaguucgcugccgggagaaagucucugacacugaaccucaucaccgagaugggccggcuucccacguucaugacccagaaaacaagagaugcucuggacaaucuggccgugcuccacaccgcggaagccggaggccgcgcuuacaaccaugcccugagcgagcuuccggagacacuggaaacccuccugcugcucacacuucuggcuaccguuacagggggaauuuuucuguuccucauguccggccgggggaucggaaagaugacacugggcaugugcugcaucauuaccgccucuauccuucugugguaugcccagauucagccucacuggaucgcugcgagcauuauccucgaguuuuuccugaucgugcugcucauucccgaacccgagaagcaaagaaccccucaggauaaucagcuuacauacgucgugaucgccauucugaccgucguggcugccacaauggccaacgaaaugggcuuucuggagaaaacgaagaaagaccucgggcugggauccaucgcuacccgccagccggagagcaauauucuugacaucgaucugcggcccgccucugcguggacacucuacgccguugcuaccacauucgugaccccuaugcugagacauuccauugaaaacagcuccgugaaugucucucugacggccaucgcuaaccaagccaccguucucaugggccuugggaagggauggccccugagcaaaauggacaucggcgugccucugcucgcgauuggguguuauucccaggugaaucccaucacacugaccgccgcccuucugcuccuggucgcccacuacgcuauuaucggaccuggccugcaggccaaggcuacacgggaggcccagaagcgcgcggccgcuggcauuaugaaaaacccgaccguggaugggaucacgguuaucgaccucgaucccauuccuuaugaccccaaguuugaaaaacaacuuggacaggugaugcugcugguccucugcgugacacagguccugaugaugagaaccacaugggcccuuugugaggcucugacccucgccaccggcccuaucucuacacugugggaagggaaucccggacgguucuggaacacgaccauugccgugagcauggcgaauaucuuucgcggcuccuaccuggcuggggccggacuccuuuucagcauuaugaagaacacaaccaacacaagacggggcaccggcaauaugggggagacgcugggagagaaauggaagucucgccugaacgcucucggcaaauccgaauuucaaaucuauaaaaagagcgggauccaggagguugauagaacacuggccaaagaaggaauuaagcggggcgagaccgaccaccaugccgugucucgcggguccgcuaaacuuagaugguucgucgagcggaauauggugaccccggaaggaaagguuguggaucugggcugcggcagagggggauggagcuacuauuguggcgggcucaaaaacguccgcgaggugaagggacugacaaagggcgggccuggacacgaagaacccauccccaugucuaccuacggcuggaaucuggugcggcuccagagcggcguugacgucuuuuucauuccucccgaaaaaugcgauacacuucugugugacaucggggaguccucuccuaacccgacgguggaggccggaagaacccugcgcgugcucaaucuggucgaaaacuggcuuaauaacaauacacaguucugcauuaagguucugaaccccuacaugccuagcgugaucgagaaaauggaagcgcuccaacggaaguauggcggggcccuggugagaaauccccugucccgcaacagcacccaugagauguacugggucuccaaugcuucuggaaacaucgugagcuccguuaacaugauuucucggaugcucaucaauagauuuacaaugcgccacaaaaaggccaccuaugaaccugauguggaccuuggcagcgggacgcggaacauuggaaucgaguccgagauucccaaucuggacaucauuggcaagagaaucgagaagaucaagcaggagcaugaaaccucuuggcacuacgaucaggaccacccguauaaaacaugggcuuaccauggcagcuaugagaccaagcagacaggguccgccagcucuauggucaacggagugguucgccugcucaccaaaccuugggaugugcugcccacagucacccaaauggcgaugacggacacaaccccuuucggccagcagcggguguuuaaggaaaagguggauaccagaacacaggagcccaaagaggggacgaagaaacuuaugaagauuaccgccgaauggcuguggaaagagcucggaaagaaaaagacaccucgcauguguaccagagaagaguucacacggaagguccgcuccaaugcugcccugggcgcuaucuuuaccgacgagaacaaauggaaaagcgccagagaagcuguugaggauucucgguucugggaacugguggacaaagagagaaaucuccaccuggaagggaagugcgagacauguguguacaacaugaugggaaaacgggagaagaaacuuggcgaauuuggcaaagccaaggggucccgcgcgauuugguacauguggcugggagccagauuccucgaguuugaagcucugggcuuccuuaaugaggaucauugguuuagccgggaaaacucucuguccggggucgagggagagggccuccacaaacugggguauauccugcgcgacgugagcaagaaagaaggcggagccauguacgcugaugacaccgccggcugggacacgagaauuacccucgaggaucugaagaaugaagagaugguuacaaaccacauggaaggggagcauaagaaacuugccgaggcgaucuucaagcugaccuaucaaaauaaagugguccgggugcagcgccccacaccgagaggaaccguuauggacaucauuucccggcgcgaucagagaggcagcgggcaagugggaacguacggccucaacacauuuaccaauauggaagcucagcugauccggcagauggagggggaaggcgucuucaagaacauucagcaccuuacagugaccgaggagguugccgugaaaaacuggcuggcccgcgucggaagagaacggcucucucgcauggcuaucagcggcgacgauugcguggucaagccucuggacgauagauucgccaaugcucugacggcccucaacgacauggggaagauucggaaagauauccaacagugggagcccuccaagggauggaaugacuggacccaggugcccuuuugcucucaucacuuccaugaacugaucaugaaagauggcagaguucuuguggucccuugucgcaaccaggacgagcugauugggcgggcgagaaucagccaaggagccggcuggucccuccgcgaaacagcuugccuggggaagucuuaugcccagauguggagccuuauguacuuucaccggagagaucugcgccucgcugccaaugcgauuuguuccgccgugccgucucacugggugcccaccagccggacaaccugguccauccaugcuaaacacgaguggaugacaaccgaggacaugcugacgguuuggaacagaguguggauucgcgaaaauccuuggauggaggacaagacacccgucgaaagcugggaggaaaucccuuaucugggcaagcgggaggaucaguggugcggaucucucauuggccugaccuccagagccaccugggcuaaaaacauccaggccgcuaucaaucaagugcgcagccuuauugggaacgaggaauacacagacuacaugcccucuaugaagcgguucagacgggaggaagaggaagccggaguucugugguga

SEQ ID NO: 20084 - RNA, 9876 nt, Artificial Sequence
  derived and/or modified CDS sequence (opt5) from DENV-2__FJ410237__SS-prME
agcgccggcaugaucauuaugcugauccccaccgugauggcuuuccaccugaccacgcggaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgaugaccgaugacaucggcaugggggugacauaucucgcccugcuggccgcuuucaaaguucgcccuaccuuugccgcgggacuucugcuccggaagcugacauccaaggagcucaugaugaccacgauuggcaucgugcugcuuucucagagcacaauucccgaaaccguccuggagcucacagaugcucuggcccuggggaugauggugcuuaaaaucgugagaaauauggaaaaguaccagcuggccgucaccaucauggcuauucucugcguuccuaacgccgugauccugcagaaugcguggaaaguguccuguaccauucucgcugucgugucuguuagcccccugcuucugacauccagccaacagaagacggacuggaucccucucgcccugaccauuaaaggacugaaccccacagccaucuuccuuaccacacugucucgcaccaauaagaaaagauccuggccgcucaacgaggcuaucauggccgugggcauggucagcauucuggcuucuucccuccugaagaaugacaucccuaugacggggccccuuguggccggaggccugcugacaguuugcuaugugcucaccggccggagcgcggaucuggaacuugagcgcgccaccgacgucaagugggaggaucaggcugaaauuucuggguccagcccuauccuguccauuacaaucagcgaggacggaucuaugagcauuaaaaacgaagaggaggaacagacccucacaauccugaucagaacgggccuccuggugauuuccgggcuuuuucccaucucuauuccgaucaccgccgcugccugguaccugugggaggucaagaaacaacgggccggagugcugugggauguuccuucucccccucccaugggcaaggcugaacucgaggacggggcguaucgcauuaaacagaagggaauccugggcuacucccagaucggcgccgggguguacaaggaaggaacauuccacaccauguggcaugucacaagaggcgcugugcuuaugcacaaagggaagcggauugagcccuccugggccgauguuaaaaaggaccugaucagcuauggaggcggguggaaacucgagggagaauggaaggagggcgaagaggugcagguccuggcccucgaaccuggcaagaauccgcgcgcugugcaaaccaaacccgggcuguuuaagacgaacaccggaacaauuggcgccgugucccuugauuucucuccugggaccagcggaucccccaucauugacaaaaagggcaaaguugucgggcuguacggaaacggcguggugacaagaagcggcgcguaugucucugcuaucgcccagaccgagaaguccaucgaggauaauccugaaauugaggacgauaucuuucggaagcgcagacugacaauuauggaccuccaccccggggccggaaaaacgaagcgguaccugccugcuaucgugagagaagccauuaaacgcggccuucggacccugauccucgcgccgacaagaguuguggcugccgagauggaagaggcccugcgcgggcuccccauucgguaucagaccccugcuaucagagccgagcauaccggacgcgaaaucgucgaccugaugugucacgcuacauucacgaugcggcuucugagccccgugagaguuccuaacuacaaucugauuaucauggaugaggcccauuucaccgaccccgcgucuauugccgcucgcggcuauaucuccacacggguggaaaugggggaggccgcuggcauuuuuaugaccgccacaccgccuggaagcagagaucccuucccccaauccaacgccccuaucaucgacgaggaacgggagauucccgaacgcucuuggaauagcggccacgagugggucaccgauuuuaaggggaaaacggugugguucguuccuuccaucaaggcuggaaacgacauugcggccugccucagaaagaauggcaaaaaggugauccagcugagccggaaaacauuugauucugaauacgucaagacccgcaccaacgacugggauuucguggugacaaccgacauuuccgagaugggggcuaauuuuaaagccgagagagucaucgauccgcggagauguaugaagcccguuauccuuacagacggagaggaacgcgugauucuggccggcccuaugcccgugacccauagcucugcugcccagcggagagggcgcaucggccggaacccuaaaaaugaaaacgaccaguacauuuauaugggagagccccucgaaaaugaugaggacugcgcgcacuggaaggaggcuaagaugcugcuggauaacaucaauacgccggaaggcauuaucccuagcauguucgagcccgaaagagagaaagucgacgccauugauggggaauaccgccuccggggagaggccagaaagacauuuguggaccuuaugcgcagaggcgaucugccuguuuggcuggcuuauaaaguggccgcggaggggaucaacuacgccgaccggcgcugguguuucgauggaaucaagaacaaucaaauucucgaagagaacgucgaaguggagaucuggaccaaagagggcgaaagaaagaagcugaaaccccgguggcuugacgcucgcauuuauuccgauccucuggcccucaaggaguuuaaagaguucgcugccgggagaaagucucugacacugaaucucaucaccgagaugggccggcuucccacguucaugacccagaaaacaagagacgcucuggauaaccuggccguucuccacaccgcggaagccggaggccgcgcuuacaaucaugcccugagcgagcuuccggagacacuggaaacccuccugcugcucacacuucuggcuaccgugacagggggaauuuuucuguuccucauguccggccgggggaucggaaagaugacacugggcaugugcugcaucauuaccgccucuauccuucugugguaugcccagauucagccucacuggaucgcugcgagcauuauccucgaguuuuuccugaucguccugcucauucccgaacccgagaagcaaagaaccccucaggacaaccagcuuacauacguggucaucgccauucugaccgugguugcugccacaauggccaaugaaaugggcuuucuggagaaaacgaagaaagaccucgggcugggauccaucgcuacccagcaaccggagagcaacauucuugauaucgaccugcgccccgccucugcguggacacucuacgccguggcuaccacauucgugaccccuaugcugcggcauuccauugaaaauagcuccgucaacguuucucugacggccaucgcuaaucaggccaccgugcucaugggccuugggaagggauggccccugagcaaaauggauaucggcgugccucugcucgcgauuggguguuauucccaggucaaccccaucacacugaccgccgcccuucugcuccugguggcccacuacgcuauuaucggaccuggccugcaggccaaggcuacaagagaggcccaaaagcgggcggccgcuggcauuaugaaaaauccgaccguugacgggaucacggugaucgaucucgaccccauuccuuaugaucccaaguuugaaaaacagcuuggacaggucaugcugcugauccucugcgugacacaaguccugaugaugcgcaccacaugggcccuuugugaggcucugacccucgccaccggcccuauuucuacacugugggaagggaaccccggaagauucuggaauacgaccaucgccgugagcauggcgaacauuuuucggggcuccuaccuggcuggggccggacuccuuuucagcaucaugaagaauacaaccaacacacgcagaggcaccggcaacaugggggagacgcugggagagaaauggaagucucggcugaaugcucucggcaaauccgaauuucagaucuauaaaaagagcgggauucaggagguugaccgcacacuggccaaagaaggaaucaagagaggcgagaccgaucaccaugccgugucucggggguccgcuaaacuucgcugguucgucgagagaaacauggugaccccggaaggaaagguuguggaccugggcugcggcagagggggauggagcuacuauuguggcgggcucaaaaauguccgggaggugaagggacugacaaagggcgggccuggacacgaagaacccauucccaugucuaccuacggcuggaaccuggugcgccuccagagcggcguugaugucuuuuucaucccucccgaaaaaugcgacacacuucugugugauauuggggaguccucuccuaauccgacgguggaggccggacggacccugagagugcucaaccuggucgaaaauuggcuuaacaauaacacacaauucugcaucaagguucugaaucccuacaugccuagcgugaucgagaaaauggaagcgcuccagcgcaaguauggcggggcccuggugcggaacccccuguccagaaauagcacccaugagauguacugggucuccaacgcuucuggaaauauugugagcuccguuaacaugaucucucgcaugcucauuaaccgguuuacaaugagacacaaaaaggccaccuaugaaccugacguggaccuuggcagcgggacgcgcaauaucggaauugaguccgagauccccaaccuggauauuaucggcaagcggaucgagaagauuaagcaggagcaugaaaccucuuggcacuacgaccaggaucacccguauaaaacaugggcuuaccauggcagcuaugagaccaagcaaacaggguccgccagcucuauggucaauggagugguuagacugcucaccaaaccuugggacgugcugcccacagucacccagauggcgaugacggauacaaccccuuucggccagcagcgcguguuuaaggaaaagguggacacccggacacaagagcccaaagaggggacgaagaaacuuaugaagaucaccgccgaauggcuguggaaagagcucggaaagaaaaagacaccuagaauguguacccgcgaagaguucacaagaaagguccgguccaacgcugcccugggcgcuauuuuuaccgaugagaauaaauggaaaagcgcccgcgaagcuguugaggacucuagauucugggaacugguggauaaagagcggaaccuccaccuggaagggaagugcgagacauguguguacaauaugaugggaaaaagagagaagaaacuuggcgaauuuggcaaagccaaggggucccgggcgaucugguacauguggcugggagcccgcuuccucgaguuugaagcucugggcuuccuuaacgaggaccauugguuuagcagagaaaauucucuguccggggucgagggagagggccuccacaaacugggguauauucugcgggaugugagcaagaaagaaggcggagccauguacgcugacgacaccgccggcugggauacgcgcaucacccucgaggaccugaagaacgaagagaugguuacaaaucacauggaaggggagcauaagaaacuugccgaggcgaucuucaagcugaccuaucagaacaaaguggucagagugcagcggcccacaccgcgcggaaccguuauggauauuaucuccagacgggaccaacgcggcagcgggcaggucggaacguacggccucaauacauuuaccaacauggaagcucagcugauuagacagauggagggggaaggcgucuucaagaauauccaacaccuuacagugaccgaggagguugccgugaaaaacuggcuggcccgggucggacgcgaaagacucucucggauggcuauuagcggcgaugacugcguggucaagccucuggaugaccgcuucgccaacgcucugacggcccucaaugauauggggaagaucagaaaagacauccagcagugggagcccuccaagggauggauugauuggacccaggugcccuuuugcucucaucacuuccaugaacugaucaugaaagacggccggguucuuguggucccuuguagaaaccaagaugagcugauugggcgcgcgcggaucagccagggagccggcuggucccucagagaaacagcuugccuggggaagucuuaugcccagauguggagccuuauguacuuucaccgccgggaccugagacucgcugccaaugcgauuuguuccgccgugccgucucacugggugcccaccagccgcacaaccugguccauccaugcuaaacacgaguggaugacaaccgaggacaugcugacgguuuggaaccggguguggauuagagaaaauccuuggauggaggauaagacacccgucgaaagcugggaggaaaucccuuaucugggcaagcgcgaggaccaguggugcggaucucucaucggccugaccucccgggccaccugggcuaaaaacauucaagccgcuaucaaucaggugagaagccuuauugggaacgaggaauacgccgauuacaugcccucuaugaagcgcuuccggagagaggaagaggaagcgggaguucugugguga

SEQ ID NO: 20085 - RNA, 9876 nt, Artificial Sequence
  derived and/or modified CDS sequence (opt5) from DENV-2__FJ410241__SS-prME
agcgccggcaugaucauuaugcugauccccaccgugauggcuuuccaccugaccacgcggaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugaaaacaagagugggcaccaagcaugcgauccuccugguugccgugucuuucgucacacuuauuaccgggaacaugagcuuuaaagaccugggacgggugguugugauggucggcgcuacgauggccgaugacaucggcaugggggugaccuaucucgcccugcuggcugccuucaagguuagaccuacauuugcggcuggacuucugcuccgcaagcugaccuccaaagagcucaugaugacaaccauuggcaucgugcugcuuucucagagcacgauucccgaaacaguccuggagcucaccgaugcccuggcccuggggaugauggugcuucggaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccaacagaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacaacgggcuggagugcugugggauguuccuucucccccucccaugggcaaggcggaacucgaggacggggccuaucgcauuaaacagaagggaauccugggcuacucccagaucggcgcugggguguacaaggaaggaaccuuccacacaauguggcaugucaccagaggcgccgugcuuaugcacaaagggaagcggauugagcccuccugggccgauguuaaaaaggaccugaucagcuauggaggcggguggaaacucgagggagaauggaaggagggcgaagaggugcagguccuggcucucgaaccuggcaagaauccgcgcgccgugcaaacaaaacccgggcuguuuaagaccaacacgggaaccauuggcgcggugucccuugauuucucuccugggacaagcggaucccccaucauugacaaaaagggcaaaguugucgggcuguacggaaacggcguggugaccagaagcggcgcuuaugucucugccaucgcccagacagagaaguccaucgaggauaauccugaaauugaggacgauaucuuucggaagcgcagacugaccauuauggaccuccaccccggggcuggaaaaacaaagcgguaccugccugccaucgugagagaagcgauuaaacgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaauccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccucagaaagaauggcaaaaaggugauccagcugagccggaaaacguuugauucugaauacgucaagacacgcaccaacgacugggauuucguggugaccacagacauuuccgagaugggggccaauuuuaaagccgagagagucaucgauccgcggagauguaugaagcccguuauccuuaccgacggagaggaacgcgugauucuggcuggcccuaugcccgugacacauagcucugccgcgcagcggagagggcgcaucggccggaacccuaaaaaugaaaacgaccaguacauuuauaugggagagccccucgaaaaugaugaggacugcgcucacuggaaggaggccaagaugcugcuggauaacaucaauaccccggaaggcauuaucccuagcauguucgagcccgaaagagagaaagucgacgccauugauggggaauaccgccuccggggagaggcuagaaagacguuuguggaccuuaugcgcagaggcgaucugccuguuuggcuggccuauaaaguggcggccgaggggaucaacuacgcugaccggcgcugguguuucgauggaaucaagaacaaucaaauucucgaagagaacgucgaaguggagaucuggacaaaagagggcgaaagaaagaagcugaaaccccgguggcuugacgcccgcauuuauuccgauccucuggcucucaaggaguuuaaagaguucgccgcugggagaaagucucugacccugaaucucaucacagagaugggccggcuucccaccuucaugacgcagaaaaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaagcaaagaaccccucaggacaaccagcuuaccuacguggucaucgcuauucugacagugguugccgccaccauggcuaaugaaaugggcuuucuggagaaaacaaagaaagaccucgggcugggauccaucgccacgcagcaacuugagagcaacauucuggauaucgaccuccgcccggcgucugccuggacccuguacgcuguggccacaaccuucgugacacccaugcugcggcauuccauugaaaauagcuccgucaacguuucucucaccgcuaucgccaaucaggcgacggugcuuaugggccuggggaagggauggccucugagcaaaauggauaucggcgugccccuccuggccauuggguguuauucccaggucaacccuaucacccuuacagcugcccugcuccugcugguggcucacuacgccauuaucggacccggccuccaggcuaaggccaccagagaggcgcaaaagcgggccgcugccggcauuaugaaaaauccuacaguugacgggaucaccgugaucgaucuugacccgauucccuaugauccuaaguuugaaaaacagcugggacaggucaugcugcucauccugugcgugacgcaaguccuuaugaugcgcacaaccugggcucugugugaggcccucacacuggccaccggccccauuucuacccugugggaagggaacccuggaagauucuggaauacaacgaucgcggugagcauggcuaacauuuuucggggcuccuaccucgccggggcuggacuucuguucagcaucaugaagaauaccacaaacacccgcagaggcacaggcaacaugggggagacccugggagagaaauggaagucucggcucaaugcccugggcaaauccgaauuucagaucuauaaaaagagcgggauucaggagguugaccgcacgcuugccaaagaaggaaucaagagaggcgagacagaucaccaugcugugucucggggguccgccaaacugcgcugguucgucgagagaaacauggugacccccgaaggaaagguuguggaccucggcugcggcagagggggauggagcuacuauuguggcgggcugaaaaauguccgggaggugaagggacugaccaagggcgggccgggacacgaagaaccuauucccaugucuacauacggcuggaaccucgugcgccuucagagcggcguugaugucuuuuucauucccccugaaaaaugcgacacccugcugugugauauuggggaguccucucccaauccuacaguggaggcgggacggacgcucagagugcugaaccuugucgaaaauuggcugaacaauaacacccaauucugcaucaagguucucaauccguacaugcccagcgugaucgagaaaauggaagcccugcagcgcaaguauggcggggcucuggugcggaacccucucuccagaaauagcacacaugagauguacugggucuccaacgccucuggaaauauugugagcuccguuaacaugaucucucgcaugcuuauuaaccgguuuaccaugagacacaaaaaggcuacauaugaacccgacguggaccugggcagcgggacccgcaauaucggaauugaguccgagaucccuaaccuggauauuaucggcaagcggaucgagaagaucaagcaggagcaugaaacgucuuggcacuacgaccaggaucaccccuauaaaaccugggccuaccauggcagcuaugagacaaagcaaaccggguccgcgagcucuauggucaauggagugguuagacuccugacaaaaccgugggacgugcuuccuaccgucacacagauggccaugaccgauacgacacccuucggccagcagcgcguguuuaaggaaaagguggacacccggacccaagagccuaaagaggggacaaagaaacugaugaagaucacggcugaauggcucuggaaagagcugggaaagaaaaagacccccagaauguguacacgcgaagaguucaccagaaagguccgguccaacgccgcucugggcgccauuuuuacagaugagaauaaauggaaaagcgcucgcgaagccguugaggacucuagauucugggaacucguggauaaagagcggaaccugcaccuugaagggaagugcgagaccuguguguacaauaugaugggaaaaagagagaagaagcugggcgaauuuggcaaagcgaaggggucccgggccaucugguacauguggcucggagcucgcuuccuggaguuugaagcccuuggcuuccugaacgaggaccauugguuuagcagagaaaauucucucuccggggucgagggagagggccugcacaaacugggguauauucuccgggaugugagcaagaaagaaggcggagcuauguacgccgacgacacagccggcugggauacccgcaucacgcuggaggaccuuaagaacgaagagaugguuaccaaucacauggaaggggagcauaagaaacuggcggaggcuaucuucaagcucacauaucagaacaaaguggucagagugcagcggccuacaccccgcggaacaguuauggauauuaucuccagacgggaccaacgcggcagcgggcaggucggaaccuacggccugaauacguuuacaaacauggaagcccagcuuauuagacagauggagggggaaggcgucuucaagaauauccaacaccugaccgugacagaggagguugccgugcagaacuggcucgcucgggucggacgcgaaagacugucucggauggccauuagcggcgaugacugcguggucaaaccgcuggaugaccgcuucgcuaacgcccucaccgcgcugaaugauauggggaagaucagaaaggacauccagcagugggagccuuccaaaggauggaacgauuggacgcaagugcccuuuugcucucaucacuuccaugaacuuauuaugaaggacggccggguucuggugguccccuguagaaaucaggaugagcucaucgggcgcgcccggauuagccagggagcuggcuggucccugagagaaaccgccugccuugggaaaucuuaugcucagauguggagccugauguacuuucaccgccgggaccucagacuggccgcgaacgccaucuguuccgcugugccuucucacugggugccgacaagccgcaccacaugguccauucaugccaagcacgaguggaugaccacagaggacaugcugaccguuuggaaucggguguggaucagagaaaaccccuggauggaggauaaaacgccugucgaaagcugggaggaaauucccuaucucggcaagcgcgaggaccaauggugcggaucucugaucggccuuacaucccgggcuaccugggccaagaauauccaggcugccauuaaccaggugagaagccugaucgggaaugaggaauacaccgauuacaugccuucuaugaaacgcuuccggagagaggaagaggaagcgggaguucucugguga

SEQ ID NO: 20086 - RNA, 9876 nt, Artificial Sequence
  derived and/or modified CDS sequence (opt5) from DENV-2__FJ410259__SS-prME
agcgccggaaugaucauuaugcugauccccaccgugauggcuuuccaccugaccacgcggaauggggagccucauaugauuguuggaauccaggaaaagggaaagucccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauuguuaccugcgcuauguuuacaugcaagaaaaacauggaaggcaagaucguccagccugagaaucucgaauacacgauuguggugacaccccacucuggggaggagcaugccgucggaaacgacacaggcaaacacggcauggaaaucaaggugaccccucaguccagcacaaccgaggcggaacugacgggguauggaaccguuacaauggaguguucucccagaaccggccuugauuucaaugaaauggugcugcuccaaauggagaacaaagccuggcugguccaccggcagugguuucuugaccugccgcucccuuggcugcccggggcugauaagcaggaguccaauuggauccagaaggaaacacuggugaccuucaaaaacccucaugccaagaaacaagacguugugguccucggaagccaggagggcgcuaugcacacggcccugacaggggccaccgaaauucagauguccucuggcaaucuucuguuuacaggacaucucaagugccgccugagaauggacaaacuucaacugaagggcaugagcuacuccauguguaccgggaaguucaaaguggucaaggagaucgcugagacccagcacggaacaauugugauccggguucaguaugaaggcgaugggagccccugcaaaauucccuucgagaucauggaccucgaaaagagauacgugcugggacgccugaucacggucaacccuauugugaccgagaaagauucuccgguuaacaucgaagcggagcccccuuuuggcgacuccuacauuaucauugggguggagcccggccagcucaagcugaauugguucaagaaaggaagcucuaucggccaaauguuugaaacaaccaugagaggggcuaagagaauggcuauucuuggagauacagccugggacuucggcagccucgggggagucuuuaccuccaucggcaaagcccuccaucagguguucggggcuaucuauggcgccgcguuuucuggagugagcuggacgaugaagauucugaucggcguuauuaucacauggauugggaugaacucccgcagcaccucucuguccgucagccuugugcucgugggaaucgucacccuguaccugggcgugaugguucaggcugauucuggguguguggucuccuggaaaaauaaggagcucaagugcggaagcggcaucuucauuacagacaacgugcacaccuggacagaacaguauaaauuucaaccugagucccccucuaagcuggccagcgccauccagaaagcucaggaagaggggauuuguggcauccgguccguuacgagacuugagaaucugauguggaagcagauuaccccggaacucaaccacauccuggccgagaaugaagugaaacugacaaucaugaccggagauauucgcggcaucaugcaagcugggaagcggucucuuagaccucagcccacagagcucaaauacagcuggaagaccuggggaaaggccaaaaugcuguccacggaaagcuauaaccagaccuuccugauugacggcccugagacagcggagugccccaauaccaaccgcgccuggaacucucucgaagucgaggauuacggguuuggaguguucacaaccaacaucuggcugaaacuuaaagaaaagcaggacgcuuuuugugacuccaaacugaugagcgccgcuauuaaggauaaucgggccguucaugcggacaugggcuauuggaucgagucugcccucaacgauacauggaagaucgagaaggcuagcuucauugaagugaagaauugccacuggccuaaaagccauacccuguggucuaacggcguccuggagagcgaaaugaucauucccaagaaccuugccgggccggugucccaacacaauuacagaccuggauaccacacgcagaucgcuggccccuggcaucucgggaaacuggagauggacuucgauuuuugugacggaacaaccgugauugucaccgaagauugcggcaaccgcgggcccagccugcggacaaccacggccucuggaaagcucaucacagaguggugcuguagauccugcacccugccuccgcuucgguaucgcggcgaggacggcuguugguacgggauggaaauuagaccccugaaggagaaagaagagaaucucguuaacagccuggugacagccggacacggccagguggauaauuucucccuggggguccuuggaauggcucucuuucuggaagagaugcugcggaccagagugggcacaaagcaugcgauccuccuggccgcuguuucuuucgugacccuuaucacggggaacaugagcuuuaaagaccugggacgcgucgugguuauggugggcgccaccauggccgaugacauuggcaugggggucacauaucucgcucugcuggccgcguucaaggugcggccuaccuuugcugccggacuucugcucagaaaacugacauccaaggagcucaugaugaccacgaucggcauuguucugcuuucucaaagcacaauccccgaaaccgugcuggagcucacagaugcccuggcucuggggaugaugguccuuaagauugugcgcaauauggaaaaauaccagcuggccgugaccaucauggcgauccucugcgucccuaacgcuguuauucugcagaaugccuggaagguguccuguaccauccucgccguggucucugugagcccccugcuucugacauccagccagcagaagacggacuggauuccucucgcucugaccaucaagggacugaaccccacagccauuuuccuuaccacacugucuagaaccaauaaaaagcgguccuggccgcucaacgaggcuaucauggccguuggcauggugagcauccuggcgucuucccuccugaaaaaugacauuccuaugacggggccccuugucgccggaggccugcugacagugugcuauguucucaccggccgcagcgcugaucuggaacuugagagagccaccgacgugaagugggaggaucaggcugaaaucucuggguccagcccuauucuguccaucacaauuagcgaggacggaucuaugagcaucaagaacgaagaggaggaacagacccucacaauucugauccggacgggccuccuggucaucuccgggcuuuuucccauuucuaucccgauuaccgccgccgcuugguaccugugggaggugaaaaagcagcgcgcgggaguccugugggaugugccuucucccccucccaugggcaaagccgaacucgaggacggggcuuauagaaucaagcaaaaaggcauucugggcuacucccagaucggcgccgggguuuacaaggaaggaacauuccacaccauguggcaugugacacggggcgccguccuuaugcacaaggggaaacgcaucgagcccuccugggcugaugugaagaaagaccugauuagcuauggaggcggguggaagcucgagggagaauggaaagagggcgaagagguucaggugcuggcccucgaaccuggcaagaauccgagagcgguccagaccaagcccgggcuguuuaaaacgaacaccggaacaaucggcgcugugucccuugauuucucuccugggaccagcggaucccccauuaucgacaagaaaggcaaggugguugggcuguacggaaacggcgucgugacacggagcggcgccuaugugucugccauugcucaaaccgagaaauccaucgaggauaauccugaaaucgaggacgauauuuuucgcaagagacggcugacaaucauggaccuccaccccggggccggaaagacgaaaagauaccugccugcgauuguccgcgaagcuaucaagcggggccuuagaacccugauucucgccccgacacgcgugguugccgcugagauggaagaggcccugcgggggcuccccaucagauaucagaccccugcuauucgcgccgagcauaccggacgggaaaucguggaccugaugugucacgcgacauucacgaugagacuucugagccccguccgcgugccuaacuacaaucugaucauuauggaugaggcccauuucaccgaccccgcuucuaucgccgcucggggcuauauuuccacaagaguugaaaugggggaggccgccggcaucuuuaugaccgcuacaccgccuggaagccgggaucccuucccccaguccaacgcgccuauuaucgacgaggaacgcgagauccccgaaagaucuuggaauagcggccacgagugggugaccgauuuuaaagggaagacggucugguucgugccuuccauuaaagccggaaacgacaucgcugccugccuccggaagaauggcaagaaaguuauucaacugagccgcaagacauuugauucugaauacgugaaaaccagaaccaacgacugggauuucgucgugacaaccgacaucuccgagaugggggccaauuuuaaggcugagcgggugauugauccgagacgcuguaugaaacccgucauccuuacagacggagaggaacggguuauccuggccggcccuaugcccgugacccauagcucugcggcucagagacgcgggcggauuggcagaaacccuaagaaugaaaacgaccaguacaucuauaugggagagccccucgaaaaugaugaggacugcgcccacuggaaagaggccaagaugcugcuggauaacauuaauacgccggaaggcaucauuccuagcauguucgagcccgaacgcgagaagguggacgcuaucgauggggaauaccggcucagaggagaggcccgcaaaacauuugucgaccuuaugagacggggcgaucugccuguguggcuggcguauaagguugccgcugaggggauuaacuacgccgaccgcagaugguguuucgauggaaucaaaaacaaucagauccucgaagagaacguggaagucgagauuuggaccaaggagggcgaacggaaaaagcugaagccccgcuggcuugacgcuagaaucuauuccgauccucuggcccucaaagaguuuaaggaguucgcugccgggcggaaaucucugacacugaaucucauuaccgagaugggcagacuucccacguucaugacccaaaagacacgcgacgcgcuggauaaccuggccgugcuccacaccgcugaagccggaggccgggcuuacaaucaugcccugagcgagcuuccggagacacuggaaacccuccugcugcucacacuucuggccaccguuacagggggaaucuuucuguuccucauguccggcagagggauuggaaaaaugacacugggcaugugcugcaucaucaccgcuucuauucuucugugguaugcgcagauccagccucacuggauugccgcuagcaucauucucgaguuuuuccugaucgugcugcucauccccgaacccgagaagcagcgcaccccucaagacaaccagcuuacauacgucgugauugccauccugaccgucguggccgcuacaauggccaaugaaaugggcuuucuggagaagacgaaaaaggaccucgggcugggauccauugcgacccagcagccggagagcaacauccuugauauugaccugcggcccgccucugcuuggacacucuacgccguugcuaccacauucgugaccccuaugcugagacauuccaucgaaaauagcuccgugaacgucucucugacggccauugcgaaucaagccaccguucucaugggccuugggaaaggauggccccugagcaagauggauaucggcgugccucugcucgcuaucggguguuauucccaggugaaccccauuacacugaccgccgcccuucugcuccuggucgcccacuacgcuaucauuggaccuggccugcaggccaaagcgacacgggaggcccagaagcgcgcugccgcuggcaucaugaagaauccgaccguggacgggauuacgguuaucgaucucgaccccaucccuuaugaucccaaauuugaaaagcaacuuggacaggugaugcugcugauucucugcgucacacaggugcugaugaugagaaccacaugggcccuuugugaggcccugacccucgcgaccggcccuaucucuacacugugggaagggaaccccggacgguucuggaauacgaccauugcugucagcauggccaacaucuuucgcggcuccuaccuggcuggggccggacuccuuuucagcauuaugaaaaauacaaccaacacaagacggggcaccggcaacaucggggagacgcugggagagaaguggaaaucucgccugaaugcccucggcaaguccgaauuucaaaucuauaaaaagagcgggauucaggagguggacagaacacuggcuaaggaaggaaucaaacggggcgagaccgaucaccaugccguuucucgcggguccgcgaaacuuagaugguucguggagcggaacauggucaccccggaaggaaaagugguugaccugggcugcggcagagggggauggagcuacuauuguggcgggcucaagaaugugcgcgaggucaaaggacugacaaagggcgggccuggacacgaggaacccauucccaugucuaccuacggcuggaaccuggugcggcuccagagcggcguggaugucuuuuucaucccucccgaaaagugcgacacacuucugugugauauuggggaguccucuccuaauccgacggucgaggccggaagaacccugcgcgugcucaaccugguggaaaauuggcuuaacaauaacacacaguucugcaucaaaguccugaaucccuacaugccuagcguuaucgagaagauggaagcucuccaacggaaauauggcggggcccuggugagaaacccccugucccgcaauagcacccaugagauguacuggguguccaacgcuucuggaaauauugucagcuccgugaacaugaucucucggaugcucauuaacagauuuacaaugcgccacaagaaagccaccuaugaaccugacguugaccuuggcagcgggacgcggaauaucggaauugaguccgagauccccaaccuggauauuaucggcaagagaaucgaaaagauuaaacaggagcaugaaaccucuuggcacuacgaccaggaucacccguauaagacaugggcguaccauggcagcuaugagaccaaacagacaggguccgccagcucuauggugaauggagucgugcgccugcucaccaagccuugggacguucugcccacagugacccaaauggcuaugacggauacaaccccuuucggccagcagcgggucuuuaaagaaaagguggacaccagaacacaggagcccaaggaggggacgaagaaacuuaugaaaaucaccgccgaauggcuguggaaagagcucggcaagaagaaaacaccucgcauguguaccagagaagaguucacacggaaggugcgcuccaacgcugcccugggcgcuauuuuuaccgaugagaauaaguggaaaagcgccagagaagcggucgaggacucucgguucugggaacugguugauaaggagagaaaccuccaccuggaagggaaaugcgagacauguguguacaauaugaugggaaagcgggagaagaaacuuggcgaauuuggcaaagccaaagggucccgcgcuaucugguacauguggcugggagccagauuccucgaguuugaagcucugggcuuccuuaacgaggaccauugguuuagccgggaaaauucucuguccgggguggagggagagggccuccacaagcugggguauauucugcgcgaugucagcaaaaaggaaggcggagccauguacgccgacgacaccgcgggcugggauacgagaaucacccucgaggaccugaaaaacgaagagauggugacaaaucacauggaaggggagcauaagaaacuugcugaggccaucuucaaacugaccuaucaaaacaagguugugcggguccagcgccccacaccgagaggaaccgugauggauauuaucucccggcgcgaccagagaggcagcgggcaaguuggaacguacggccucaauacauuuaccaacauggaagcccagcugauucggcagauggagggggaaggcguguucaaaaauauccagcaccuuacagucaccgaggagguggcuguucauaacuggcuggcccgcgugggaagagaacggcucucucgcauggcuauuagcggcgaugacugcgucgugaagccucuggaugacagauucgccaacgcgcugacggcccucaaugauauggggaaaauccggaaggacauccaacagugggagcccuccaagggauggaacgauuggacccagguccccuuuugcucucaccauuuccacgaacugauuaugaaagacggcagaauccuugugguuccuugucgcaaucaggaugagcugauugggcgggcuagaaucagccaaggagccggcuggucccuccgcgaaacagcuugccuggggaagucuuaugcccagauguggagccuuauguacuuucaccggagagaccugcgccucgcggccaacgcuauuuguuccgccgugccgucucauuggguccccaccagccggacaaccugguccauccacgcuaaacaugaguggaugacaaccgaggacaugcugacgguguggaauagaguguggauucgcgaaaacccuuggauggaggauaagacacccguugaaagcugggaggaaaucccuuaucugggcaaacgggaggaccaguggugcggaucucucaucggccugaccuccagagccaccugggcuaagaauauucaggccgcgaucaaccaagugcgcagccuuauugggaaugaggaauacacagauuacaugcccucuaugaagcgguucagacgggaggaagaggaagccggaguccugugguga

SEQ ID NO: 20087 - RNA, 9876 nt, Artificial Sequence
  derived and/or modified CDS sequence (opt5) from DENV-2__FJ547067__SS-prME
agcgccggcaugaucauuaugcugauccccaccgugauggcuuuccaccugacaacgcggaauggggagccucauaugauuguuggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaggacaagcgguuugugugcaagcauagcaugguggaucgcggcuggggcaauggguguggacuguucggcaaagggggaauuguuaccugcgcuauguuuacaugcaagaaaaacauggaaggcaagaucguccagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucggcggggucuuuacauccaucgggaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccauuucuuucgugacacuuaucaccgggaacaugagcuuuaaggaccugggaagagucgugguuauggugggcgcuacgauggccgaugacauuggcaugggggucaccuaucucgcccugcuggcugccuucaaagugcgcccuacauuugcggcuggacuucugcuccggaagcugaccuccaaggagcucaugaugacaaccaucggcauuguucugcuuucucagagcacgauccccgaaacagugcuggagcucaccgaugcccuggcccuggggaugaugguccuuaaaaucgugagaaauauggaaaaguaccagcuggcugugacaauuauggccauccucugcgucccuaacgcgguuauucugcagaaugcuuggaaaguguccuguaccauccucgccgccgugucugucagcccccugcuucugaccuccagccaacagaagacagacuggauuccucucgcucugacgaucaaaggacugaaccccaccgccaucuuccuuacaacccugucucgcacaaauaagaaaagauccuggccgcucaacgaggcuauuauggccgugggcaugguuagcauccuggcgucuucccuccugaagaaugacauuccuaugaccgggccccuuguggccggaggccugcugacggucugcuaugugcucacaggccggagcgcugaucuggaacuugagcgcgccaccgacguuaagugggaggaacaggcugagaucucuggguccagcccuauucuguccaucaccauuagcgaagauggaucuaugagcaucaaaaacgaggaggaggaacagacacucaccauccugauuagaacaggccuccuggugaucuccgggcuuuuucccauuucuaucccgauuacggccgccgcuugguaccugugggaagucaagaaacaacgggcgggagugcugugggacgucccuucucccccucccaugggcaaggccgagcucgaagauggggcuuaucgcaucaaacagaagggaauccugggcuacucccagauuggcgccgggguguacaaggagggaaccuuccacacaauguggcauguuaccagaggcgccgugcuuaugcacaaagggaagcggaucgagcccuccugggcugacgucaaaaaggaucugauuagcuauggaggcggguggaaacucgaaggagaguggaaggaaggcgaggaagugcagguucuggcccucgagccuggcaagaauccgcgcgcggugcaaacaaaacccgggcuguuuaagaccaacacgggaaccaucggcgcugucucccuugacuucucuccugggacaagcggaucccccauuaucgauaaaaagggcaaagugguggggcuguacggaaacggcguugucaccagaagcggcgccuaugugucugccaucgcucagacagagaaguccauugaagacaauccugagaucgaagaugacauuuuucggaagcgcagacugaccaucauggaucuccaccccggggccggaaaaacaaagcgguaccugccugcgauugugagagaggcuaucaaacgcggccuucggacgcugauucucgccccgaccagagucguggccgcugaaauggaggaggcccugcgcgggcuccccauccgguaucagaccccugcuaucagagccgaacauaccggacgcgagauuguugaccugaugugucacgcgaccuucacaaugcggcuucugagccccgugagagucccuaacuacaaucugaucauuauggacgaagcccauuucacggaucccgcuucuaucgccgcucgcggcuauauuuccacccggguggagaugggggaggccgccggcaucuuuaugacagcuaccccgccuggaagcagagaccccuucccccaauccaacgcgccuaucauugaugaagaacgggaaauccccgagcgcucuuggaauagcggccacgaauggguuacagacuuuaaggggaaaaccgugugguucgucccuuccauuaaggccggaaacgauaucgcugccugccucagaaagaauggcaaaaaggugauucagcugagccggaaaacguuugacucugaguacguuaagacacgcaccaacgauugggacuucguggucaccacagauaucuccgagaugggggccaauuuuaaagcugaaagagugaucgacccgcggagauguaugaagcccgugauucuuaccgauggagaggaacgcgucauccuggccggcccuaugcccguuacacauagcucugcggcucagcggagagggcgcauuggccggaacccuaaaaaugagaacgaccaguacaucuauaugggagaaccccucgagaaugacgaggauugcgcccacuggaaggaagccaagaugcugcuggacaacauuaauaccccggagggcaucauuccuagcauguucgaacccgagagagaaaaaguggaugcuaucgacggggaguaccgccuccggggagaggccagaaagacguuuguggaucuuaugcgcagaggcgaccugccugucuggcuggcguauaaaguggccgcugaagggaucaacuacgccgaucggcgcugguguuucgacggaauuaagaacaaucaaauccucgaggaaaacguugagguggagauuuggacaaaagaaggcgagagaaagaagcugaaaccccgguggcuugaugcucgcaucuauuccgacccucuggcccucaaggaauuuaaagaguucgcugccgggagaaagucucugacccugaaucucauuacagaaaugggccggcuucccaccuucaugacgcagaaaaccagagaugcgcuggacaaccuggccguccuccacacagcugaggccggaggccgcgcuuacaaucaugcccugagcgagcuuccggaaacccuggagacacuccugcugcucacccuucuggccacagugaccgggggaaucuuucuguuccucauguccggccgggggaucggaaagaugacgcugggcaugugcugcauuaucacagcuucuauucuucugugguaugcgcagauccagccucacuggauugccgcuagcaucauccucgaauuuuuccugauuguucugcucauccccgagcccgaaaagcaaagaaccccucaggauaaccagcuuaccuacguggucauugccauccugacaguggucgccgcuaccauggccaaugagaugggcuuucuggagaaaacaaagaaagaccucgggcugggauccauugcgacgcagcaaccggaaagcaacauccuugacauugaucugcgccccgccucugcuuggacccucuacgccguggcuacaaccuucguuacaccuaugcugcggcauuccaucgagaauagcuccgugaacgugucucugaccgccaucgcgaaucaggccacgguccucaugggccuugggaagggauggccccugagcaaaauggacauuggcguuccucugcucgcuaucggguguuauucccaggugaaccccauuacccugacagccgcccuucugcuccugguggcccacuacgcuaucauuggaccuggccugcaggccaaggcgaccagagaagcccaaaagcgggcugccgcuggcaucaugaaaaauccgacagucgaugggaucaccgugauugaccucgaucccaucccuuaugaccccaaguuugagaaacagcuuggacagguuaugcugcugauucucugcgugacgcaaguccugaugaugcgcacaaccugggcccuuugugaagcccugacacucgcgaccggcccuaucucuacccugugggaggggaaccccggaagauucuggaauacaacgauugcugugagcauggccaacaucuuucggggcuccuaccuggcuggggccggacuccuuuucagcaucaugaagaauaccacaaacacccgcagaggcacaggcaacaugggggagacccugggagaaaaauggaagucucggcugaaugcccucggcaaauccgaguuucaggucuauaaaaagagcgggauucaggaaguggaucgcacgcuggcuaaagagggaaucaagagaggcgagacagaccaccaugccguuucucggggguccgcgaaacuucgcugguucguggaaagaaacauggucaccccggagggaaaggugguugaucugggcugcggcagagggggauggagcuacuauuguggcgggcucaaaaaugugcgggaagucaagggacugaccaagggcgggccuggacacgaggaacccauucccaugucuacauacggcuggaaccuggugcgccuccagagcggcguggacgucuuuuucaucccucccgagaaaugcgauacccuucugugugacauuggggaguccucuccuaauccgacagucgaagccggacggacgcugagagugcucaaccugguggagaauuggcuuaacaauaacacccaauucugcaucaagguccugaaucccuacaugccuagcguuaucgagaagauggaggcucuccagcgcaaguauggcggggcccuggugcggaacccccuguccagaaauagcacacaugaaauguacuggguguccaacgcuucuggaaauauugucagcuccgugaacaugaucucucgcaugcucauuaaccgguuuaccaugagacacaaaaaggccacauaugagccugauguugaccuuggcagcgggacccgcaauaucggaauugaguccgaaauccccaaccuggacauuaucggcaagcggaucgagaaaauuaagcaggaacaugagacgucuuggcacuacgaucaggaccacccguauaaaaccugggcguaccauggcagcuaugaaacaaagcaaaccggguccgccagcucuauggugaauggagucgugagacugcucacaaaaccuugggauguucugcccaccgugacacagauggcuaugaccgacacgacaccuuucggccagcagcgcgucuuuaaggagaagguggauacccggacccaagagcccaaagaagggacaaagaaacuuaugaagaucacggccgaguggcuguggaaagaacucggaagaaagaaaaccccucgcauguguacaagagaggaguucacccggaaggugcgcuccaacgcugcccugggcgcuauuuuuacagacgaaaauaaguggaaaagcgccagagaggcggucgaagauucucgguucugggagcugguugacaaggaaagaaaccuccaccuggaggggaaaugcgagaccuguguguacaauaugaugggaaagcgggagaagaaacuuggcgaguuuggcaaggccaaagggucccgcgcuaucugguacauguggcugggagccagauuccucgaauuugaggcucugggcuuccuuaacgaagaucauugguuuagccgggaaaauucucuguccgggguggagggagaaggccuccacaagcugggguauauucugcgcgacgucagcaaaaaggagggcggagccauguacgccgaugacacagcgggcugggacaccagaaucacgcucgaagaucugaaaaacgaggaaauggugaccaaucacauggagggggagcauaagaaacuugcugaagccaucuucaaacugacauaucagaacaagguugugcggguccagcgccccaccccgagaggaacagugauggacauuaucucccggcgcgaucaaagaggcagcgggcagguuggaaccuacggccucaauacguuuacaaacauggaggcccagcugauucggcagauggaaggggagggcguguucaaaucuauccaacaccuuaccgucacagaggaaguggcuguucagaauuggcuggcccgcgugggaagagagcggcucagccgcauggcuauuuccggcgacgauugcgucgugaagccucuggacgauagauucgccaacgcgcugaccgcccucaacgacauggggaaaauccggaaggauauccagcagugggaacccucuaagggauggaaugacuggacgcaaguccccuuuugcagccaucacuuccaugagcugauuaugaaagauggcagagugcuuguugugccuugucgcaaccaggacgaacugaucgggcgggcuagaauuucccagggagccggcuggucucuccgcgagaccgcuugccugggaaagagcuaugcccagauguggucccuuauguacuuucaccggagagaucugcgccucgcggccaaugcuaucuguucugccgucccgagccacugggugcccacaucccggaccacauggagcauucaugcuaaacacgaguggaugaccacagaagacaugcugaccguguggaacagaguuuggauccgcgagaauccuuggauggaagacaagacgcccguggagucuugggaagagauuccuuaucugggcaaacgggaggaucaauggugcggaucccucaucggccugacaagcagagccaccugggcuaagaacauccaggccgcgauuaaucagguccgcucucuuaucgggaacgaagaguacaccgacuacaugcccuccaugaagcgguucagacgggaagaggaagaggccggagugcugugguga

SEQ ID NO: 20088 - RNA, 9876 nt, Artificial Sequence
  derived and/or modified CDS sequence (opt5) from DENV-2__JN819418__SS-prME
acagccggcgugaucauuaugcugauccccacagcuauggccuuccaccucacgacccggaauggggagccucauaugauugucggacggcaggaaaagggcaaaucccugcuuuuuaagacagaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuugugugcaagcauuccaugguggauagaggcuggggcaacggguguggacuguucggcaaagggggaauugucacaugcgccauguuuacgugcaaaaagaauauggaaggcaaaguugugcucccugagaaccuggaauacaccaucgugauuacaccccacagcggggaggagcaugcggucggaaaugacaccggcaagcacggcaaagaaaucaagaucacaccucagucuuccauuaccgaggccgaacuuacgggguauggaaccgugacaauggaguguagcccccggaccggccuggauuucaacgaaaugguucuccugcagauggaggacaaggcuuggcuugugcaccgccaaugguuucuggaucucccgcugccuuggcugcccggggccgacacacagggaucuaauuggauccagaaggagacccucgucacguucaagaacccucaugcuaaaaagcaggacgugguugugcugggcucccaagaaggggccaugcacacagcccuuaccggcgcuacagagauucagaugagcuccggaaaucugcucuuuaccggccaucugaaaugcagacuucggauggauaagcugcagcucaaagggaugucuuacagcauguguaccggaaaguucaagaucgucaaagaaauugcggagacacaacacggcacgaucgugaucagaguccaguaugagggggacggaucccccugcaagauucccuucgaaaucauggaucuggagaaacgccaugugcugggccggcucauuaccguuaacccuaucgugacagaaaaggacagcccggucaacauugaggccgaacccccuuuuggggauucuuacaucauuaucggcguggagcccggacagcugaaacuuaauugguucaagaagggcuccagcaucgggcagauguuugagaccacaaugagaggagcuaaacgcauggccauucugggcgacaccgccugggauuucgggucucucggaggcguuuuuacgagcaucgggaaggcucugcaccaaguguucggcgccauuuacggagcggcuuuuuccggcgucucuuggacaaugaaaauccugauuggggugaucaucaccuggauuggaaugaacagccgguccaccagccuuucugugucccucguucuggucggcguggugacacuguaucucggggccaugguccaggccgacagcggaugugugguuucuuggaagaauaaagaacugaagugcggcuccgggaucuucauuaccgauaacgugcacacauggacggagcaguacaaguuucagccugaaagccccuccaaacuugcuucugccauccaaaaggcucaugaggaaggcauuuguggaaucagaagcgucacccgccuggagaaucucauguggaaacagaucacaccggagcugaaccacauucuguccgaaaaugaggugaaacuuaccaucaugacaggcgacauuaaagggaucaugcaggccggaaagcggucucucagaccucagcccaccgaacugaaauauagcuggaagacguggggcaaggcgaaaaugcuguccaccgagagccauaaccaaacauuccucauugaugggccugaaaccgccgagugccccaauacaaaccgcgcuuggaacucucuggagguugaagacuacggauuuggcguguucuccaccaacaucuggcuuaagcugcgggagaaacaggacgucuuuugugauagcaagcucaugucugccgcuaucaaagacaauagagccgugcacgcggauaugggcuauuggauugaauccgcccugaacgacacauggaagauggagaaggcuagcuucaucgagguuaaaucuugccacuggccuaagagccauacccugugguccaauggggugcuugaaagcgagaugauuauccccaaaaacuucgccggaccggucucucagcacaacuaccgcccuggcuaucauacgcagacagcugggcccuggcaccucggaaagcuggaaauggauuuugacuucugugagggcaccaccgugguggucacagaagauugcgggaaucggggacccucccugagaaccacgacagccagcggcaaacucauuaccgaguggugcugucgguccugcacacugccuccgcuucgcuacagaggcgaggacggguguugguacggaauggaaauccggccccugaaggagaaggaagagaaccucguuaauucucuggugaccgccggccaugggcaaauugauaacuuuagccugggagugcuuggcauggcucucuuccuggaagagaugcugagaacacgcgucgggaccaaacacgcgauccuccugguggccguuuccuuuaugacgcuuaucaccggaaauaugucuuuccgggaccugggcagagugauggucauggugggcgcuacaaugaccgaugacauugggaugggaguuacauaucucgcccugcuggccgcuuuuaaggugcgcccuaccuucgccgcgggccuucugcucagaaaacugacgagcaaggagcucaugauggcuacaaucgggauugcccugcuuucccagucuaccauccccgaaacaauucuggagcucaccgaugcccuggcucugggaaugaugguccuuaaaaucgugcggaacauggaaaaguaccagcuggccguuaccaucauggcgauuagcugcgugccuaaugcugucauccuccaaaacgccuggaagguguccuguacaauucuggccgcugugagcgucucuccccuccugcuuacguccagccagcagaaagccgacuggaucccucuggcucucaccauuaagggccugaaucccacagccaucuuucugaccacacuuucucgcaccuccaaaaagagaagcuggccgcugaacgaggcgaucauggccguugggauggugucuauucucgcuuccagccugcucaaaaaugacaucccuaugacgggaccccugguggccggcggccuucugacagucugcuaugugcugaccgggcgguccgcugaucucgaacuggagcgcgccgccgacguuaagugggaggaucaggcugaaauuagcggaucuagcccuauccuuuccauuaccaucucugaggacggcagcauguccauuaaaaacgaagaggaggaacaaacacugaccauccucaucagaacagggcugcucgugauuucuggacuguuccccgucagcaucccgauuacggcggccgcuugguaccuuugggaggugaagaagcagcgggccggcguucugugggaugugccuucucccccucccgucgggaaagccgaacuggaggacggagcuuaucgcaucaagcagagaggcauucucggcuacagccagaucggggccggaguguauaaagaaggcaccuuucacacaauguggcaugucaccagaggggcggugcugaugcaccgcggaaagagaaucgagcccagcugggcugauguuaaaaaggaccuuauuuccuacggcgggggauggaagcuggagggcgaauggaaagagggcgaagaggugcaaguccucgcccuggaaccugggaagaauccgcgggccgugcagacaaaacccggacucuucaagaccaacacgggcaccaucggggcuguuagccuggauuuuucuccuggaacauccggcagccccauuguggacagaaaagggaaggucgugggacuuuacggcaauggcgugguuacccgcucuggggccuaugucuccgcgaucgcucagacagaaaagagcauugaggauaacccugaaaucgaggacgauaucuuccggaaaaagagacugaccauuauggaccugcaucccggagccggcaaaacaaagcgcuaccucccugccaucgugcgggaagcuauuaaaagagggcugcgcacgcuuauccuggccccgacccggguggucgcugccgagauggaagaggcgcucagaggacugcccauucgcuaucagaccccugccauccgggcugagcacaccggcagagaaauuguggaccucaugugucaugccaccuucacaaugcggcugcuuucccccguucgcgugccuaacuacaaucugaucaucauggaugaggcucacuuuacggaccccgccucuauugccgcuagaggguauaucagcacccgggucgaaaugggcgaggcggccggaauuuucaugacagcuaccccgccuggcucccgcgaucccuuuccccaaagcaacgccccuaucauggacgaggaaagagagauucccgaacggucuuggaacuccgggcacgagugggugacagauuucaagggaaagaccguuugguuugugccuagcaucaaagccggcaacgacaucgcugccugccugagaaagaaugggaaaaaggucauucagcucucucgcaaaacguucgauagcgaauacgugaagacacgggcgaacgacugggauuuuguugugaccaccgacaucuccgagaugggagcuaauuucaaggccgagagagucauugauccgcgccgguguaugaaacccgugauccugacagacggcgaagagagagugauucuugccgggccuaugcccgucacccauucuagcgcugcccagcgccggggcagaaucggacgcaacccuaagaaugaaaacgaccaauauaucuacaugggcgagccccuggaaaaugaugaggacugcgcgcacuggaaagaggccaagaugcuccuggauaacauuaauacaccggaagggaucauuccuuccauguuugagcccgaaagagagaaaguugacgcuaucgauggagaauaccggcugcgcggcgaggccagaaagaccuucguggaccucaugcggcgcggggaucuuccuguguggcuggcuuauagagucgccgcugagggaauuaacuacgccgaccggagaugguguuuugauggcaucaaaaauaaccagauucuggaagagaacguggaaguugagaucuggacgaaggagggggaacgcaagaaacucaagccccgguggcuggacgcgagaaucuauucugauccucuugcccugaaagaguucaaggaguucgcugccggccgcaaaagccucacacugaaucugauuaccgagaugggacggcuccccacauuuaugacccagaaggcuagagacgcccuugauaaccuggccgugcugcauacggcugaagcgggcgggcgggccuacaaucacgcucucuccgagcugccggagacccuugaaacacugcuccugcugacccuccuugccacagucaccggaggcaucuuccuguuucugaugagcgggaagggaauuggcaaaaugacacucggcaugugcugcaucauuaccgccucuauccugcuuugguaugcucagauccaaccucacuggauugccgcguccaucauucuggaguucuuucucaucgugcugcugauucccgaacccgagaagcagcgcacgccucaggacaaccagcucacauacguugugaucgccauccuuaccgucguggcugccaccauggcuaaugaaaugggguuccuggagaaaacaaagaaagaccugggacucggcagcauuaccacacaagaguccgaaucuaacauccuggauauugaccuuagaccggccagcgcguggacgcuguaugccgucgcuaccacauuugugacccccaugcuccggcauuccaucgaaaauucuagcguuaacgugucccugacagccauugcuaaucaggccaccgugcugauggggcucggaaagggcuggccucuuagcaagauggauaucggggucccccugcuggcuauuggauguuacucucagguuaacccuaucacgcucaccgccgcgcugcuucugcucguggcccacuacgcuaucauuggccccggccugcaggccaaagcuacacgcgaagcccaaaagagagccgcggcugggaucaugaaaaauccuaccguggacggaauuacagucaucgaucuggacccgauucccuaugauccuaaguucgagaaacagcucggccaggugaugcuucugauccugugcguuacccaggugcucaugaugcggacgacaugggcccugugugaagcucuuacccuggccacagggcccaucuccacccucugggagggaaacccuggccgcuuuuggaauaccacaauugccgucagcauggcuaacaucuucagagggucuuaccuggccggagcgggccugcucuuuuccauuaugaagaauacgaccaacacacggcgcggcaccgggaauaucggagagacacuuggcgaaaaguggaaaagcagacugaacgcccuggggaagucugaguuccaaauuuauaaaaagagcggaauccaggaaguggaccggacccucgcuaaagagggcaucaagagaggggagacggaucaucacgccgucucccgcggaucugcuaaacugcggugguuuguggaaagaaacaugguuacacccgagggcaagguggucgaccuuggcugcgggcgcggaggcuggagcuacuauugugggggacugaagaaugugcgggaaguuaaaggccucaccaaagggggaccgggccaugaggaaccuauucccauguccaccuacggcuggaaccuggugagacugcagagcggggucgauguguucuucacacccccugagaaaugcgacacccuccuuugugauaucggagaguccucucccaauccuacaauugaagccggccgcacgcugcgggugcugaaccucguugagaauuggcugaacaauaacacccaauuuugcaucaagguccuuaauccguauaugcccagcgugauugagaagauggagacacugcagagaaaguacgggggagcgcucgugcgcaacccucuguccagaaauucuacccacgaaauguacugggucagcaacgccacaggcaauaucguuuccucugugaacaugaucagcagaaugcugauuaaucgcuucaccaugaagcacaaaaaggcuacguaugagcccgacguggaccucggguccggaacccggaacaucggcauugagagcgaaaucccuaaccuugauauuaucggcaaaagaauugagaagaucaaacaggaacaugagacaucuuggcacuacgaccaggaucaucccuauaagaccugggccuaccacggguccuaugaaacaaagcaaaccggaagcgcuucuuccauggucaauggcgugguucgccugcugacaaaaccgugggacguggucccuauggugacccagauggccaugacggauacaacccccuuugggcagcagagaguuuucaaggagaaaguggacacccggacacaagagccuaaggaaggaacgaaaaagcucaugaagaucaccgcugaguggcuguggaaagaacuuggcaagaaaaagacaccccgcauguguaccagagaggaguuuacacggaaagucagaagcaacgccgcgcugggggccauuuucaccgaugaaaauaaguggaaaucugcucgggaggccguggaagacggacgcuuuugggagcucguggauagagaacggaaccugcaccuggagggcaagugcgagacaugugucuacaauaugaugggcaagcgcgagaagaagcucggggaguucggaaaagcuaagggcuccagagccaucugguauauguggcugggggcccgguuucuugaguucgaggcgcugggauuucucaacgaagaccauugguucagccgcgaaaauucccugagcggcguugagggggaaggccuucacaaacugggauacauucucagagaugugucuaagaaggagggcggggcuauguacgccgacgacaccgccggaugggauacgcggaucacccuggaagaccugaaaaacgaggaaauggugacaaaucauauggagggcgagcacaagaaacucgcugaagccauuuuuaagcugaccuaucagaacaaagucgugcgcguucagagaccuacaccccgggggaccgugauggauaucaucagccgcagagaccagcggggauccggccaagucgggacguacggccuuaauacauucaccaacauggaggcucagcugauucgccagauggaaggagagggcaucuucaagucuauucaacaucucacagugaccgaggaaaucgccguucagaauuggcuggcgagaguggggcgggagagacuuagccgcauggccauuuccggagaugacugcgucgugaagccgcuggaugaccgguuugcuucugcccucacggcucugaacgauaugggcaaaguuagaaaggacauccagcagugggaaccuagccgcggguggaaugauuggacccaagugcccuucugcucccaccacuuucaugagcugaucaugaaagacggacggguccucgugguccccuguagaaaccaggaugaacugauuggccgcgcccggaucucucagggggcgggcuggagccuuaaggagacagccugccugggaaaauccuaugcucagauguggacccucauguacuuccacagacgcgaccugcggcuugccgcuaacgccauuuguagcgcugugccuucucauuggguuccgacauccagaaccacauggagcauccacgccaagcacgaguggaugaccacggaagacaugcuggcgguguggaaucgcgucuggauucaagagaaccccuggauggaagauaagacaccuguggagucuugggaagaggugcccuaucucggcaaacgggaggaccaguggugcgggucccugaucggacugaccagcagagccaccugggcuaagaauauucagacagccaucaaccagguucggucccucaucggcaaugaagaguacaccgauuauaugccuucuaugaaaagauuucgccgggaagaggaagaggccggggugcugugguga

SEQ ID NO: 20089 - RNA, 9876 nt, Artificial Sequence
  derived and/or modified CDS sequence (opt5) from DENV-2__EU482640__SS-prME
acagccggaaucauuaucaugaugauucccacagugauggcuuuccaccugacgacccggaauggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacaacggucgccccuuccaugaccaugcggugcaucggaauuucuaaccgcgacuuuguggaaggcguuagcgggggauccuggguggauaucguccuggagcacggcagcugugugacaaccauggcgaaaaauaagcccacacucgacuucgaacugaucaagaccgaggccaaacacccugcuacgcuuagaaaguacugcauugaagccaaacugacaaacaccaccacagcuucucgguguccgacccagggggagcccucccucaaugaggaacaagauaagcgcuuugugugcaaacauagcauggucgacagaggauggggcaacggcugugggcuguucggaaagggcgggaucguuacaugcgccauguuuacgugcaagaaaaauauggagggaaagauugugcagccugaaaaccuggaguauaccaucgugauuacaccccacucuggcgaagagaaugcggucgggaacgauaccggaaaacauggcaaggagaucaaagugacaccucaguccagcaucaccgaagccgagcucacgggcuacgggaccguuacaauggaauguucuccccggaccggacuggacuucaaugagauggugcuucugcagauggaaaacaaggcuuggcucguccaccgccaaugguuucuggaucuuccgcugccuuggcuccccggcgccgacacacagggguccaacuggauucagaaagagacccuggugacguucaagaauccucacgcuaagaaacaggauguugugguccugggaagccaagagggcgccaugcauacagcccucaccggggcuacagaaauccagauguccucuggcaaccugcuuuuuaccggacaccugaagugcagacuccggauggacaaacugcagcuuaagggcaugagcuauuccauguguaccgggaaauucaagguggucaaggagauugcggaaacacaacauggaacgaucgugauuagaguucaguacgagggcgacgggagccccugcaaaauccccuucgagaucauggaucuggaaaagcgccacgugcucggacggcugauuaccgucaauccuaucgugacagagaaagacucuccgguuaacauugaagccgagcccccuuuuggcgauuccuacaucauuaucgggguggaacccggccagcugaagcucagcugguucaaaaagggaucuagcauuggccagauguuugagaccacaaugagaggggcuaagcgcauggccauccugggagacaccgccugggauuucggcucccuugggggagucuuuacgucuaucggcaaagcucugcaucaaguguucggggccauuuauggcgcggcuuuuagcggaguguccuggacaaugaagauccucauuggcguugucaucaccuggauugggaugaauagccggucuaccucccugagcgugucucuggugcuugucggagugguuacacucuaccugggcgugaugguccaggccgacuccgggugugugguuagcuggaaaaacaaggagcugaaaugcggauccggcaucuucaucaccgauaaugugcacacauggacggaacaguauaaguuucagccugagucucccagcaagcucgccuccgcuauucaaaaagcccacgaagaggggaucuguggcauuagaucugucacccgccuggaaaaccuuauguggcggcagaucacaccggagcugaaucauauucucagcgagaacgaagugaagcugaccaucaugacaggagacaucaaaggcauuaugcaggcugggaagagaucccugcgcccucagcccaccgagcuuaaauacagcuggaaggccuggggaaaagcgaagaugcucucuacggaacugcacaaucauaccuuccugaucgauggcccugagacagccgaaugccccaacaccaaucgggcuuggaacucccucgagguugaggacuauggguuuggaguguucacaaccaauauuuggcugaaacuuaaagaaagacaagaugucuuuugugacagcaagcugaugucugccgcuaucaaagacucccgcgccgugcacgcggauaugggcuacuggauugagagcgcccucaacgacacauggaagaucgaaaaggcuucuuucaucgaggucaagagcugccacuggccuaagucccauacccuguggagcaacggcgugcuggagucugaaaugauuauccccaaaaauuucgccgggccgguuucccagcacaacuaucggccuggauaccauacgcagacagcuggccccuggcaccuugggagacucgagauggauuuugacuucugugaaggaaccaccgugguggucacagaggauugcggcaaucgggggcccagccugcgcaccacgacagccuccggaaagcugauuaccgaauggugcuguagaucuugcacacucccuccgcugcgguacagaggcgaggacggcuguugguaugggauggagauccgcccccuuaaagaaaaggaggaaaaccuggugaauagccucguuaccgccggacauggccagauugauaacuuuucccugggggugcugggaauggcucuuuuccucgaggaaaugcugcggacaagaaucggcaccaaacacgcgauucugcucgucgccgugucuuuuguuacgcugaucaccgggaauaugagcuuccgcgaccuuggaagagugauggucauggugggcgcuacaaugaccgaugacaucggcauggggguuacauaccuggcccuccuggccgcuuuuaaggugcggccuaccuucgccgcgggacugcuucugcgcaagcucacguccaaagagcugaugaugacaaccauuggcaucguccuccugucucaaagcacagugcccgagaccauucuugaacugaccgaugcucucgcccuggggaugauggugcugaagaucgucagaaacauggagaaauaucagcuugccguuacaauuauggcuauccugugcgugccuaaugccgugauccuccagaacgcguggaaggucuccuguacgacccuggcugugguuagcgugucuccccuccugcuuacauccagccggcaaaaagccgacuggauuccucuggcccucaccaucaagggacugaaucccacagcuauuuuucugaccacgcuuucucgcacauccaagaaaagaagcuggccgcugaacgaagccaucauggcugucggcauggugucuauucucgccuccagccugcucaagaaugauaucccuaugaccgggccccugguugcgggaggccuucugaccgugugcuacguccugacaggccgguccgccgaccucgagcuggaacgcgcugccgacgugagaugggaggagcaggcugaaaucagcgggucuagcccuauucuuuccaucaccauuucugaggauggaagcauguccaucaaaaacgaagaggaggaacagacacugacgauucucauccggaccggccugcucgucauuucugggcuguuccccgugagcaucccgaucacagccgccgcuugguaucuuugggagguuaagaaacagcgcgcgggagugcugugggacgucccuucucccccucccgugggcaaggccgaacuggaggauggggcuuacagaauuaaacaaaagggaauccucggcuauagccagauuggcgccgggguuuacaaggaaggaaccuuucacacaauguggcaugugacccggggcgccguccugaugcacaaagggaagagaaucgagcccagcugggcugacgugaaaaaggaucuuauuuccuacggaggcggguggaaacuggagggagaauggaaggagggcgaagaggugcagguucucgcccuggaaccuggcaagaauccgcgcgcgguccagacgaaacccggacucuucaagaccaacacaggaaccaucggcgcugugagccuggacuuuucuccugggacauccggaagccccaucguggauaaaaagggcaaagucguggggcuuuauggaaacggcguugugacccggucuggcacauacgucuccgccauugcccaaacggaaaaguccaucgaggacaauccugaaauugaggaugacaucuucagaaagaaacgccugaccauuauggaucugcaucccggggcuggaaagacaaaacgguaucucccugccaucgugagagaagcgaucaagcgcggccugcggacccuuauucuggcuccgaccagaguuguggccgccgagauggaagaggcucuccgcgggcugcccauccgguaccagaccccugccauuagagcugagcacacgggacgggaaaucgucgaccucaugugucaugccaccuucacaaugcgccugcuuucccccauuagagugccuaacuauaaucugaucauuauggaugaggcgcacuuuaccgaccccgccucuaucgcugcccggggcuacaucagcacacgcguugaaaugggggaggcugccggcauuuucaugaccgccacgccgccuggauccagagaccccuuuccccagagcaacgcuccuaucauggaugaggaacgggagauucccgaaagaucuuggaacuccggccacgagugggugacagacuucaaagggaagaccgucugguuugugccuagcaucaaggcgggaaacgauauugccgcuugccugcgcaaaaauggcaagaaagugauccagcucucucggaagaccuucgacagcgaauauaucaaaacaagaaccaacgauugggacuuugucguuacaaccgauauuuccgagaugggggccaauuucaaggccgagcgcgugaucgacccgcggagauguaugaagcccgugauucugacggauggagaagaacgcgucauccuugcuggcccuaugcccgugacacauucuagcgccgcgcaacggagagggcgcguuggcagaaacccuaaaaaugaaaacgaccaguacauuuacaugggagagccccuggaaaaugaugaggacugcgcucacuggaaggaggccaaaaugcuccuggacaacaucaauaccccggaaggcaucauuccuuccauguuugagcccgaacgggagaagguggaugccaucgacggggaauaucgccugagaggagaggcucggaaaacauucgucgaucucaugcgcagaggcgaccuuccuguguggcuggccuaccggguugcggccgaggggauuaacuaugcugauagacgcugguguuuugacggagugaagaacaaucagauccuggaagagaacgucgaaguggagauuuggaccaaagagggcgaacggaagaagcucaaacccagauggcuggaugcccgcaucuacucugacccucuugcucugaaggaguucaaagaguucgccgcugggagaaagagccucacgcugaaucugauuaccgagaugggcagacuccccacauuuaugacccaaaaagcccggaacgcgcuugauaaucuggccguccugcauacagcugaagccggaggccgcgcuuauaaccacgcccucuccgagcugccggagacccuugaaacacugcuccugcugacccuccuugccacggugacagggggaaucuuccuguuucugaugagcggcaaggggaucggaaagaugacccucggcaugugcugcauuaucaccgcuucuauucugcuuugguacgcgcagauccagccucacuggauugccgcuuccaucauccuggaguucuuucucauuguucugcugauccccgaacccgagaaacagagaacaccucaagacaaucagcucaccuauguggugauugccauccuuacagucguugccgcuacgauggccaacgaaaugggcuuccuggagaagaccaaaaaggauuuugggcugggaagcauuacaacccagcagccggaguccaauauccucgacaucgaucugcggcccgcgucugccuggacacuuuacgcuguggccaccacguucauuaccccuaugcugcgccauagcaucgaaaacuccucugugaaugucagccucacagcuauugccaaccaagcgaccgugcugaugggccuggggaaaggauggccccucuccaagauggacaucggcguuccucuucuggccauuggguguuacagccaggugaaucccaucacacugaccgcugcccuccugcuucuggucgcucacuaugccauuaucggaccuggccuccaggcuaaggccacgagagaggcgcagaaacgggccgcugccggcaucaugaagaacccgacaguggacgggauuaccgucaucgaucuggaccccauuccuuacgaucccaaauuugaaaagcaacugggacaggugaugcuccuuguucugugcgugacacagguccugaugaugcgcaccaccugggcucucugugaggcccugacacuugccacgggcccuaucucuacccugugggaagggaaucccggaagauucuggaacacaaccauugcgguguccauggcuaauaucuuucggggcagcuaucucgccggggcuggacugcuguucucuaucaugaaaaacacagccaacacccgcagaggcacgggcaauacaggggagacccucggagagaaguggaagaaccggcuuaaugcccugggcaaauccgaauuucagauuuacaagaaaagcgggauccaagagguugacagaacccuggcuaaggaaggaauuaaacgcggcgagacagaucaucacgccgugucucgggggagcgcgaagcucagaugguucgucgagcgcaaccuggugaccccggaaggaaaagugguugaccuuggcugcggcagaggcgggugguccuauuacuguggagggcugaagaaugucaaggaggugaaagggcucacaaagggcgggccuggacaugaggaacccauccccaugucuacguauggcuggaaccuggugagacugcagagcggcgucgauguuuucuuuaccccucccgaaaaaugcgacacacuccuuugugauauuggggaguccagcccuaauccgaccguggaggccggacgcacacugcgggugcugaaccucgucgaaaauuggcugaacaauaacacccaguucugcaucaaggugcuuaaucccuacaugccuuccguuaucgagaaaauggaagcucugcaaagaaaguacggcggggcccucgugcgcaacccccugucucggaauagcacgcacgagauguauugggucuccaacgcuucuggaaacauugugagcuccguuaauaugaucucuagaaugcugauuaaccgcuuuaccaugcggcacaagaaagccacauacgaaccugacguggaucucggcagcgggaccagaaauaucggaauugaguccgagacacccaaccuugacaucaucggcaagcgcauugagaagaucaagcaggagcaugaaaccagcuggcacuaugaucaggaccauccguacaaaacaugggcguaucacggcucuuacgagaccaagcagacgggguccgccagcucuauggucaauggaguggugagacugcugacaaagccuugggacgucauucccaugguuacccaaauggcuaugaccgauacaacgccuuucggccagcagcggguguuuaaagaaaagguggacacccgcacacaggagcccaaagaggggaccaagaaacucaugaagaucacagccgaauggcuguggaaggagcuuggcaaaaagaaaaccccuagaauguguacacgggaagaguucaccagaaagguccgguccaacgcugcccugggcgcuauuuuuacggaugagaauaaauggaaaagcgcccgcgaagcgguggaggacucuggguucugggaacucguugauaaagagagaaaccugcaccuggaaggaaagugcgagaccuguguguauaauaugaugggcaagcgggagaaaaagcucggcgaauuugggaaagccaagggaucccgcgcuaucugguacauguggcugggcgccagauuccuugaguuugaagcucugggguuccucaacgaggaccauugguuuagccgggaaaauucccugagcggagucgagggcgaggggcuucacaaacugggcuacauucuccgcgaugugucuaagaaggaaggaggcgccauguaugccgacgauacagcggggugggacaccagaaucacacuggaggaucugaaaaacgaagagaugguuaccaaucauauggaaggagagcacaagaaacucgcugaggccaucuucaagcugacguaccaaaacaaagugguccgggugcagcgccccacaccgagaggcaccguuauggacauuaucagccggcgcgaccagagaggguccggacagguggucacauauggccuuaauaccuucacgaacauggaagcccaacugauucggcagauggagggggaaggcguguuuaagucuauccagcaacucaccgucacagaggagauugcugugaagaacuggcuggcccgcguuggaagagaacggcuuagcagaauggcuaucuccggcgaugacugcguggucaaaccucuggaugaccgcuucgccucugcgcucaccgcccugaaugauauggggaaggugcggaaagacauccagcagugggagcccagcagaggauggaacgauuggacacaggugcccuuuugcucccaucacuuccacgaacugauuaugaaggacggccgcguucucguggucccuugucggaaucaagaugagcugaucgggagagcucgcauuucucagggagccggcuggagcaugcgggaaaccgcuugccuugggaaauccuacgcccagauguggagccugauguauuuucauagacgcgaccuccggcuggcggccaacgcuaucuguucugccgugccgucccacuggguucccacaagcagaaccacguggucuauucaugcuacacacgaguggaugaccaccgaggauaugcuuacaguguggaaucgcgucuggauccaggaaaacccuuggauggaggacaagacccccguggaauccugggaggaaaucccuuaccugggcaagcgggaggaucaauggugcggaagccucauuggccugacauccagagccacgugggcuaaaaauauccagaccgccauuaaccagguccggucucugaucgggaaugaggaauauacagacuacaugcccagcaugaagagauuccgccgggaggaagaggaagcgggagugcucugguga

SEQ ID NO: 20090 - RNA, 9876 nt, Artificial Sequence
  derived and/or modified CDS sequence (opt5) from DENV-2__EU482641__SS-prME
agcgccggaaugaucauuaugcugauccccaccgugauggcuuuccaccugacaacgcggaauggggagccucauaugauugucggaauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccaucacaggggagcaccgcagagaaaagcgguccguggcgcucgucccucaugugggaaugggccuggagacccgcacagaaaccuggaugucuagcgagggcgcuuggaaacacgcccagagaauugagacguggauccugcggcaucccggguucacaauuauggccgcuauccucgccuacaccauuggaacaacccacuuucagcgcguucugaucuucauucuucugaccgcuguggccccuuccaugacaaugagaugcaucggcaucucuaaccgggauuuugucgaaggggugagcggaggcuccuggguugacauugugcucgagcacgggagcugugucacgaccauggcgaagaauaagcccacacuggauuucgaacuuaucaaaaccgaggccaagcagccugcuacacugcgcaaauauugcauugaagccaagcucaccaacacgacaaccgagucuagauguccgacccaaggagagcccucccugaaagaagaacaagacaagcgguuugugugcaagcauagcaugguggaucgcggcuggggcaauggguguggacuguucggcaaagggggaaucgucacaugcgcuauguuuaccugcaagaaaaacauggaaggcaagauuguucagccugagaaucucgaauacacaaucguggugacgccccacucuggggaggagcaugccgucggaaacgacaccggcaaacacggcauggaaaucaaggugacaccucaguccagcauuaccgaggcggaacugacaggguauggaaccguuacgauggaguguucucccagaaccggccuugauuucaaugaaauggugcugcuccaaauggagaacaaagccuggcugguccaccggcagugguuucuugaccugccgcucccuuggcugcccggggcugauaagcaggaguccaauuggauccagaaggaaacacuggugaccuucaaaaacccucaugccaagaaacaagacguugugguccucggaagccaggagggcgcuaugcacacagcccugaccggggccacggaaauucagauguccucuggcaaucuucuguuuacaggacaucucaagugccgccugagaauggacaaacuucaacugaagggcaugagcuacuccauguguaccgggaaguucaaaguggucaaggagaucgcugagacacagcacggaaccauugugauccggguucaguaugaaggcgaugggagccccugcaaaauccccuucgagauuauggaccucgaaaagagauacgugcugggacgccugaucaccgucaacccuauugugacagagaaagauucuccgguuaacaucgaagcggagcccccuuuuggcgacuccuacauuaucauugggguggagcccggccagcucaagcugaauugguucaagaaaggaagcucuaucggccaaauguuugaaacgaccaugagaggggccaagagaauggcuauccuuggagauacagccugggacuucggcagccucgggggagucuuuaccuccauuggcaaagcccuccaucagguguucggggcuaucuauggcgccgcguuuucuggagugagcuggacaaugaagauucugaucggcguuauuaucaccuggaucgggaugaacucccgcagcacgucucuguccgucagccuugugcucgugggaauugucacacuguaccugggcgugaugguucaggcugauucuggguguguggucuccuggaaaaauaaggagcucaagugcggaagcggcaucuucauuaccgacaacgugcacaccuggacagaacaguauaaauuucaaccugagucccccucuaagcuggccagcgccauccagaaagcucaggaagaggggauuuguggcauccgguccguuaccagacuugagaaucugauguggaagcagaucacaccggaacucaaccacauucuggccgagaaugaagugaaacugacgaucaugaccggagauauucgcggcaucaugcaagcugggaagcggucucuuagaccucagcccacagagcucaaauacagcuggaagaccuggggaaaggccaaaaugcuguccacagaaagcuauaaccagaccuuccugauugacggcccugagacggcggagugccccaauaccaaccgcgccuggaacucucucgaagucgaggauuacggguuuggaguguucacaaccaacaucuggcugaaacuuaaagaaaagcaggacgcuuuuugugacuccaaacugaugagcgccgcuaucaaggauaaucgggccguucaugcggacaugggcuauuggauugagucugcccucaacgauacauggaagaucgagaaggcuagcuucauugaagugaagaauugccacuggccuaaaagccauacccuguggucuaacggcguccuggagagcgaaaugaucauucccaagaaccuugccgggccggugucccaacacaauuacagaccuggauaccacacacagaucgcuggccccuggcaucucgggaaacuggagauggacuucgauuuuugugacggaaccacggugauugucacagaagauugcggcaaccgcgggcccagccugcggaccaccacagccucuggaaagcucaucaccgaguggugcuguagauccugcacgcugccuccgcuucgguaucgcggcgaggacggcuguugguacgggauggaaaucagaccccugaaggagaaagaagagaaucucguuaacagccuggugacagccggacacggccagguggauaauuucucccuggggguccuuggaauggcucucuuucuggaagagaugcugcggaccagagugggcacaaagcaugcgauucuccugguugccgugucuuucgucacccuuaucacagggaacaugagcuuuaaagaccugggacgcgugguugugauggucggcgcuaccauggccgaugacauuggcaugggggugacguaucucgcccugcuggcugccuucaagguucggccuaccuuugcggcuggacuucugcucagaaaacugacauccaaggagcucaugaugaccacaaucggcauugugcugcuuucucaaagcaccauccccgaaacgguccuggagcucacagaugcccuggcccuggggaugauggugcuuaagaucgugcgcaauauggaaaaauaccagcuggcugucaccauuauggccauccucugcguuccuaacgcggugauucugcagaaugcuuggaagguguccuguacaauccucgccgucgugucuguuagcccccugcuucugaccuccagccagcagaagaccgacuggauuccucucgcccugacaaucaagggacugaaccccacggcuaucuuccuuaccacacugucuagaaccaauaaaaagcgguccuggccgcucaacgaggccauuauggcugugggcauggucagcauccuggccucuucccuccugaaaaaugacauuccuaugacagggccccuuguggcgggaggccugcugaccguuugcuaugugcucacgggccgcagcgccgaucuggaacuugagagagcuacagacgucaagugggaggaucaggccgaaaucucuggguccagcccuauucuguccaucaccauuagcgaggacggaucuaugagcaucaagaacgaagaggaggaacagacccucacaauccugauucggaccggccuccuggugaucuccgggcuuuuucccauuucuaucccgauuacagcugccgccugguaccugugggaggucaaaaagcagcgcgcuggagugcugugggauguuccuucucccccucccaugggcaaagcggaacucgaggacggggccuauagaaucaagcaaaaaggaauccugggcuacucccagauuggcgcugggguguacaaggaaggaacguuccacaccauguggcaugucacacggggcgccgugcuuaugcacaaggggaaacgcaucgagcccuccugggccgauguuaagaaagaccugauuagcuauggaggcggguggaagcucgagggagaauggaaagagggcgaagaggugcagguccuggcucucgaaccuggcaagaauccgagagccgugcagaccaagcccgggcuguuuaaaacaaacaccggaacgaucggcgcggugucccuugauuucucuccugggaccagcggaucccccauuaucgacaagaaaggcaagguugucgggcuguacggaaacggcguggugacacggagcggcgcuuaugucucugccaucgcccaaaccgagaaauccauugaggauaauccugaaaucgaggacgauauuuuucgcaagagacggcugacaaucauggaccuccaccccggggcuggaaagaccaaaagauaccugccugccauugugcgcgaagcgaucaagcggggccuuagaacacugauucucgcuccgacgcgcguuguggccgccgagauggaagaggcucugcgggggcuccccaucagauaucagaccccugccauccgcgcugagcauacaggacgggaaauugucgaccugaugugucacgccaccuucaccaugagacuucugagccccgugcgcguuccuaacuacaaucugaucauuauggaugaggcgcauuucacagaccccgccucuaucgcugcccggggcuauauuuccacgagaguggaaaugggggaggcugccggcaucuuuaugaccgccacaccgccuggaagccgggaucccuucccccaguccaacgcuccuaucauugacgaggaacgcgagauccccgaaagaucuuggaauagcggccacgagugggucaccgauuuuaaagggaagacagugugguucguuccuuccauuaaagcgggaaacgacaucgccgcuugccuccggaagaauggcaagaaagugauucaacugagccgcaagaccuuugauucugaauacgucaaaacgagaacaaacgacugggauuucguggugaccaccgacaucuccgagaugggggccaauuuuaaggccgagcgggucaucgauccgagacgcuguaugaaacccguuauucuuacagacggagaggaacgggugauccuggcuggcccuaugcccgugacccauagcucugccgcgcagagacgcgggcggauuggcagaaacccuaagaaugaaaacgaccaguacaucuauaugggagagccccucgaaaaugaugaggacugcgcucacuggaaagaggccaagaugcugcuggauaacauuaauacaccggaaggcaucauuccuagcauguucgagcccgaacgcgagaaggucgacgccaucgauggggaauaccggcucagaggagaggcucgcaaaaccuuuguggaccuuaugagacggggcgaucugccuguuuggcuggccuauaagguggcggccgaggggaucaacuacgcugaccgcagaugguguuucgauggaauuaaaaacaaucagauccucgaagagaacgucgaaguggagauuuggacgaaggagggcgaacggaaaaagcugaagccccgcuggcuugacgccagaaucuauuccgauccucuggcucucaaagaguuuaaggaguucgccgcugggcggaaaucucugacacugaaucucauuaccgagaugggcagacuucccacauucaugacccaaaagacgcgcgacgcccuggauaaccuggcgguucuccacaccgccgaagcuggaggccgggccuacaaucaugcucugagcgagcuuccggagacacuggaaacccuccugcugcucacacuucuggccaccgugacagggggaaucuuucuguuccucauguccggcagagggaucggaaaaaugacccugggcaugugcugcauuaucacggccucuauucuucugugguaugcucagauccagccucacuggauugcggccagcaucauccucgaguuuuuccugauuguccugcucauccccgaacccgagaagcagcgcacaccucaagacaaccagcuuaccuacguggucauugcuauccugaccgugguugccgccacaauggcuaaugaaaugggcuuucuggagaagaccaaaaaggaccucgggcugggauccauugccacacagcagccggagagcaacauccuugauauugaccugcggcccgcgucugccuggacgcucuacgcuguggccaccacauucgugaccccuaugcugagacauuccaucgaaaauagcuccgucaacguuucucugacagcuaucgccaaucaagcgaccgugcucaugggccuugggaaaggauggccccugagcaagauggauauuggcgugccucugcucgccaucggguguuauucccaggucaaccccauuacgcugaccgcugcccuucugcuccugguggcucacuacgccaucauuggaccuggccugcaggcuaaagccacacgggaggcgcagaagcgcgccgcugccggcaucaugaagaauccgaccguugacgggaucacagugauugaucucgaccccaucccuuaugaucccaaauuugaaaagcaacuuggacaggucaugcugcugauucucugcgugacccagguccugaugaugagaacgacaugggcucuuugugaggcccugacccucgccacaggcccuaucucuacccugugggaagggaaccccggacgguucuggaauaccacaauugcggugagcauggcuaacaucuuucgcggcuccuaccuggccggggcuggacuccuuuucagcaucaugaaaaauacgaccaacacaagacggggcaccggcaacauuggggagacacugggagagaaguggaaaucucgccugaaugcccucggcaaguccgaauuucaaaucuauaaaaagagcgggauucaggagguugacagaacccuggccaaggaaggaaucaaacggggcgagacggaucaccaugcugugucucgcggguccgccaaacuuagaugguucgucgagcggaacauggugacaccggaaggaaaaguuguggaccugggcugcggcagagggggauggagcuacuauuguggcgggcucaagaauguccgcgaggugaaaggacugaccaagggcgggccuggacacgaggaacccauucccaugucuaccuacggcuggaaccuggugcggcuccagagcggcguugaugucuuuuucaucccucccgaaaagugcgacacacuucugugugauaucggggaguccucuccuaauccgaccguggaggcgggaagaacacugcgcgugcucaaccuggucgaaaauuggcuuaacaauaacacgcaguucugcauuaaaguucugaaucccuacaugccuagcgugaucgagaagauggaagcccuccaacggaaauauggcggggcucuggugagaaacccccugucccgcaauagcacccaugagauguacugggucuccaacgccucuggaaauauugugagcuccguuaacaugaucucucggaugcucauuaacagauuuacaaugcgccacaagaaagcuaccuaugaaccugacguggaccuuggcagcgggacacggaauaucggaauugaguccgagauccccaaccuggauaucauuggcaagagaaucgaaaagauuaaacaggagcaugaaaccucuuggcacuacgaccaggaucacccguauaagacgugggccuaccauggcagcuaugagaccaaacagacaggguccgcgagcucuauggucaauggagugguucgccugcucaccaagccuugggacgugcugcccacagucacccaaauggccaugacagauaccacgccuuucggccagcagcggguguuuaaagaaaagguggacacaagaacccaggagcccaaggaggggaccaagaaacuuaugaaaaucacagcugaauggcuguggaaagagcucggcaagaagaaaacgccucgcauguguaccagagaagaguucacacggaagguccgcuccaacgccgcucugggcgccauuuuuaccgaugagaauaaguggaaaagcgcuagagaagccguugaggacucucgguucugggaacugguggauaaggagagaaaccuccaccuggaagggaaaugcgagacauguguguacaauaugaugggaaagcgggagaagaaacuuggcgaauuuggcaaagcgaaagggucccgcgccaucugguacauguggcugggagcuagauuccucgaguuugaagcccugggcuuccuuaacgaggaccauugguuuagccgggaaaauucucuguccggggucgagggagagggccuccacaagcugggguauauccugcgcgaugugagcaaaaaggaaggcggagcuauguacgccgacgacaccgccggcugggauacaagaauuacccucgaggaccugaaaaacgaagagaugguuacgaaucacauggaaggggagcauaagaaacuugcggaggcuaucuucaaacugaccuaucaaaacaaggugguccgggugcagcgccccacaccgagaggaaccguuauggauauuaucucccggcgcgaccagagaggcagcgggcaagugggaacauacggccucaauaccuuuacgaacauggaagcccagcugauucggcagauggagggggaaggcgucuucaaaaauauccagcaccuuacagugaccgaggagguugccgugcauaacuggcuggcucgcgucggaagagaacggcucucucgcauggccaucagcggcgaugacugcguggucaagccucuggaugacagauucgcuaacgcccugacagcgcucaaugauauggggaaaauucggaaggacauccaacagugggagcccuccaagggauggaacgauuggacccaggugcccuuuugcucucaccauuuccacgaacugauuaugaaagacggcagaauccuuguugugccuugucgcaaucaggaugagcugauugggcgggccagaaucagccaaggagcuggcuggucccuccgcgaaacggccugccuggggaagucuuaugcucagauguggagccuuauguacuuucaccggagagaccugcgccucgccgcgaacgccauuuguuccgcugucccgucucauugggugcccaccagccggacaaccugguccauccacgccaaacaugaguggaugacaaccgaggacaugcugacaguguggaauagaguuuggauccgcgaaaacccuuggauggaggauaagacccccguggaaagcugggaggaaauuccuuaucugggcaaacgggaggaccaguggugcggaucucucaucggccugacguccagagcuacaugggccaagaauauucaggcugccaucaaccaaguccgcagccuuauugggaaugaggaauacaccgauuacaugcccucuaugaagcgguucagacgggaggaagaggaagcgggagugcugugguga

SEQ ID NO: 20091 - RNA, 9876 nt, Artificial Sequence
  derived and/or modified CDS sequence (opt5) from DENV-2__EU482642__SS-prME
agcgccggaaugaucauuaugcugauccccacagugauggcuuuccaccucacaacgagaaauggggaaccucauaugauugucggaauccaggaaaagggcaaaucccugcuuuuuaagaccgaagacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacagucuucgagcugaccgaugcccucgcccuggggaugauggugcugaagaucgugagaaauauggaaaaauaccagcuugcugucacaaucauggccauucugugcguuccuaacgcggugauccuccagaaugcuuggaagguguccuguaccauucuggccgucgugucuguuagcccccuccugcuuaccuccagccagcagaaaacggacuggaucccucuggcccucacgauuaagggacugaaccccaccgcuaucuuucugacaacccuuucucgcacaaauaaaaagagauccuggccgcugaacgaggccaucauggcugugggcauggucagcauucucgccucuucccugcucaagaaugacaucccuaugaccgggccccugguggcgggaggccuucugacgguuugcuaugugcugacaggccggagcgccgaucucgaacuggagcgcgcuaccgacgucaaaugggaggaucaggccgaaauuucuggguccagcccuauccuuuccauuaccaucagcgaggacggaucuaugagcauuaagaacgaagaggaggaacagacacugaccauccucaucagaacaggccugcucgugauuuccgggcuguuccccaucucuauuccgaucacggcugccgccugguaccuuugggaggucaaaaagcagcgggcuggagugcugugggauguuccuucucccccucccaugggcaaagcggaacuggaggacggggccuaucgcauuaagcaaaagggaauccucggcuacucccagaucggcgcugggguguacaaagaaggaaccuuucacacaauguggcaugucaccagaggcgccgugcugaugcacaaggggaaacggauugagcccuccugggccgauguuaagaaagaccuuaucagcuauggaggcggguggaagcuggagggagaauggaaggagggcgaagaggugcagguccucgcucuggaaccuggcaaaaauccgcgcgccgugcagacaaagcccgggcuguucaaaaccaacacgggaaccauuggcgcggugucccuggauuuuucuccugggacaagcggaucccccaucauugacaagaaaggcaagguugucgggcuuuacggaaacggcguggugaccagaagcggcgcuuaugucucugccaucgcccaaacagagaaguccaucgaggauaauccugaaauugaggacgauaucuuccggaaacgcagacugaccauuauggaccugcaccccggggcuggaaagacaaaacgguaccucccugccaucgugagagaagcgauuaagcgcggccugcggacgcuuauccuggcuccgaccagaguuguggccgccgagauggaagaggcucuccgcgggcugcccauucgguaucagaccccugccaucagagcugagcauaccggacgcgaaaucgucgaccucaugugucacgccaccuucacaaugcggcugcuuagccccgugagaguuccuaacuacaaucugauuaucauggaugaggcgcauuuuacggaccccgccucuauugcugcccgcggcuauaucuccacccggguggaaaugggggaggcugccggcauuuucaugacagccaccccgccuggaagcagagaucccuuuccccaguccaacgcuccuaucaucgacgaggaacgggagauucccgaacgcucuuggaauagcggccacgagugggucacagauuucaaagggaagaccgugugguuuguuccuuccaucaaggcgggaaacgacauugccgcuugccugcgcaaaaauggcaagaaagugauccaacucagccggaagacguucgauucugaauacgucaaaacacgcaccaacgacugggauuuuguggugaccacagacauuuccgagaugggggccaauuucaaggccgagagagucaucgauccgcggagauguaugaaacccguuauccugaccgacggagaggaacgcgugauucuugcuggcccuaugcccgugacacauagcucugccgcgcagcggagagggcgcaucggccggaacccuaagaaugaaaacgaccaguacauuuauaugggagagccccuggaaaaugaugaggacugcgcucacuggaaggaggccaaaaugcuccuggauaacaucaauaccccggaaggcauuaucccuagcauguuugagcccgaaagagagaaggucgacgccauugauggggaauaccgccugcggggagaggcuagaaaaacguucguggaccucaugcgcagaggcgaucuuccuguuuggcuggccuauaagguggcggccgaggggaucaacuacgcugaccggcgcugguguuuugauggaaucaaaaacaaucagauucuggaagagaacgucgaaguggagaucuggacaaaggagggcgaaagaaagaaacucaagccccgguggcuggacgcccgcauuuauuccgauccucuugcucugaaagaguucaaggaguucgccgcugggagaaaaucucucacccugaaucugaucacagagaugggccggcuccccaccuuuaugacgcaaaagaccagagacgcccuugauaaccuggcgguucugcacacagccgaagcuggaggccgcgccuacaaucaugcucucagcgagcugccggagacccuugaaacacugcuccugcugacccuccuugccacagugaccgggggaauuuuccuguuucugauguccggccgggggaucggaaagaugacgcucggcaugugcugcaucauuacagccucuauccugcuuugguaugcucagauucagccucacuggaucgcggccagcauuauccuggaguucuuucucaucguccugcugauucccgaacccgagaaacagagaaccccucaagacaaccagcucaccuacguggucaucgcuauucuuacagugguugccgccaccauggcuaaugaaaugggcuuccuggagaagaccaaaaaggaccuggggcucggauccaucgccacgcagcagccggagagcaacauucuggauaucgaccuucgccccgcgucugccuggacccuguacgcuguggccacaaccuuugugacaccuaugcuccggcauuccauugaaaauagcuccgucaacguuucucugaccgcuaucgccaaucaagcgacggugcugaugggccucgggaaaggauggccccuuagcaagauggauaucggcgugccucugcuggccauuggguguuauucccaggucaaccccaucacccucacagcugcccugcuucugcucguggcucacuacgccauuaucggaccuggccugcaggcuaaggccaccagagaggcgcagaaacgggccgcugccggcauuaugaagaauccgacaguugacgggaucaccgugaucgaucuggaccccauuccuuaugaucccaaauucgaaaagcaacucggacaggucaugcuucugauccugugcgugacgcagguccucaugaugcgcacaaccugggcucugugugaggcccuuacacuggccaccggcccuauuucuacccucugggaagggaaccccggaagauuuuggaauacaacgaucgcggugagcauggcuaacauuuuccggggcuccuaccuggccggggcuggacugcucuuuagcaucaugaaaaauaccacaaacacccgcagaggcacaggcaacaugggggagacccuuggagagaaguggaaaucucggcugaaugcccugggcaaguccgaguuccaaaucuauaagaaaagcgggauucaggagguugaccgcacgcucgccaaggaaggaaucaaaagaggcgagacagaucaccaugcugugucucggggguccgccaagcugcgcugguuugucgagagaaacauggugaccccggaaggaaaaguuguggaccuuggcugcggcagagggggauggagcuacuauuguggcgggcugaagaauguccgggaggugaagggacucaccaaaggcgggccuggacacgaagaacccauucccaugucuacauacggcuggaaccuggugcgccugcagagcggcguugaugucuucuucaucccucccgaaaagugcgacacccuccuuugugauauuggggaguccucuccuaauccgacaguggaggcgggacggacgcugagagugcugaaccucgucgaaaauuggcugaacaauaacacccaguuuugcaucaaaguucuuaaucccuacaugccuagcgugaucgagaagauggaagcccugcaacgcaaauauggcggggcucucgugcggaacccccuguccagaaauagcacacaugagauguacugggucuccaacgccucuggaaauauugugagcuccguuaacaugaucucucgcaugcugauuaaccgguucaccaugagacacaagaaggcuacauaugaaccugacguggaccucggcagcgggacccgcaauaucggaauugaguccgagauccccaaccuugauauuaucggcaaacggaucgaaaagauuaaacaggagcaugaaacgucuuggcacuacgaccaggaucacccguauaagaccugggccuaccauggcagcuaugagacaaaacagaccggguccgcgagcucuauggucaauggagugguuagacugcugacaaagccuugggacgugcuccccaccgucacacaaauggccaugaccgauacgacaccuuuuggccagcagcgcguguucaaggaaaaaguggacacccggacccaggagcccaaggaggggaccaaaaagcugaugaaaaucacggcugaauggcuuuggaaggagcugggcaaaaagaagaccccuagaauuuguacacgcgaagaguuuaccagaaaaguccgguccaacgccgcucucggcgccaucuucacagaugagaauaaguggaaaagcgcucgcgaagccguugaggacucuagauuuugggaacugguggauaaggagcggaaccugcaccucgaagggaaaugcgagaccuguguguacaauaugaugggaaagagagagaagaaacugggcgaguucggcaaggcgaaagggucccgggccauuugguacauguggcuuggagcucgcuuucuggaguucgaagcccucggcuuucugaacgaggaccauugguucagcagagaaaauucucuuuccggggucgagggagagggccugcacaagcucggguauauccugcgggaugugagcaaaaaggaaggcggagcuauguacgccgacgacacagccggcugggauacccgcaucacgcuggaggaccucaagaacgaagagaugguuaccaaucacauggaaggggagcauaaaaagcuggcggaggcuauuuuuaaacuuacauaucaaaacaagguggucagagugcagcggcccaccccgcgcggaacaguuauggauaucauuuccagaaaagaccagcggggcagcgggcaagugggaaccuacggccugaauacguucacaaacauggaagcccagcucauccgccagauggagggggaaggcgucuucaagaauauucagcaccugaccgugacagaggagguugccgugcaaaacuggcuugcuagagucggacgggaacgccugucuagaauggccaucagcggcgaugacugcguggucaagccucucgaugaccgguuugcuaacgcccugaccgcgcugaaugauauggggaaaauccgcaaggacauucagcagugggagcccuccaaaggauggaacgauuggacacaggugcccuucugcucucaucacuuucaugaacucaucaugaaggacggcagaguucugguggucccuugucggaaucaagaugagcuuauugggagagcccgcaucagccagggagcuggcuggucccugcgggaaaccgccugccucgggaaaucuuaugcucagauguggagccugauguacuuccacagacgcgaccuucggcuggccgcgaacgccauuuguuccgcugugccgucucacugggugcccacaagcagaaccacaugguccauccaugccaagcacgaguggaugaccacagaggacaugcucaccguuuggaaucgcguguggauucaggaaaacccuuggauggaggauaagacgcccgucgaaagcugggaggaaaucccuuaucugggcaaacgggaggaccaauggugcggaucucugaucggccucacauccagagcuaccugggccaagaauauucaggcugccaucaaccaggugcgcagccugauugggaaugaggaauacaccgauuacaugcccucuaugaaacgguuuagacgcgaggaagaggaagcgggaguucuuugguga

SEQ ID NO: 20092 - RNA, 9876 nt, Artificial Sequence
  derived and/or modified CDS sequence (opt5) from DENV-2__EU482643__SS-prME
agcgccggcaugaucauuaugcugauccccaccgucauggcuuuccaccugaccacgcggaauggggaaccucauaugauugucggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaaugaagaacaaggccuggcugguccaccggcagugguuucuugaccugccgcucccuuggcugcccggggcugauaaacaggaguccaauuggauucagaaggagacccuggugacauucaaaaacccucaugccaagaaacaagacguugugguccucggaagccaggaaggcgcuaugcacaccgcccugacgggggccacagagauccagauguccucuggcaaucuucuguuuaccggacaucucaagugccgccugagaauggacaaacuucaacugaaaggcaugagcuacuccauguguacagggaaguucaaaguggucaaggaaauugcugagacccagcacggaaccaucgugauucggguucaguaugagggcgaugggagccccugcaaaauccccuucgaaaucauggaccucgagaagagauacgugcugggacgccugauuacagucaacccuaucgugacggaaaaggauucuccgguuaacauugaggcggaacccccuuuuggcgacuccuacaucauuaucgggguggagcccggccagcucaaacugaauugguucaagaaaggaagcucuauuggccaaauguuugagaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaagaacucaagugcggaagcggcauuuucaucaccgacaacgugcacacauggaccgagcaguauaaauuucaaccugaaucccccucuaagcuggccagcgccauucagaaagcucaggaggaagggaucuguggcauucgguccguuacaagacuugagaaucugauguggaagcagaucacgccggagcucaaccacauccuggccgaaaaugaggugaaacugaccauuaugacaggagauaucaagggcauuaugcaagcugggaagcgcucucuucggccucagcccaccgaacucaaauacagcuggaagacauggggaaaagccaagaugcuguccaccgagagcuauaaccagacguuccugaucgacggcccugaaaccacagagugccccaauaccaacagagcguggaacucucucgaggucgaagauuacggguuuggaguguucacaaccaacauuuggcugaaacuuaaggagaagcaggacgccuuuugugacuccaaacugaugagcgcugccaucaaggauaaucgcgcuguucaugccgacaugggcuauuggaucgaaucugcgcucaacgauacauggaaaauugagaaggccuccuucaucgaggugaaaaauugccacuggccuaagagccauacccuguggucuaacggcguccuggaaagcgagaugauuauccccaagaaccuugcugggccggugucccaacacaauuaccggccuggauaccacacgcagauugccggccccuggcaucucgggaaacuggaaauggacuucgauuuuugugacggaacaaccgugaucgucaccgaggauugcggcaacagagggcccagccugcgcacaaccacggcuucuggaaagcucauuacagaauggugcugucgguccugcacccugccuccgcuuagauaucggggcgaggacggcuguugguacgggauggagauccgcccccugaaagaaaaggaggaaaaucucguuaacagccuggugacagccggacacggccagguggauaauuucucccuggggguccuuggaauggcccucuuucuggaggaaaugcugagaacccgggugggcacaaaacaugcuauccuccugguuaccgugucuuucgucacgcuuauuaccgggaacaugagcuuuaaggaccugggaagagugguugugauggucggcgcgacaauggccgaugacaucggcaugggggugaccuaucucgcucugcuggccgccuucaagguucgcccuacauuugcugccggacuucugcuccggaaacugaccuccaaggagcucaugaugacgacaauuggcaucgugcugcuuucucaaagcaccauucccgagacaguccuggaacucaccgaugcgcuggcucuggggaugauggugcuuaaaaucgugagaaauauggagaaguaccagcuggccgucaccaucauggccauucucugcguuccuaacgcugugauccugcagaaugccuggaaaguguccuguacaauucucgcggucgugucuguuagcccccugcuucugacguccagccagcaaaagaccgacuggaucccucucgcucugacaauuaaaggacugaaccccaccgccaucuuccuuacaacccugucucgcacgaauaagaagagauccuggccgcucaacgaagccaucauggcugugggcauggucagcauucuggccucuucccuccugaaaaaugacaucccuaugacagggccccuuguggcuggaggccugcugaccguuugcuaugugcucaccggccggagcgccgaucuggagcuugaacgcgcgacagacgucaagugggaggaucaggccgagauuucuggguccagcccuauccuguccauuaccaucagcgaagacggaucuaugagcauuaaaaacgaggaagaggagcagacacucacgauccugaucagaaccggccuccuggugauuuccgggcuuuuucccaucucuauuccgaucacagcugccgcuugguaccugugggaagucaagaaacagcgggccggagugcugugggauguuccuucucccccucccaugggcaaggccgagcucgaagacggggcuuaucgcauuaagcaaaaaggaauccugggcuacucccagaucggcgcggggguguacaaggagggaaccuuccacacaauguggcaugucaccagaggcgccgugcuuaugcacaaagggaagcggauugaacccuccugggcugauguuaaaaaggaccugaucagcuauggaggcggguggaagcucgagggagaguggaaagaaggcgaggaagugcagguccuggcccucgagccuggcaagaauccgcgcgccgugcagacgaaacccgggcuguuuaagaccaacacaggaaccauuggcgcugugucccuugauuucucuccugggacaagcggaucccccaucauugacaaaaagggcaagguugucgggcuguacggaaacggcguggugaccagaagcggcgccuaugucucugcgaucgcucaaacagaaaaauccaucgaggauaauccugagauugaagacgauaucuuucggaagcgcagacugacgauuauggaccuccaccccggggccggaaaaaccaagcgguaccugccugccaucgugagagaggcuauuaaacgcggccuucggacacugauccucgccccgaccagaguuguggcggcugaaauggaggaagcccugcgcgggcuccccauucgguaucagaccccugccaucagagcugagcauacaggacgcgagaucgucgaccugaugugucacgccacguucaccaugcggcuucugagccccgugagaguuccuaacuacaaucugauuaucauggaugaagcucauuucacagaccccgccucuauugcggcccgcggcuauaucuccacccggguggagaugggggaagcugccggcauuuuuaugacagcuaccccgccuggaagcagagaucccuucccccaguccaacgccccuaucaucgacgaggagcgggaaauucccgagcgcucuuggaauagcggccacgaaugggucacggauuuuaaggggaagacagugugguucguuccuuccaucaaagccggaaacgacauugcugcgugccucagaaagaauggcaaaaaggugauccaacugagccggaaaaccuuugauucugaguacgucaagacccgcacaaacgacugggauuucguggugaccacagacauuuccgaaaugggggccaauuuuaaagcugagagagucaucgauccgcggagauguaugaagcccguuauccuuaccgacggagaggaacgcgugauucuggccggcccuaugcccgugacgcauagcucugccgcucagcggagagggcgcaucggccggaacccuaagaaugagaacgaccaguacauuuauaugggagaaccccucgagaaugaugaagacugcgcccacuggaaagaggcgaagaugcugcuggauaacaucaauacaccggagggcauuaucccuagcauguucgaacccgagagagaaaaagucgacgcuauugauggggaguaccgccuccggggagaagccagaaagaccuuuguggaccuuaugcgcagaggcgaucugccuguuuggcuggccuauaaaguggcugccgaggggaucaacuacgcggaccggcgcugguguuucgauggaaucaagaacaaucagauucucgaggaaaacgucgagguggaaaucuggacaaaggagggcgagcgcaagaagcugaaaccccgguggcuugacgcccgcauuuauuccgauccucuggcucucaaggaauuuaaagaguucgccgcugggagaaagucucugacccugaaucucaucacggaaaugggccggcuucccaccuucaugacacaaaagaccagagacgcccuggauaaccuggcuguucuccacacagccgaggcgggaggccgcgccuacaaucaugcucugagcgaacuuccggagacccuggagacacuccugcugcucacccuucuggccacggugacagggggaauuuuucuguuccucauguccggccgggggaucggaaaaaugacccugggcaugugcugcaucauuaccgcuucuauccuucugugguaugcccagauucagccucacuggaucgccgcuagcauuauccucgaauuuuuccugaucguccugcucauucccgagcccgaaaagcagagaacaccucaagacaaccagcuuaccuacguggucaucgcgauucugacagugguugccgcuacgauggccaaugagaugggcuuucuggagaagaccaagaaagaccucgggcugggauccaucgccacacagcagccggagagcaacauucuugauaucgaccugcgccccgcuucugccuggacccucuacgcgguggccacaaccuucgugacgccuaugcugcggcauuccauugagaauagcuccgucaacguuucucugaccgcuaucgccaaucaagcuacagugcucaugggccuugggaagggauggccccugagcaagauggauaucggcgugccucugcucgccauuggguguuauucccaggucaaccccaucacccugacagcggcccuucugcuccugguggcucacuacgccauuaucggaccuggccugcaggcuaaagccaccagagaagcucagaagcgggccgcggccggcauuaugaaaaauccgacgguugacgggaucacagugaucgaucucgaccccauuccuuaugaucccaaguuugagaaacaacuuggacaggucaugcugcugauccucugcgugacccagguccugaugaugcgcacaaccugggcucuuugugaagcccugacccucgcuacaggcccuauuucuacgcugugggaggggaaccccggaagauucuggaauaccacaaucgccgugagcauggccaacauuuuucggggcuccuaccuggcgggggcuggacuccuuuucagcaucaugaagaauaccacaaacacccgcagaggcacgggcaacaucggggaaacacugggagagaaauggaagucucggcugaaugcccucggcaaguccgaguuucaaauuuauaaaaagagcgggauccaggaaguugaccgcacccuggcuaaagagggaauuaagagaggcgaaaccgaucaccaugccgugucucggggguccgccaaacuucgcugguucgucgagagaaacauggugacaccggagggaaagguuguggaccugggcugcggcagagggggauggagcuacuauuguggcgggcucaagaauguccgggaagugaaaggacugaccaagggcgggccuggacacgaggaacccauccccaugucuacauacggcuggaaccuggugcgccuccagagcggcguugaugucuuuuucauuccucccgagaaaugcgacacgcuucugugugauaucggggaauccucuccuaauccgaccguggaggcuggacggacacugagagugcucaaccuggucgagaauuggcuuaacaauaacacccaguucugcaucaagguucugaaucccuacaugccuagcgugauugagaagauggaggcccuccaacgcaaguauggcggggcgcuggugcggaacccccuguccagaaauagcacacaugaaauguacugggucuccaacgccucuggaaauaucgugagcuccguuaacaugauuucucgcaugcucaucaaccgguuuaccaugagacacaagaaagcuacguaugagccugacguggaccuuggcagcgggacccgcaauauuggaaucgaauccgagauucccaaccuggauaucaucggcaagcggauugagaaaaucaagcaggaacaugagacaucuuggcacuacgaccaggaucacccguauaaaaccugggccuaccauggcagcuaugaaacaaagcagaccggguccgcuagcucuauggucaauggagugguuagacugcucacaaagccuugggacgugcugcccaccgucacgcaaauggccaugacagauaccaccccuuucggccagcagcgcguguuuaaagagaagguggacacacggacgcaggaacccaaagaggggaccaagaaacuuaugaagauuacagcggaguggcuguggaaagaacucggaaagaagaaaaccccuagaauguguacacgcgaggaguucaccagaaagguccgguccaacgccgcucugggcgccaucuuuacagaugagaauaaauggaaaagcgcucgcgaggccguugaagacucuagauucugggagcugguggauaaagaacggaaccuccaccuggaggggaagugcgaaaccuguguguacaauaugaugggaaagagagagaagaaacuuggcgaguuuggcaaagcuaaagggucccgggccauuugguacauguggcugggagcgcgcuuccucgaauuugaggcccugggcuuccuuaacgaagaccauugguuuagcagagaaaauucucuguccggggucgaaggagagggccuccacaaacugggguauauccugcgggaugugagcaagaaggagggcggagcuauguacgccgacgacacggcuggcugggauacccgcaucacacucgaagaccugaaaaacgaggaaaugguuaccaaucacauggagggggaacauaagaaacuugccgaggccauuuucaagcugacauaucaaaacaaaguggucagagugcagcggcccaccccgcgcggaacgguuauggauaucauuuccagacgggaccagcgcggcagcgggcaagugggaacauacggccucaauaccuuuacaaacauggaggcgcagcugaucagacagauggaaggggagggcgucuucaagaauauucagcaccuuaccgugacggaagagguugcugugcaaaacuggcuggcccgggucggacgcgagagacucucucggauggccaucagcggcgaugacugcguggucaagccucuggaugaccgcuucgcuaacgcccugaccgcucucaaugauauggggaaaaucagaaaggacauucagcagugggaacccuccaaaggauggaacgauuggacacaggugcccuuuugcucucaucacuuccaugagcugaucaugaaggacggccggguucuuguggucccuuguagaaaucaagaugaacugauugggcgcgcccggaucagccagggagcgggcuggucccucagagagaccgccugccuggggaaaucuuaugcucagauguggagccuuauguacuuucaccgccgggaccugagacucgccgcuaacgccauuuguuccgcggugccgucucacugggugcccacaagccgcaccacaugguccauccaugccaagcacgaauggaugaccacggaggacaugcugacaguuuggaaucggguguggauuagagauaacccuuggauggaggacaagacccccgucgaaagcugggaggaaaucccuuaucugggcaaacgcgaggaucaguggugcggaucucucaucggccugaccucccgggcuacaugggccaagaauauucaagcugccaucaaccaggugagaagccuuauggggaaugaagaguacaccgacuacaugcccucuaugaaacgcuuccggagagaggaagaggaagcuggaguucugugguga

SEQ ID NO: 20093 - RNA, 9876 nt, Artificial Sequence
  derived and/or modified CDS sequence (opt5) from DENV-2__EU482644__SS-prME
agcgccggcaugaucauuaugcugauccccaccgugauggcuuuccaccugaccacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaccggggugacauaucucgcccugcuggcugccuucaaaguucgcccuaccuuugcggcuggacuucugcuccggaagcugacauccaaggagcucaugaugaccacgauuggcaucgugcugcuuucucagagcacaauucccgaaaccguccuggagcucacagaugcccuggcccuggggaugauggugcuuaaaaucgugagaaauauggaaaaguaccagcuggcugucaccaucaugaccauucucugcguuccuaacgccgugauccugcagaaugcguggaaaguguccuguacaauucucgcugucgugucuguuagcccccugcuucugacguccagccaacagaagaccgacuggaucccucucgcccugacaauuaaaggacugaaccccaccgccaucuuccuuacaacccugucucgcacgaauaagaaaagauccuggccgcucaacgaggcuaucauggccgugggcauggucagcauucuggcuucuucccuccugaagaaugacaucccuaugacagggccccuuguggccggaggccugcugaccguuugcuaugugcucaccggccggagcgcggaucuggaacuugagcgcgccacagacgucaagugggaggaucaggcugaaauuucuggguccagcccuauccuguccauuaccaucagcgaggacggaucuaugagcauuaaaaacgaagaggaggaacagacacucacgauccugaucagaaccggccuccuggugauuuccgggcuuuuucccaucucuauuccgaucacagccgcugccugguaccugugggaggucaagaaacaacgggccggagugcugugggauguuccuucucccccucccaugggcaaggcugaacucgaggacggggcguaucgcauuaaacagaagggaauccugggcuacucccagaucggcgccgggguguacaaggaaggaaccuuccacacaauguggcaugucaccagaggcgcugugcuuaugcacaaagggaagcggauugagcccuccugggccgauguuaaaaaggaccugaucagcuauggaggcggguggaaacucgagggagaauggaaggagggcgaagaggugcagguccuggcccucgaaccuggcaagaauccgcgcgcugugcaaacgaaacccgggcuguuuaagaccaacacaggaaccauuggcgccgugucccuugauuucucuccugggacaagcggaucccccaucauugacaaaaagggcaaaguugucgggcuguacggaaacggcguggugaccagaagcggcgcguaugucucugcuaucgcccagacagagaaguccaucgaggauaauccugaaauugaggacgauaucuuucggaagcgcagacugacgauuauggaccuccaccccggggccggaaaaaccaagcgguaccugccugcuaucgugagagaagccauuaaacgcggccuucggacacugauccucgcgccgaccagaguuguggcugccgagauggaagaggcccugcgcgggcuccccauucgguaucagaccccugcuaucagagccgagcauacaggacgcgaaaucgucgaccugaugugucacgcuacguucaccaugcggcuucugagccccgugagaguuccuaacuacaaucugauuaucauggaugaggcccauuucacagaccccgcgucuauugccgcucgcggcuauaucuccacccggguggaaaugggggaggccgcuggcauuuuuaugacagccaccccgccuggaagcagagaucccuucccccaauccaacgccccuaucaucgacgaggaacgggagauucccgaacgcucuuggaauagcggccacgagugggucacggauuuuaaggggaaaacagugugguucguuccuuccaucaaggcuggaaacgacauugcggccugccucagaaagaauggcaaaaaggugauccagcugagccggaaaaccuuugauucugaauacgucaagacccgcacaaacgacugggauuucguggugaccacagacauuuccgagaugggggcuaauuuuaaagccgagagagucaucgauccgcggagauguaugaagcccguuauccuuaccgacggagaggaacgcgugauucuggccggcccuaugcccgugacgcauagcucugcugcccagcggagagggcgcaucggccggaacccuaaaaaugaaaacgaccaguacauuuauaugggagagccccucgaaaaugaugaggacugcgcgcacuggaaggaggcuaagaugcugcuggauaacaucaauacaccggaaggcauuaucccuagcauguucgagcccgaaagagagaaagucgacgccauugauggggaauaccgccuccggggagaggccagaaagaccuuuguggaccuuaugcgcagaggcgaucugccuguuuggcuggcuuauaaaguggccgcggaggggaucaacuacgccgaccggcgcugguguuucgauggaaucaagaacaaucaaauucucgaagagaacgucgaaguggagaucuggacaaaagagggcgaaagaaagaagcugaaaccccgguggcuugacgcucgcauuuauuccgauccucuggcccucaaggaguuuaaagaguucgcugccgggagaaagucucugacccugaaucucaucacggagaugggccggcuucccaccuucaugacacagaaaaccagagacgcucuggauaaccuggccguucuccacacagcggaagccggaggccgcgcuuacaaucaugcccugagcgagcuuccggagacccuggaaacacuccugcugcucacccuucuggcuacggugacagggggaauuuuucuguuccucauguccggccgggggaucggaaagaugacccugggcaugugcugcaucauuaccgccucuauccuucugugguaugcccagauucagccucacuggaucgcugcgagcauuauccucgaguuuuuccugaucguccugcucauucccgaacccgagaagcaaagaacaccucaggacaaccagcuuaccuacguggucaucgccauucugacagugguugcugccacgauggccaaugaaaugggcuuucuggagaaaaccaagaaagaccucgggcugggauccaucgcuacacagcaaccggagagcaacauucuugauaucgaccugcgccccgccucugcguggacccucuacgccguggcuacaaccuucgugacgccuaugcugcggcauuccauugaaaauagcuccgucaacguuucucugaccgccaucgcuaaucaggccacagugcucaugggccuugggaagggauggccccugagcaaaauggauaucggcgugccucugcucgcgauuggguguuauucccaggucaaccccaucacccugacagccgcccuucugcuccugguggcccacuacgcuauuaucggaccuggccugcaggccaaggcuaccagagaggcccaaaagcgggcggccgcuggcauuaugaaaaauccgacgguugacgggaucacagugaucgaucucgaccccauuccuuaugaucccaaguuugaaaaacagcuuggacaggucaugcugcugauccucugcgugacccaaguccugaugaugcgcacaaccugggcccuuugugaggcucugacccucgccacaggcccuauuucuacgcugugggaagggaaccccggaagauucuggaauaccacaaucgccgugagcauggcgaacauuuuucggggcuccuaccuggcuggggccggacuccuuuucagcaucaugaagaauaccacaaacacccgcagaggcacgggcaacaugggggagacacugggagagaaauggaagucucggcugaaugcucucggcaaauccgaauuucagaucuauaaaaagagcgggauucaggagguugaccgcacccuggccaaagaaggaaucaagagaggcgagaccgaucaccaugccgugucucggggguccgcuaaacuucgcugguucgucgagagaaacauggugacaccggaaggaaagguuguggaccugggcugcggcagagggggauggagcuacuauuguggcgggcucaaaaauguccgggaggugaagggacugaccaagggcgggccuggacacgaagaacccauucccaugucuacauacggcuggaaccuggugcgccuccagagcggcguugaugucuuuuucaucccucccgaaaaaugcgacacgcuucugugugauauuggggaguccucuccuaauccgaccguggaggccggacggacacugagagugcucaaccuggucgaaaauuggcuuaacaauaacacccaauucugcaucaagguucugaaucccuacaugccuagcgugaucgagaaaauggaagcgcuccagcgcaaguauggcggggcccuggugcggaacccccuguccagaaauagcacacaugagauguacugggucuccaacgcuucuggaaauauugugagcuccguuaacaugaucucucgcaugcucauuaaccgguuuaccaugagacacaaaaaggccacguaugaaccugacguggaccuuggcagcgggacccgcaauaucggaauugaguccgagauccccaaccuggauauuaucggcaagcggaucgagaagauuaagcaggagcaugaaacaucuuggcacuacgaccaggaucacccguauaaaaccugggcuuaccauggcagcuaugagacaaagcaaaccggguccgccagcucuauggucaauggagugguuagacugcucacaaaaccuugggacgugcugcccaccgucacgcagauggcgaugacagauaccaccccuuucggccagcagcgcguguuuaaggaaaagguggacacacggacgcaagagcccaaagaggggaccaagaaacuuaugaagaucacagccgaauggcuguggaaagagcucggaaagaaaaagaccccuagaauguguacacgcgaagaguucaccagaaagguccgguccaacgcugcccugggcgcuauuuuuacagaugagaauaaauggaaaagcgcccgcgaagcuguugaggacucuagauucugggaacugguggauaaagagcggaaccuccaccuggaagggaagugcgagaccuguguguacaauaugaugggaaaaagagagaagaaacuuggcgaauuuggcaaagccaaggggucccgggcgaucugguacauguggcugggagcccgcuuccucgaguuugaagcucugggcuuccuuaacgaggaccauugguuuagcagagaaaauucucuguccggggucgagggagagggccuccacaaacugggguauauucugcgggaugugagcaagaaagaaggcggagccauguacgcugacgacacggccggcugggauacccgcaucacacucgaggaccugaagaacgaagagaugguuaccaaucacauggaaggggagcauaagaaacuugccgaggcgaucuucaagcugacauaucagaacaaaguggucagagugcagcggcccaccccgcgcggaacgguuauggauauuaucuccagacgggaccaacgcggcagcgggcaggucggaacauacggccucaauaccuuuacaaacauggaagcucagcugauuagacagauggagggggaaggcgucuucaagaauauccaacaccuuaccgugacggaggagguugccgugcagaacuggcuggcccgggucggacgcgaaagacucucucggauggcuauuagcggcgaugacugcguggucaaaccucuggaugaccgcuucgccaacgcucugaccgcccucaaugauauggggaagaucagaaaggacauccagcagugggagcccuccaaaggauggaacgauuggacacaagugcccuuuugcucucaucacuuccaugaacugauuaugaaggacggccggguucuuguggucccuuguagaaaucaggaugagcugaucgggcgcgcgcggauuagccagggagccggcuggucccucagagaaaccgcuugccuggggaaaucuuaugcccagauguggagccuuauguacuuucaccgccgggaccugagacucgcugccaacgcgaucuguuccgccgugccgucucacugggugcccacaagccgcaccacaugguccauucaugcuaagcacgaguggaugaccacggaggacaugcugacaguuuggaaucggguguggaucagagaaaacccuuggauggaggauaaaacccccgucgaaagcugggaggaaauuccuuaucugggcaagcgcgaggaccaauggugcggaucucucaucggccugaccucccgggccacaugggcuaagaauauccaggccgcuauuaaccaggugagaagccuuaucgggaaugaggaauacaccgauuacaugcccucuaugaaacgcuuccggagagaggaagaggaagccggaguucugugguga

SEQ ID NO: 20094 - RNA, 9876 nt, Artificial Sequence
  derived and/or modified CDS sequence (opt5) from DENV-2__EU482645__SS-prME
agcgcuggaaugaucauuaugcugauccccaccgugauggcuuuccaccugaccacgagaaauggggagccucauaugauugucggaauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagaagguucugauuuucauccuucugacagcuguggccccuuccaugacgaugcgcugcauuggcaucucuaacagagauuuugucgaaggggugagcggaggcuccuggguugacaucgugcucgagcacgggagcugugucaccacaauggcgaagaauaaacccacccuggauuucgaacuuauuaagacagaggccaaacagccugcuacccugcggaaguauugcaucgaagccaaacucacgaacacaaccaccgagucucgcuguccgacacaaggagagcccucccugaaggaagaacaagacaagagauuugugugcaaacauagcaugguggaucggggcuggggcaauggguguggacuguucggcaaagggggaauugugaccugcgcuauguuuacaugcaaaaagaacauggaaggcaaaaucguucagccugagaaucucgaauacacgauuguggugacaccccacucuggggaggagcaugccgucggaaacgacacaggcaagcacggccaggaaaucaaagugaccccucaauccagcaucacagaggcggaacugaccggguauggaacgguuaccauggaguguucuccccgcacaggccuugauuucaaugaaauggugcugcuccagauggagaacaaggccuggcugguccacagacagugguuucuugaccugccgcucccuuggcugcccggggcugauaagcaggaguccaauuggauucaaaaagaaacccuggugacauucaagaacccucaugccaaaaagcaggacguugugguccucggaagccaggagggcgcuaugcacaccgcccugacgggggccacagaaauccaaauguccucuggcaaucuucuguuuaccggacaucucaaaugccggcugcgcauggacaaacuucagcugaagggcaugagcuacuccauguguacagggaaauucaagguggucaaagagauugcugagacccagcacggaaccaucgugauuagaguucaguaugaaggcgaugggagccccugcaagauccccuucgagaucauggaccucgaaaaacgguacgugcugggaagacugauuacagucaacccuaucgugacggagaaggauucuccgguuaacauugaagcggagcccccuuuuggcgacuccuacaucauuaucgggguggagcccggccaacucaagcugaauugguucaaaaagggaagcucuauuggccagauguuugaaaccacaaugcgcggggccaaacggauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacuccagaagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaauauaaguuucagccugagucccccucuaaacuggccagcgccauucagaaggcucaggaagaggggaucuguggcauucgcuccguuacacggcuugagaaucugauguggaaacaaaucacgccggaacucaaccacauccuggccgagaaugaagugaagcugaccauuaugacaggagauaucaaaggcauuaugcaggcugggaagagaucucuucgcccucagcccaccgagcucaaguacagcuggaaaacauggggaaaggccaaaaugcuguccaccgaaagcuauaaccagacguuccugaucgacggcccugagaccgcggagugccccaauacaaaccgggccuggaacucucucgaagucgaggauuacggguuuggaguguucaccacaaacauuuggcugaaacuuaaagaaaagcaagacgcuuuuugugacuccaagcugaugagcgccgcuaucaaagauaauagagccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccagcacaauuaccgcccuggauaccacacccagauugcuggccccuggcaucucgggaagcuggagauggacuucgauuuuugugacggaacgacagugaucgucaccgaagauugcggcaaccgggggcccagccugagaaccacaaccgccucuggaaaacucauuacggaguggugcugucgcuccugcacacugccuccgcuucgguauagaggcgaggacggcuguugguacgggauggaaauccggccccugaaggagaaagaagagaaucucguuaacagccuggugaccgccggacacggccaaguggauaauuucucccuggggguccuuggaauggcucucuuucuggaagagaugcugcgcacaagagugggcaccaagcaugcgauccuccugguugccgugucuuucgucacacuuauuaccgggaacaugagcuuuaaagaccugggacgggugguugugauggucggcgcuacgauggccgaugacaucggcaccggggugacauaucucgcccugcuggcugccuucaagguuagaccuaccuuugcggcuggacuucugcuccgcaagcugacauccaaagagcucaugaugaccacgauuggcaucgugcugcuuucucagagcacaauucccgaaaccguccuggagcucacagaugcccuggcccuggggaugauggugcuuaagaucgugcggaauauggaaaaauaccagcuggcugucaccaucaugaccauucucugcguuccuaacgccgugauccugcagaaugcguggaagguguccuguacaauucucgcugucgugucuguuagcccccugcuucugacguccagccaacagaaaaccgacuggaucccucucgcccugacaauuaagggacugaaccccaccgccaucuuccuuacaacccugucuagaacgaauaaaaagcgcuccuggccgcucaacgaggcuaucauggccgugggcauggucagcauucuggcuucuucccuccugaagaaugacaucccuaugacagggccccuuguggccggaggccugcugaccguuugcuaugugcucaccggcagaagcgcggaucuggaacuugagcgggccacagacgucaaaugggaggaucaggcugaaauuucuggguccagcccuauccuguccauuaccaucagcgaggacggaucuaugagcauuaagaacgaagaggaggaacagacacucacgauccugauccgcaccggccuccuggugauuuccgggcuuuuucccaucucuauuccgaucacagccgcugccugguaccugugggaggucaaaaagcaaagagccggagugcugugggauguuccuucucccccucccaugggcaaagcugaacucgaggacggggcguaucggauuaagcagaagggaauccugggcuacucccagaucggcgccgggguguacaaagaaggaaccuuccacacaauguggcaugucacccgcggcgcugugcuuaugcacaaggggaaaagaauugagcccuccugggccgauguuaagaaagaccugaucagcuauggaggcggguggaagcucgagggagaauggaaggagggcgaagaggugcagguccuggcccucgaaccuggcaaaaauccgcgggcugugcaaacgaagcccgggcuguuuaaaaccaacacaggaaccauuggcgccgugucccuugauuucucuccugggacaagcggaucccccaucauugacaagaaaggcaagguugucgggcuguacggaaacggcguggugacccgcagcggcgcguaugucucugcuaucgcccagacagagaaguccaucgaggauaauccugaaauugaggacgauaucuuuagaaaacggcgccugacgauuauggaccuccaccccggggccggaaagaccaaaagauaccugccugcuaucgugcgggaagccauuaagagaggccuucgcacacugauccucgcgccgacccggguuguggcugccgagauggaagaggcccugagagggcuccccauucgcuaucagaccccugcuauccgggccgagcauacaggaagagaaaucgucgaccugaugugucacgcuacguucaccaugcgccuucugagccccgugcggguuccuaacuacaaucugauuaucauggaugaggcccauuucacagaccccgcgucuauugccgcuagaggcuauaucuccacccgcguggaaaugggggaggccgcuggcauuuuuaugacagccaccccgccuggaagccgggaucccuucccccaauccaacgccccuaucaucgacgaggaaagagagauucccgaacggucuuggaauagcggccacgagugggucacggauuuuaaagggaagacagugugguucguuccuuccaucaaggcuggaaacgacauugcggccugccuccgcaaaaauggcaagaaagugauccagcugagcagaaagaccuuugauucugaauacgucaaaacccggacaaacgacugggauuucguggugaccacagacauuuccgagaugggggcuaauuuuaaggccgagcgcgucaucgauccgagacgguguaugaaacccguuauccuuaccgacggagaagagagagugauucuggccggcccuaugcccgugacgcauagcucugcugcccagcgccgggggagaaucggccgcaacccuaagaaugaaaacgaccaguacauuuauaugggagagccccucgaaaaugaugaggacugcgcgcacuggaaggaggcuaaaaugcugcuggauaacaucaauacaccggaaggcauuaucccuagcauguucgagcccgaacgggagaaggucgacgccauugauggggaauacagacuccgcggagaggcccggaaaaccuuuguggaccuuaugagacgcggcgaucugccuguuuggcuggcuuauaagguggccgcggaggggaucaacuacgccgacagacggugguguuucgauggaaucaaaaacaaucaaauucucgaagagaacgucgaaguggagaucuggacaaaggagggcgaacgcaagaaacugaagcccagauggcuugacgcucggauuuauuccgauccucuggcccucaaagaguuuaaggaguucgcugccgggcgcaaaucucugacccugaaucucaucacggagaugggcagacuucccaccuucaugacacagaagacccgggacgcucuggauaaccuggccguucuccacacagcggaagccggaggcagagcuuacaaucaugcccugagcgagcuuccggagacccuggaaacacuccugcugcucacccuucuggcuacggugacagggggaauuuuucuguuccucauguccggccgcgggaucggaaagaugacccugggcaugugcugcaucauuaccgccucuauccuucugugguaugcccagauucagccucacuggaucgcugcgagcauuauccucgaguuuuuccugaucguccugcucauucccgaacccgagaaacaacggacaccucaggacaaccagcuuaccuacguggucaucgccauucugacagugguugcugccacgauggccaaugaaaugggcuuucuggagaagaccaaaaaggaccucgggcugggauccaucgcuacacagcaaccggagagcaacauucuugauaucgaccugagacccgccucugcguggacccucuacgccguggcuacaaccuucgugacgccuaugcugcgccauuccauugaaaauagcuccgucaacguuucucugaccgccaucgcuaaucaggccacagugcucaugggccuugggaaaggauggccccugagcaagauggauaucggcgugccucugcucgcgauuggguguuauucccaggucaaccccaucacccugacagccgcccuucugcuccugguggcccacuacgcuauuaucggaccuggccugcaggccaaggcuacccgggaggcccagaagagagcggccgcuggcauuaugaagaauccgacgguugacgggaucacagugaucgaucucgaccccauuccuuaugaucccaaauuugaaaagcagcuuggacaggucaugcugcugauccucugcgugacccaaguccugaugaugcggacaaccugggcccuuugugaggcucugacccucgccacaggcccuauuucuacgcugugggaagggaaccccggacgcuucuggaauaccacaaucgccgugagcauggcgaacauuuuuagaggcuccuaccuggcuggggccggacuccuuuucagcaucaugaaaaauaccacaaacacccggcgcggcacgggcaacaugggggagacacugggagagaaguggaaaucuagacugaaugcucucggcaaguccgaauuucagaucuauaagaaaagcgggauucaggagguugaccggacccuggccaaggaaggaaucaaacgcggcgagaccgaucaccaugccgugucuagaggguccgcuaaacuucggugguucgucgagcgcaacauggugacaccggaaggaaaaguuguggaccugggcugcggcagagggggauggagcuacuauuguggcgggcucaagaauguccgggaggugaagggacugaccaaaggcgggccuggacacgaggaacccauucccaugucuacauacggcuggaaccuggugagacuccagagcggcguugaugucuuuuucaucccucccgaaaagugcgacacgcuucugugugauauuggggaguccucuccuaauccgaccguggaggccggacgcacacugcgggugcucaaccuggucgaaaauuggcuuaacaauaacacccaauucugcaucaaaguucugaaucccuacaugccuagcgugaucgagaagauggaagcgcuccagagaaaauauggcggggcccuggugcgcaacccccugucccggaauagcacacaugagauguacugggucuccaacgcuucuggaaauauugugagcuccguuaacaugaucucuagaaugcucauuaaccgcuuuaccaugcggcacaagaaggccacguaugaaccugacguggaccuuggcagcgggaccagaaauaucggaauugaguccgagauccccaaccuggauauuaucggcaaacgcaucgaaaagauuaaacaggagcaugaaacaucuuggcacuacgaccaggaucacccguauaagaccugggcuuaccauggcagcuaugagacaaaacaaaccggguccgccagcucuauggucaauggagugguucggcugcucacaaagccuugggacgugcugcccaccgucacgcagauggcgaugacagauaccaccccuuucggccagcagagaguguuuaaggaaaaaguggacacacgcacgcaagagcccaaggaggggaccaagaaacuuaugaaaaucacagccgaauggcuguggaaagagcucggcaagaagaagaccccucggauguguacaagagaagaguucacccgcaaagucagauccaacgcugcccugggcgcuauuuuuacagaugagaauaaguggaaaagcgcccgggaagcuguugaggacucucgcuucugggaacugguggauaaggagagaaaccuccaccuggaagggaaaugcgagaccuguguguacaauaugaugggaaagcgggagaagaaacuuggcgaauuuggcaaggccaaaggguccagagcgaucugguacauguggcugggagcccgguuccucgaguuugaagcucugggcuuccuuaacgaggaccauugguuuagccgcgaaaauucucuguccggggucgagggagagggccuccacaagcugggguauauucugagagaugugagcaaaaaggaaggcggagccauguacgcugacgacacggccggcugggauacccggaucacacucgaggaccugaagaacgaagagaugguuaccaaucacauggaaggggagcauaagaaacuugccgaggcgaucuucaaacugacauaucagaacaaagugguccgcgugcagagacccaccccgcggggaacgguuauggauauuaucucccgcagagaccaacggggcagcgggcaggucggaacauacggccucaauaccuuuacaaacauggaagcucagcugauucgccagauggagggggaaggcgucuucaaaaauauccaacaccuuaccgugacggaggagguugccgugcagaacuggcuggccagagucggacgggaacgccucucuagaauggcuauuagcggcgaugacugcguggucaagccucuggaugaccgguucgccaacgcucugaccgcccucaaugauauggggaagauccgcaaagacauccagcagugggagcccuccaagggauggaacgauuggacacaagugcccuuuugcucucaucacuuccaugaacugauuaugaaagacggcagaguucuuguggucccuugucggaaucaggaugagcugaucgggagagcgcgcauuagccagggagccggcuggucccuccgggaaaccgcuugccuggggaagucuuaugcccagauguggagccuuauguacuuucacagacgcgaccugcggcucgcugccaacgcgaucuguuccgccgugccgucucacugggugcccacaagcagaaccacaugguccauucaugcuaaacacgaguggaugaccacggaggacaugcugacaguuuggaaucgcguguggauccgggaaaacccuuggauggaggauaagacccccgucgaaagcugggaggaaauuccuuaucugggcaagagagaggaccaauggugcggaucucucaucggccugaccucccgcgccacaugggcuaaaaauauccaggccgcuauuaaccaggugcggagccuuaucgggaaugaggaauacaccgauuacaugcccucuaugaagagauuccgccgggaggaagaggaagccggaguucugugguga

SEQ ID NO: 20095 - RNA, 9876 nt, Artificial Sequence
  derived and/or modified CDS sequence (opt5) from DENV-2__EU482646__SS-prME
agcgccggcaugaucauuaugcugauccccacagugauggcuuuccaccugacaacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucguuccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuuauuugcaagcauagcaugguggaucgcggcuggggcaauggguguggacuguucggcaaagggggaaucgugaccugcgcuauguuuacaugcaagaaaaacauggaaggcaagauuguccagccugagaaucucgaauacacgaucguugugacaccccacucuggggaggagcaugccgugggaaacgacacaggcaaacacggcaaggaaaucaaagucaccccucaguccagcauuacagaggcggaacugaccggguauggaacggugaccauggaguguucucccagaacaggccuugauuucaaugaaaugguucugcuccaaauggagaacaaggccuggcuggugcaccggcagugguuucuugaccugccgcucccuuggcugcccggggcugauaagcaggaguccaauuggauccagaaagaaacccuggucacauucaagaacccucaugccaaaaagcaagacgugguugugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugaaagagaucgcugagacccagcacggaaccauugucauccgggugcaguaugaaggcgaugggagccccugcaagauccccuucgagauuauggaccucgagaagcgguacguucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggagucuucaccacaaacaucuggcugaaacuuaaagaaaagcaggacgcuuuuugugacuccaagcugaugagcgccgcuaucaaagauaaucgcgccgugcaugcggacaugggcuauuggauugagucugcccucaacgauaccuggaagaucgagaaggcuagcuucauugaaguuaagaauugccacuggccuaaaagccauacacuguggucuaacggcgugcuggagagcgaaaugaucauucccaagaaccuugccgggccggucucccaacacaauuaccggccuggauaccacacccagaucgcuggccccuggcaucucgggaagcuggagauggacuucgauuuuugugacggaacgacagugauugugaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauccgcccccugaaggagaaagaagagaaucucgucaacagccugguuaccgccggacacggccagguggauaauuucucccugggggugcuuggaauggcucucuuucuggaagagaugcugagaacacgggucggcaccaagcaugcgauucuccugguggccguuucuuucgugacacuuaucaccgggaacaugagcuuuaaagaccugggaagagucgugguuauggugggcgcuacgauggccgaugacauuggcaugggggucaccuaucucgcccugcuggcugccuucaaggugcgcccuacauuugcggcuggacuucugcuccggaagcugaccuccaaagagcucaugaugacaaccaucggcauuguucugcuuucucaaagcacgauccccgaaacagugcuggagcucaccgaugcccuggcccuggggaugaugguccuuaagaucgugagaaauauggaaaaauaccagcuggcugugacaauuauggccauccucugcgucccuaacgcgguuauucugcagaaugcuuggaagguguccuguaccauccucgccguggucucugugagcccccugcuucugaccuccagccagcagaagaccgacuggauuccucucgcccugacgaucaagggacugaaccccaccgcuaucuuccuuacaacccugucucgcacaaauaaaaagagauccuggccgcucaacgaggccauuauggcuguuggcauggugagcauccuggccucuucccuccugaagaaugacauuccuaugaccgggccccuugucgcgggaggccugcugacggugugcuauguucucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauccugauuagaacaggccuccuggucaucuccgggcuuuuucccauuucuaucccgauuacggcugccgccugguaccugugggaggugaaaaagcagcgggcuggaguccugugggaugugccuucucccccucccaugggcaaagcggaacucgaggacggggccuaucgcaucaagcaaaagggaauccugggcuacucccagauuggcgcugggguuuacaaagaaggaaccuuccacacaauguggcaugugaccagaggcgccguccuuaugcacaaggggaaacggaucgagcccuccugggccgaugugaagaaagaccugauuagcuauggaggcggguggaagcucgagggagaauggaaggagggcgaagagguucaggugcuggcucucgaaccuggcaaaaauccgcgcgccguccagacaaagcccgggcuguuuaaaaccaacacgggaaccaucggcgcggugucccuugauuucucuccugggacaagcggaucccccauuaucgacaagaaaggcaaggugguugggcuguacggaaacggcgucgugaccagaagcggcgcuuaugugucugccaucgcccaaacagagaaguccauugaggauaauccugaaaucgaggacgauauuuuucggaaacgcagacugaccaucauggaccuccaccccggggcuggaaagacaaaacgguaccugccugccauugucagagaagcgaucaagcgcggccuucggacgcugauucucgcuccgaccagagugguugccgccgagauggaagaggcucugcgcgggcuccccauccgguaucagaccccugccaucagagcugagcauaccggacgcgaaauuguggaccugaugugucacgccaccuucacaaugcggcuucugagccccgucagagugccuaacuacaaucugaucauuauggaugaggcgcauuucacggaccccgccucuaucgcugcccgcggcuauauuuccacccggguugaaaugggggaggcugccggcaucuuuaugacagccaccccgccuggaagcagagaucccuucccccaguccaacgcuccuaucauugacgaggaacgggagauccccgaacgcucuuggaauagcggccacgagugggugacagauuuuaaagggaagaccgucugguucgugccuuccauuaaggcgggaaacgacaucgccgcuugccuccgcaaaaauggcaagaaaguuauucaacugagccggaagacguuugauucugaauacgugaaaacacgcaccaacgacugggauuucgucgugaccacagacaucuccgagaugggggccaauuuuaaggccgagagagugaucgauccgcggagauguaugaaacccgucauucuuaccgacggagaggaacgcguuauccuggcuggcccuaugcccgugacacauagcucugccgcgcagcggagagggcgcauuggccggaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaaagagagaagguggacgccaucgauggggaauaccgccuccggggagaggcuagaaaaacguuugucgaccuuaugcgcagaggcgaucugccuguguggcuggccuauaagguugcggccgaggggaucaacuacgcugaccggcgcugguguuucgauggaauuaaaaacaaucagauccucgaagagaacguggaagucgagauuuggacaaaggagggcgaaagaaagaaacugaagccccgguggcuugacgcccgcaucuauuccgauccucuggcucucaaagaguuuaaggaguucgccgcugggagaaaaucucugacccugaaucucauuacagagaugggccggcuucccaccuucaugacgcaaaagaccagagacgcccuggauaaccuggcggugcuccacacagccgaagcuggaggccgcgccuacaaucaugcucugagcgagcuuccggagacccuggaaacacuccugcugcucacccuucuggccacaguuaccgggggaaucuuucuguuccucauguccggccgggggaucggaaagaugacgcugggcaugugcugcauuacaaccgccucuauccuucugugguaugcucagauucagccucacuggaucgcggccagcauuauccucgaguuuuuccugaucgugcugcucauucccgaacccgagaaacagagaaccccucaagacaaccagcuuacauacgucgugaucgcuauucugaccgucguggccgccacaauggcuaaugaaaugggcuuucuggagaagacgaaaaaggaccucgggcugggauccaucgccacccagcagccggagagcaacauucuugauaucgaccugcgccccgcgucugccuggacacucuacgcuguugccaccacauucgugaccccuaugcugcggcauuccauugaaaauagcuccgugaacgucucucugacggcuaucgccaaucaagcgaccguucucaugggccuugggaaaggauggccccugagcaagauggauaucggcgugccucugcucgccauuggguguuauucccaggugaaccccaucacacugaccgcugcccuucugcuccuggucgcucacuacgccauuaucggaccuggccugcaggcuaaggccacaagagaggcgcagaaacgggccgcugccggcauuaugaagaauccgaccguggacgggaucacgguuaucgaucucgaccccauuccuuaugaucccaaauuugaaaagcaacuuggacaggugaugcugcugauccucugcgucacacaggugcugaugaugcgcaccacaugggcucuuugugaggcccugacccucgccaccggcccuauuucuacacugugggaagggaaccccggaagauucuggaauacgaccaucgcggucagcauggcuaacauuuuucggggcuccuaccuggccggggcuggacuccuuuucagcaucaugaaaaauacaaccaacacacgcagaggcaccggcaacaugggggagacgcugggagagaaguggaaaucucggcugaaugcccucggcaaguccgaauuucaaaucuauaagcgcagcgggauucaggagguggacagaacacuggccaaagaaggaaucaagcggggcgagaccgaucaccaugcuguuucucgcggguccgccaaacuuagaugguucguggagcggaacauggucaccccggaaggaaaggugguugaccugggcugcggcagagggggauggagcuacuauuguggcgggcucaaaaaugugcgcgaggucaagggacugacaaagggcgggccuggacacgaagaacccauucccaugucuaccuacggcuggaaccuggugcggcuccagagcggcguggaugucuuuuucaucccucccgaaaaaugcgacacacuucugugugauauuggggaguccucuccuaauccgacggucgaggcgggaagaacccugcgcgugcucaaccugguggaaaauuggcuuaacaauaacacacaguucugcaucaagguccugaaucccuacaugccuagcguuaucgagaaaauggaagcccuccaacggaaguauggcggggcucuggugagaaacccccugucccgcaauagcacccaugagauguacuggguguccaacgccucuggaaauauugucagcuccgugaacaugaucucucggaugcucauuaacagauuuacaaugcgccacaaaaaggcuaccuaugaaccugacguugaccuuggcagcgggacgcggaauaucggaauugaguccgagauccccaaccuggauauuaucggcaagagaaucgagaagauuaagcaggagcaugaaaccucuuggcacuacgaccaggaucacccguauaaaacaugggccuaccauggcagcuaugagaccaagcagacaggguccgcgagcucuauggugaauggagucgugcgccugcucaccaaaccuugggacguucugcccacagugacccaaauggccaugacggauacaaccccuuucggccagcagcgggucuuuaaggaaaagguggacaccagaacacaggagcccaaagaggggacgaagaaacuuaugaagaucaccgcugaauggcuguggaaagagcucggaaagaaaaagacaccucgcauguguaccagagaagaguucacacggaaggugcgcuccaacgccgcucugggcgccauuuuuaccgaugagaauaaauggaaaagcgcuagagaagccgucgaggacucucgguucugggaacugguugauaaagagagaaaccuccaccuggaagggaagugcgagacauguguguacaauaugaugggaaaacgggagaagaaacuuggcgaauuuggcaaagcgaaggggucccgcgccaucugguacauguggcugggagcuagauuccucgaguuugaagcccugggcuuccuuaacgaggaccauugguuuagccgggaaaauucucuguccgggguggagggagagggccuccacaaacugggguauauucugcgcgaugucagcaagaaagaaggcggagcuauguacgccgacgacaccgccggcugggauacgagaaucacccucgaggaccugaagaacgaagagauggugacaaaucacauggaaggggagcauaagaaacuugcggaggcuaucuucaagcugaccuaucaaaacaaaguugugcggguccagcgccccacaccgagaggaaccgugauggauauuaucucccggcgcgaccagagaggcagcgggcaaguuggaacguacggccucaauacauuuaccaacauggaagcccagcugauucggcagauggagggggaaggcguguucaagaauauccagcaccuuacagucaccgaggagguggccguucaaaacuggcuggcucgcgugggaagagaacggcucucucgcauggccauuagcggcgaugacugcgucgugaaaccucuggaugacagauucgcuaacgcccugacggcgcucaaugauauggggaagauccggaaggacauccagcagugggagcccuccaaaggauggaacgauuggacccagguccccuuuugcucucaucacuuccaugaacugauuaugaaggacggcagagugcuuguugugccuugucgcaaucaagaugagcugaucgggcgggccagaauuagccagggagcuggcuggucccuccgcgaaacagccugccuggggaaaucuuaugcucagauguggagccuuauguacuuucaccggagagaccugcgccucgccgcgaacgccaucuguuccgcugucccgucucacugggugcccaccagccggacaaccugguccauucaugccaagcacgaguggaugacaaccgaggacaugcugacgguguggaauagaguuuggauccgcgaaaacccuuggauggaggauaaaacacccguggaaagcugggaggaaauuccuuaucugggcaagcgggaggaccaguggugcggaucucucaucggccugaccuccagagcuaccugggccaagaauauccaagcugccauuaaccagguccgcagccuuaucgggaaugaggaauacacagauuacaugcccucuaugaaacgguucagacgggaggaagaggaagcgggagugcugugguga

SEQ ID NO: 20096 - RNA, 9876 nt, Artificial Sequence
  derived and/or modified CDS sequence (opt5) from DENV-2__EU482647__SS-prME
agcgccggcaugaucauuaugcugauccccaccgucauggcuuuccaccugacaacgcggaauggggaaccucauaugauugucggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaaugaagaacaaggccuggcugguccaccggcagugguuucuugaccugccgcucccuuggcugcccggggcugauaaacaggaguccaauuggauucagaaggagacccuggugacauucaaaaacccucaugccaagaaacaagacguugugguccucggaagccaggaaggcgcuaugcacaccgcccugacgggggccacagagauccagauguccucuggcaaucuucuguuuaccggacaucucaagugccgccugagaauggacaaacuucaacugaaaggcaugagcuacuccauguguacagggaaguucaaaguggucaaggaaauugcugagacccagcacggaaccaucgugauucggguucaguaugagggcgaugggagccccugcaaaauccccuucgaaaucauggaccucgagaagagauacgugcugggacgccugauuacagucaacccuaucgugacggaaaaggauucuccgguuaacauugaggcggaacccccuuuuggcgacuccuacaucauuaucgggguggagcccggccagcucaaacugaauugguucaagaaaggaagcucuauuggccaaauguuugagaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaagaacucaagugcggaagcggcauuuucaucaccgacaacgugcacacauggaccgagcaguauaaauuucaaccugaaucccccucuaagcuggccagcgccauucagaaagcucaggaggaagggaucuguggcauucgguccguuacaagacuugagaaucugauguggaagcagaucacgccggagcucaaccacauccuggccgaaaaugaggugaaacugaccauuaugacaggagauaucaagggcauuaugcaagcugggaagcgcucucuucggccucagcccaccgaacucaaauacagcuggaagacauggggaaaagccaagaugcuguccaccgagagcuauaaccagacguuccugaucgacggcccugaaaccgcggagugccccaauacaaacagagccuggaacucucucgaggucgaagauuacggguuuggaguguucaccacaaacauuuggcugaaacuuaaggagaagcaggacgcuuuuugugacuccaaacugaugagcgccgcuaucaaggauaaucgcgccguucaugcggacaugggcuauuggaucgaaucugcccucaacgauaccuggaaaauugagaaggcuuccuucaucgaggugaaaaauugccacuggccuaagagccauacacuguggucuaacggcguccuggaaagcgagaugauuauccccaagaaccuugccgggccggugucccaacacaauuaccggccuggauaccacacccagauugcuggccccuggcaucucgggaaacuggaaauggacuucgauuuuugugacggaacgacagugaucgucaccgaggauugcggcaacagagggcccagccugcgcaccacaaccgccucuggaaagcucauuacggaauggugcugucgguccugcacacugccuccgcuuagauaucggggcgaggacggcuguugguacgggauggagauccgcccccugaaagaaaaggaggaaaaucucguuaacagccuggugaccgccggacacggccagguggauaauuucucccuggggguccuuggaauggcucucuuucuggaggaaaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaagguucgcccuacauuugcggcuggacuucugcuccggaaacugaccuccaaggagcucaugaugacaaccauuggcaucgugcugcuuucucaaagcacgauucccgagacaguccuggaacucaccgaugcccuggcccuggggaugauggugcuuaaaaucgugagaaauauggagaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucucgcacaaauaagaagagauccuggccgcucaacgaagccaucauggcugugggcauggucagcauucuggccucuucccuccugaaaaaugacaucccuaugaccgggccccuuguggcgggaggccugcugacgguuugcuaugugcucacaggccggagcgccgaucuggagcuugaacgcgcuaccgacgucaagugggaggaucaggccgagauuucuggguccagcccuauccuguccauuaccaucagcgaagacggaucuaugagcauuaaaaacgaggaagaggagcagacacucaccauccugaucagaacaggccuccuggugauuuccgggcuuuuucccaucucuauuccgaucacggcugccgccugguaccugugggaagucaagaaacagcgggcuggagugcugugggauguuccuucucccccucccaugggcaaggcggagcucgaagacggggccuaucgcauuaagcaaaaaggaauccugggcuacucccagaucggcgcugggguguacaaggagggaaccuuccacacaauguggcaugucaccagaggcgccgugcuuaugcacaaagggaagcggauugaacccuccugggccgauguuaaaaaggaccugaucagcuauggaggcggguggaagcucgagggagaguggaaagaaggcgaggaagugcagguccuggcucucgagccuggcaagaauccgcgcgccgugcagacaaaacccgggcuguuuaagaccaacacgggaaccauuggcgcggugucccuugauuucucuccugggacaagcggaucccccaucauugacaaaaagggcaagguugucgggcuguacggaaacggcguggugaccagaagcggcgcuuaugucucugccaucgcccaaacagaaaaauccaucgaggauaauccugagauugaagacgauaucuuucggaagcgcagacugaccauuauggaccuccaccccggggcuggaaaaacaaagcgguaccugccugccaucgugagagaggcgauuaaacgcggccuucggacgcugauccucgcuccgaccagaguuguggccgccgaaauggaggaagcucugcgcgggcuccccauucgguaucagaccccugccaucagagcugagcauaccggacgcgagaucgucgaccugaugugucacgccaccuucacaaugcggcuucugagccccgugagaguuccuaacuacaaucugauuaucauggaugaagcgcauuucacggaccccgccucuauugcugcccgcggcuauaucuccacccggguggagaugggggaagcugccggcauuuuuaugacagccaccccgccuggaagcagagaucccuucccccaguccaacgcuccuaucaucgacgaggagcgggaaauucccgagcgcucuuggaauagcggccacgaaugggucacagauuuuaaggggaagaccgugugguucguuccuuccaucaaagcgggaaacgacauugccgcuugccucagaaagaauggcaaaaaggugauccaacugagccggaaaacguuugauucugaguacgucaagacacgcaccaacgacugggauuucguggugaccacagacauuuccgaaaugggggccaauuuuaaagccgagagagucaucgauccgcggagauguaugaagcccguuauccuuaccgacggagaggaacgcgugauucuggcuggcccuaugcccgugacacauagcucugccgcgcagcggagagggcgcaucggccggaacccuaagaaugagaacgaccaguacauuuauaugggagaaccccucgagaaugaugaagacugcgcucacuggaaagaggccaagaugcugcuggauaacaucaauaccccggagggcauuaucccuagcauguucgaacccgagagagaaaaagucgacgccauugauggggaguaccgccuccggggagaagcuagaaagacguuuguggaccuuaugcgcagaggcgaucugccuguuuggcuggccuauaaaguggcggccgaggggaucaacuacgcugaccggcgcugguguuucgauggaaucaagaacaaucagauucucgaggaaaacgucgagguggaaaucuggacaaaggagggcgagcgcaagaagcugaaaccccgguggcuugacgcccgcauuuauuccgauccucuggcucucaaggaauuuaaagaguucgccgcugggagaaagucucugacccugaaucucaucacagaaaugggccggcuucccaccuucaugacgcaaaagaccagagacgcccuggauaaccuggcgguucuccacacagccgaggcuggaggccgcgccuacaaucaugcucugagcgaacuuccggagacccuggagacacuccugcugcucacccuucuggccacagugaccgggggaauuuuucuguuccucauguccggccgggggaucggaaaaaugacgcugggcaugugcugcaucauuacagccucuauccuucugugguaugcucagauucagccucacuggaucgcggccagcauuauccucgaauuuuuccugaucguccugcucauucccgagcccgaaaagcagagaaccccucaagacaaccagcuuaccuacguggucaucgcuauucugacagugguugccgccaccauggcuaaugagaugggcuuucuggagaagacaaagaaagaccucgggcugggauccaucgccacgcagcagccggagagcaacauucuugauaucgaccugcgccccgcgucugccuggacccucuacgcuguggccacaaccuucgugacaccuaugcugcggcauuccauugagaauagcuccgucaacguuucucugaccgcuaucgccaaucaagcgacggugcucaugggccuugggaagggauggccccugagcaagauggauaucggcgugccucugcucgccauuggguguuauucccaggucaaccccaucacccugacagcugcccuucugcuccugguggcucacuacgccauuaucggaccuggccugcaggcuaaagccaccagagaagcgcagaagcgggccgcugccggcauuaugaaaaauccgacaguugacgggaucaccgugaucgaucucgaccccauuccuuaugaucccaaguuugagaaacaacuuggacaggucaugcugcugauccucugcgugacgcagguccugaugaugcgcacaaccugggcucuuugugaagcccugacacucgccaccggcccuauuucuacccugugggaggggaaccccggaagauucuggaauacaacgaucgcggugagcauggcuaacauuuuucggggcuccuaccuggccggggcuggacuccuuuucagcaucaugaagaauaccacaaacacccgcagaggcacaggcaacaucggggaaacccugggagagaaauggaagucucggcugaaugcccucggcaaguccgaguuucaaacguauaaaaagagcgggauucaggaaguugaccgcacacuggccaaagagggaaucaagagaggcgaaaccgaucaccaugcugugucucggggguccgccaaacuucgcugguucgucgagagaaacauggugaccccggagggaaagguuguggaccugggcugcggcagagggggauggagcuacuauuguggcgggcucaagaauguccgggaagugaaaggacugacaaagggcgggccuggacacgaggaacccauucccaugucuaccuacggcuggaaccuggugcgccuccagagcggcguugaugucuuuuucaucccucccgagaaaugcgacacacuucugugugauauuggggaauccucuccuaauccgacgguggaggcgggacggacccugagagugcucaaccuggucgagaauuggcuuaacaauaacacacaguucugcaucaagguucugaaucccuacaugccuagcgugaucgagaagauggaggcccuccaacgcaaguauggcggggcucuggugcggaacccccuguccagaaauagcacccaugaaauguacugggucuccaacgccucuggaaauauugugagcuccguuaacaugaucucucgcaugcucauuaaccgguuuacaaugagacacaagaaagcuaccuaugagccugacguggaccuuggcagcgggacgcgcaauaucggaauugaauccgagauccccaaccuggauauuaucggcaagcggaucgagaaaauuaagcaggaacaugagaccucuuggcacuacgaccaggaucacccguauaaaacaugggccuaccauggcagcuaugaaaccaagcagacaggguccgcgagcucuauggucaauggagugguuagacugcucaccaagccuugggacgugcugcccacagucacccaaauggccaugacggauacaaccccuuucggccagcagcgcguguuuaaagagaagguggacacccggacacaggaacccaaagaggggacgaagaaacuuaugaagaucaccgcugaguggcuguggaaagaacucggaaagaagaaaacaccuagaauguguacccgcgaggaguucacaagaaagguccgguccaacgccgcucugggcgccauuuuuaccgaugagaauaaauggaaaagcgcucgcgaggccguugaagacucuagauucugggagcugguggauaaagaacggaaccuccaccuggaggggaagugcgaaacauguguguacaauaugaugggaaagagagagaagaaacuuggcgaguuuggcaaagcgaaagggucccgggccaucugguacauguggcugggagcucgcuuccucgaauuugaggcccugggcuuccuuaacgaagaccauugguuuagcagagaaaauucucuguccggggucgaaggagagggccuccacaaacugggguauauucugcgggaugugagcaagaaggagggcggagcuauguacgccgacgacaccgccggcugggauacgcgcaucacccucgaagaccugaaaaacgaggaaaugguuacaaaucacauggagggggaacauaagaaacuugcggaggcuaucuucaagcugaccuaucaaaacaaaguggucagagugcagcggcccacaccgcgcggaaccguuauggauauuaucuccagacgggaccagcgcggcagcgggcaagugggaacguacggccucaauacauuuaccaacauggaggcccagcugauuagacagauggaaggggagggcgucuucaagaauauccagcaccuuacagugaccgaagagguugccgugcaaaacuggcuggcucgggucggacgcgagagacucucucggauggccauuagcggcgaugacugcguggucaagccucuggaugaccgcuucgcuaacgcccugacggcgcucaaugauauggggaaaaucagaaaggacauccagcagugggaacccuccaaaggauggaacgauuggacccaggugcccuuuugcucucaucacuuccaugagcugauuaugaaggacggccggguucuuguggucccuuguagaaaucaagaugaacugaucgggcgcgcccggauuagccagggagcuggcuggucccucagagagacagccugccuggggaaaucuuaugcucagauguggagccuuauguacuuucaccgccgggaccugagacucgccgcgaacgccaucuguuccgcugugccgucucacugggugcccaccagccgcacaaccugguccauucaugccaagcacgaauggaugacaaccgaggacaugcugacgguuuggaaucggguguggaucagagagaacccuuggauggaagauaagacacccgucgagagcugggaagagauuccuuaucugggcaaacgcgaagaccaguggugcggaucucucaucggccugaccucccgggcuaccugggccaagaauauccaagcugccauuaaccaggugagaagccuuaucgggaaugaggaguacacagauuacaugcccucuaugaaacgcuuccggagagaagaggaagaggcgggaguucugugguga

SEQ ID NO: 20097 - RNA, 9876 nt, Artificial Sequence
  derived and/or modified CDS sequence (opt5) from DENV-2__EU482648__SS-prME
accgccggagugaucauuaugcugauccccacagcuauggccuuccaccucacgacccggaauggggagccucauaugauugucggacggcaggaaaagggcaagucccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuugucugcaagcauuccaugguggauagaggcuggggcaacggguguggacuguucggcaaagggggaauugugacaugcgcgauguuuacgugcaaaaagaauauggaaggcaaaaucguccagccugagaaccucgaauacaccauuguuaucacaccccacagcggggaggagcaugccgugggaaaugacaccggcaagcacggcaaagaaaucaagauuacaccucagucuuccaucaccgaggcugaacugacgggguauggaaccgugacaauggaguguagcccccggaccggccuugauuucaacgaaaugguccugcuccaaauggaggacaaagccuggcuggugcaccgccagugguuucuugaucugccgcucccuuggcugcccggggcugacacacagggaucuaauuggauucagaaggagacccugguuacguucaagaacccucaugccaaaaagcaagacguggucgugcucggcucccaggaaggggccaugcacacagcucugaccggcgcgacagagauccagaugagcuccggaaaucuucuguuuaccggccaucucaaaugcagacugcggauggauaaacuucaacugaaagggaugucuuacagcauguguaccggaaaguucaagauuguuaaagaaaucgccgagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggcugaacccccuuuuggggauucuuacauuaucaucggcguggagcccggacagcucaaacugaauugguucaagaagggcuccagcauugggcaaauguuugagaccacaaugagaggagccaaacgcauggccauccuuggcgacaccgcuugggauuucgggucucugggaggcgucuuuacgagcauugggaaggcccuccaccagguguucggcgcgaucuacggagcugccuuuuccggcguuucuuggacaaugaaaauucugaucggggccaucauuaccuggaucggaaugaacagccgguccaccagccugucugugucccuuguccucgugggcgugauuacacuguaucugggggcuaugguucaggccgacagcggaugugucgugucuuggaagaauaaagaacucaagugcggcuccgggaucuucauuaccgauaacgugcacacauggacggagcaguacaaguuucaaccugaaagccccuccaaacuggcuucugccauccagaaggcgcaugaggaaggcaucuguggaauuagaagcgucacccgccuugagaaucugauguggaaacagaucacaccggagcucaaccacauucuguccgaaaaugaggugaagcugaccaucaugacaggcgacauuaaagggaucaugcaggccggaaagcggucucuuagaccucaacccaccgaacucaaauauagcuggaagacguggggcaaggcuaaaaugcuguccaccgagagccauaaccagacauuccugaucgaugggccugaaaccgccgagugccccaauacaaaccgcgcuuggaacucucucgagguugaagacuacggauuuggcguguucaccacaaacauuuggcugaaacuucgggagaaacaggacgucuuuugugauuccaagcugaugagcgccgcgaucaaagacaauagagccgugcacgcugauaugggcuauuggauugaaucugcccucaacgacaccuggaagauggagaaggcuuccuucaucgagguuaaaagcugccacuggccuaagucucauacgcuguggagcaauggggugcuggaauccgagaugauuauccccaagagcuucgccggaccggucucucagcacaacuaccgcccuggcuauuacacacaaaccgccgggcccuggcaucuuggaaagcucgaaauggauuuugacuucugugagggcaccacagugguugugaccgaagauugcgggaaccggggacccucccugagaacgacaaccgcuagcggcaaacugauuacagaguggugcugucgguccugcacccucccuccgcugcgcuacagaggcgaggacggguguugguauggaauggaaauccggccccuuaaggagaaggaagagaaucuggucaacucucucgugacagcgggccacgggcagaucgauaauuuuagccugggagugcugggcauggcccuuuuccucgaagagaugcugagaacccgcgucgggacgaaacaugcuauucugcucguugccguguccuuuaugacccugaucacaggaaacaugucuuuccgggaccuuggcagagugauggucauggugggcgccaccaugacagaugacauugggaugggaguuaccuaccuggcucuccuggccgcguuuaaggugcgcccuacguucgcugccggccugcuucugagaaaacucacaagcaaggagcugaugauggccaccaucgggauugcucuccugucccagucuacaauccccgaaaccauccuugagcugaccgaugcccucgcgcugggaaugaugguccugaaaauugugcggaauauggaaaaguaucaacuugcuguuacaaucauggccauuagcugcgugccuaacgccgucauccugcagaaugcuuggaagguguccuguacgauucucgccgcuguuagcgugucuccccugcuccugaccuccagccagcagaaagccgacuggaucccucuugcgcugacaaucaagggccucaaccccaccgccauuuuucugacaacccugucucgcacguccaaaaagagaagcuggccgcuuaaugaggcuaucauggccgucgggauggugucuauucuggcuuccagccuccugaaaaacgacaucccuaugacaggaccccucguggccggcggccugcuuaccgucugcuacguucugaccgggcgguccgccgaucuggaacucgagcgcgcuacagacgugaagugggaggaucaagcggaaauuagcggaucuagcccuauccuguccauuaccaucucugaggacggcagcauguccaucaaaaaugaagaggaggaacagacacuuacgauucugaucagaaccgggcuccuggugauuucuggacucuuccccgucagcaucccgauuacagccgcugccugguaucugugggaggugaagaagcagcgggccggcguucuuugggaugugccuucucccccucccgucgggaaagcugaacuggaggacggagccuaccgcaucaagcagaaaggcauccugggcuauagccaaauuggggcgggaguguacaaggaaggcaccuuucacacaauguggcacguuaccagaggggcugugcucaugcaucggggaaaacgcaucgagcccagcugggccgaugucaagaaggaccugauuuccuacggcgggggauggaaacuugagggcgaauggaaggagggcgaagaggugcagguccuggcccucgaaccugggaaaaacccgagagcugugcagacgaagcccggacuguucaaaaccaauacaggcaccaucggggccguuagccucgauuuuucuccuggaacauccggcagccccauuguggaccggaaggggaaggucgugggacuguauggcaacggcguugugaccagaucuggggcguacgucuccgcuaucgcccagacagagaaaagcaucgaggauaauccugaaauugaggacgauaucuuccgcaagaaacggcuuacgauuauggaccugcaccccggagccggcaagaccaaaagauaucugccugcuaucgugcgcgaagccauuaagcgggggcucagaacacugauccuugcuccgacccgcgugguugccgcggagauggaagaggcccugcggggacuccccauuagauaccaaaccccugcuauccgcgccgagcauacaggccgggaaaucgucgaccugaugugucacgcuacguucaccaugagacuccugucccccgugcgggugccuaacuauaaccuuauuaucauggaugaggcccauuuuacagaccccgccucuauugcugcgcgcggguacaucagcaccagagucgaaaugggcgaggccgcuggaauuuucaugacagccaccccgccuggcucccgggaucccuuuccccagagcaaugccccuaucaucgacgaggaacgcgagauucccgaaagaucuuggaacuccgggcacgagugggugacggauuucaagggaaaaacaguuugguuugugccuagcaucaaggcuggcaaugacauugccgcgugccugcggaaaaacgggaagaaagucauccagcugucuagaaagaccuucgauagcgaauaugugaagacccgcacaaaugacugggauuuuguugugaccacagacauuuccgagaugggagcuaacuucaaagccgagcgggucaucgauccgagacgcuguaugaagcccgugauccucaccgacggcgaagaacggguuauucuggccgggccuaugcccgugacgcacucuagcgcugcccaaagacgcggccggaucggaagaaauccuaaaaacgaaaaugaccaguacauuuacaugggcgagccccuugaaaacgaugaggacugcgcgcauuggaaggaggccaaaaugcugcucgauaauaucaacacaccggaagggauuaucccuuccauguuugagcccgaacgcgagaaggucgacgcuauugauggagaauauagacugcggggcgaggcccgcaaaaccuucguggaccugaugagaagaggggaucucccuguguggcuugcuuaccgcgucgccgcugagggaaucaauuaugccgacagacggugguguuuugauggcguuaagaacaaucagauccuggaagagaacguggaaguggagauuuggacaaaggagggggaacgcaagaagcugaaaccccgcuggcucgacgcgcggaucuacucugauccucuggcccuuaaggaguucaaagaguucgcugccggcagaaagagccugacccucaaccugauuacggagaugggacgccugcccaccuuuaugacacagaaggcucgggacgcccucgauaaucuugccguccugcacaccgcugaagcgggcgggagagccuauaaccaugcucuguccgagcucccggagacacuggaaacccuucugcuccugacacugcucgccaccgugacgggaggcaucuuccuuuuucugaugagcgggaaaggaguuggcaagaugacacugggcaugugcugcauuaucaccgccucuauccuccugugguacgcucaaauucagccucacuggaucgccgcguccauuauccuugaguucuuucugauugugcuccugauccccgaacccgagaaacagcggaccccucaggacaaucaacugacauaugucgugaucgccauucucaccguuguggcugccacaauggcuaacgaaaugggguuccuugagaagacgaaaaaggaccugggacugggcagcaucgccacccaggagccggaauccaauauucucgauaucgaccugcgccccgcgucugccuggacacuuuacgcugucgccaccacauuugugaccccuaugcugagacacagcauugagaacuccucugucaaugugagccucacggcuaucgccaaccaggcuaccguucugauggggcugggaaagggcuggccccucuccaaaauggauauuggggugccucuucuggccaucggauguuacagccaggugaaucccaucacacugaccgcggcccuccugcuucugauugcucauuaugccaucauuggcccuggccuccaagcuaaggccacacgggaagcccagaaacgcgcggcugccgggaucaugaagaacccgaccgucgacggaauuacgguuaucgaucuggaccccaucccuuacgaucccaaauucgagaagcagcugggccaggugaugcuccuuauucugugcgugacacaaguccugaugaugagaaccacaugggcucucugugaagcccugacccuugccaccgggccuaucucuacacugugggagggaaaucccggccgguuuuggaacacgaccauugcuguguccauggccaauaucuuccgcgggagcuaucucgcgggagccggccugcuguuuucuauuaugaagaacacaaccaauacaagacggggcaccgggaacaucggagagacgcucggcgaaaaauggaagucccgccuuaaugcucuggggaaaagcgaguuccagaucuacaagaaaucuggcauucaggaaguugacagaacacuggccaaggagggcaucaaaagaggggaaaccgaucaccaugcugugagcagaggauccgccaagcuccgcugguuugucgaacggaacauggugaccccggagggcaaggucguggaccugggcugcgggagaggaggcuggucuuauuacugugggggacuuaaaaacguucgcgaagugaagggccugacaaaagggggaccuggccacgaggaacccauucccaugagcaccuauggcuggaaucucguccggcugcaauccgggguggauguuuucuucacaccucccgagaagugcgacacgcugcucugugauaucggagagagcuccccuaacccgaccauugaagcgggcagaacacuucgcgugcugucucuggucgagaauuggcucaacaaugacacccaguuuugcaucaaagugcugaaccccuacaugccuagcgugaucgaaaagauggagacacuucagcggaaguacgggggagcccugguuagaaauccccucucccgcaacucuacccaugaaauguauugggucagcaaugcuacgggcaacauuguguccucugugaauaugaucagccggaugcugauuaacagauucaccaugaaacacaagaaagccacauacgagccugacgucgaucugggguccggaacccgcaauaucggcauugagagcgaaauccccaaccucgacauuaucggcaagcggaucgagaaaauuaagcaggaacacgagacaucuuggcauuaugaucaagaccacccguacaagaccugggcuuaucauggguccuacgaaacaaaacagaccggaagcgccucuuccaugguuaauggcguggugagacuucugacgaagccuugggaugucgugcccaugguuacacagauggcuaugaccgacaccacaccuuuugggcagcaacgcguguucaaagagaaggucgauacgagaacccaggagcccaaagaaggaacaaagaagcugaugaaaaucaccgccgaguggcucuggaaggaacugggcaaaaagaaaacaccucggauguguacccgcgaggaguuuacaagaaaggugcggagcaacgcggcccuuggggcuauuuucaccgacgaaaacaaauggaagucugccagagaggcuguugaagauucccgguuuugggagcugguggacaaggaacgcaaucuccaccuggagggaaaaugcgagacgugugucuauaacaugaugggcaagagagagaagaagcugggcgaguucgggaaagccaagggaagccgggccaucugguacauguggcucggcgcgcgcuuucuggaguucgaggcucuuggguuucugaaugaagaucacugguucuccagagagaacagccucucuggaguggagggcgaagggcugcauaaacuuggcuacauucugcgggacgugagcaaaaaggagggaggcgccauguaugccgacgauaccgcugggugggacacacgcaucacccucgaagaucugaaaaaugaggaaauggucacaaaccacauggagggagagcauaagagacuggccgaagcuaucuuuaaacucaccuaccagaauaagguugugcgggugcagcgccccacgccgagaggcacagucauggacauuaucucccggcgcgaucaaagagggucuggacaggugggcaccuaugggcugaacacauucaccaauauggaggcccagcuuauucggcaaauggaaggcgagggaaucuucaagagcauucagcaccugacgguuaccgaggaaaucgcggugcagaacuggcucgcccgcgucggcagagagcggcuguccagaauggcuaucucuggggacgauugcgugguuaaaccucuugacgaucgcuuugccagcgcucugacagcccucaaugacaugggaaaggugcggaaagauauucagcaaugggaacccuccaagggcuggaacgacuggacccagguccccuucugcucucaucacuuucacgagcugaucaugaaagaugggagagugcugguugugccuugucgcaaucaggacgaacucauuggacgggcgagaaucagccagggcgccggguggucccugaaggagacagcuugccuuggcaagagcuacgcccaaauguggucucugauguauuuccaucgccgggaccucagacuggcugccaacgcuauuuguuccgccgucccgagccacugggugcccaccucucgcacaaccugguccauccaugcgaaacacgaguggaugacgacagaagauaugcuuaccgucuggaaucggguguggauucaggagaacccuuggauggaagacaagacccccguugagagcugggaagaggugccuuaccugggaaaaagagaggaucaguggugcggcucccucaucgggcugacaucucgcgccaccugggcuaagaacauccagacagccauuaaucaaguccggagccugaucggaaacgaagaguauacggacuacaugcccuccaugaaaagauuucggagagaagaggaagaggccggcgugcucugguga

SEQ ID NO: 20098 - RNA, 9876 nt, Artificial Sequence
  derived and/or modified CDS sequence (opt5) from DENV-2__EU482649__SS-prME
agcgccggcaugaucauuaugcugauccccaccgugauggcuuuccaccugaccacgcggaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaaugaacccgaggauaucgacuguuggugcaauucuaccuccacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuauugccccuuccaugacgaugagaugcaucggcaucucuaaccgggauuuuguggaaggggucagcggaggcuccuggguggacauuguucucgagcacgggagcugugugaccacaauggcgaagaauaagcccacccuggauuucgaacuuaucaaaacagaggccaagcagccugcuacccugcgcaaauauugcauugaagccaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaaucgugaccugcgcuauguuuacaugcaagaaaaacauggaaggcaagauuguccagccugagaaucucgaauacacgaucguugugacaccccacucuggggaggagcaugccgugggaaacgacacaggcaaacacggcaaggaaaucaaagucaccccucaguccagcauuacagaggcggaacugaccggguauggaacggugaccauggaguguucucccagaacaggccuugauuucaaugaaaugguucugcuccaaauggagaacaaggccuggcuggugcaccggcagugguuucuugaccugccgcucccuuggcugcccggggcugauaagcaggaguccaauuggauccagaaagaaacccuggucacauucaagaacccucaugccaaaaagcaagacgugguugugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugaaagagaucgcugagacccagcacggaaccauugucauccgggugcaguaugaaggcgaugggagccccugcaagauccccuucgagauuauggaccucgagaagcgguacguucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggagucuucaccacaaacaucuggcugaaacuuaaagaaaagcaggacgcuuuuugugacuccaagcugaugagcgccgcuaucaaagauaaucgcgccgugcaugcggacaugggcuauuggauugagucugcccucaacgauaccuggaagaucgagaaggcuuccuucauugaaguuaagaauugccacuggccuaaaagccauacacuguggucuaacggcgugcuggagagcgaaaugaucauucccaagaaccuugccgggccggucucccaacacaauuaccggccuggauaccacacccagaucgcuggccccuggcaucucgggaagcuggagauggacuucgauuuuugugacggaacgacagugauugugaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauccgcccccugaaggagaaagaagagaaucucgucaacagccugguuaccgccggacacggccagguggauaauuucucccugggggugcuuggaauggcucucuuucuggaagagaugcugagaacacgggucggcaccaagcaugcgauucuccugguggccguuucuuucgugacacuuaucaccgggaacaugagcuuuaaagaccugggaagagucgugguuauggugggcgcuacgauggccgaugacauuggcaugggggucuccuaucucgcccugcuggcugccuucaaggugcgcccuaccuuugcggcuggacuucugcuccggaagcugacaucuaaagagcucaugaugaccacaaucggcauuguucugcuuagccaauccaccauccccgaaacggugcuggagcucacagaugcccuggcccuggggaugaugguccuuaagaucgugagaaauauggaaaaauaccagcuggcugugaccauuauggccauccucugcgucccuaacgcgguugugcugcagaaugcuuggaaggugucuuguacaauucucgccgucgugagcguuagcccccugcuucugaccagcucucagcagaagaccgacuggaucccucucgcccugacaauuaagggacugaaccccacggcuaucuuccuuaccacacugucccgcaccaauaaaaagagaagcuggccgcucaacgaggccaucauggcugugggcauggucucuauucuggccuccagccuccugaagaaugacaucccuaugacagggccccuuguggcgggaggccugcugaccguuugcuaugugcucacgggccggucugccgaucuggaacuugagcgcgcuacagacgucaaaugggaggaucaggccgaaauuuccgggagcuccccuauccugagcauuaccaucucugaggacggaagcauguccauuaagaacgaagaggaggaacagacccucacaauccugaucagaaccggccuccuggugauuucugggcuuuuucccaucagcauuccgaucacagcugccgccugguaccugugggaggucaaaaagcagcgggcuggagugcugugggauguuccuucucccccucccaugggcaaagcggaacucgaggacggggccuaucgcauuaagcaaaagggaauccugggcuacagccagaucggcgcugggguguacaaagaaggaacguuccacaccauguggcaugucacaagaggcgccgugcuuaugcacaaggggaaacggauugagcccagcugggccgauguuaagaaagaccugaucuccuauggaggcggguggaagcucgagggagaauggaaggagggcgaagaggugcagguccuggcucucgaaccuggcaaaaauccgcgcgccgugcagaccaagcccgggcuguuuaaaacaaacaccggaacgauuggcgcggugucucuugauuucagcccugggaccuccggaagccccaucauugacaagaaaggcaagguugucgggcuguacggaaacggcguggugacaagaucuggcgcuuaugucuccgccaucgcccaaaccgaaaaguccaucgaggauaauccugaaauugaggacgauaucuuucggaaacgcagacugacaauuauggaccuccaccccggggcuggaaagaccaaacgguaccugccugccaucgugagagaagcgauuaagcgcggccuucggacacugauccucgcuccgacgagaguuguggccgccgagauggaagaggcucugcgcgggcuccccauucgguaucagaccccugccaucaaagcugagcauacaggaagagaaaucgucgaccugaugugucacgccaccuucaccaugcgccuucugucucccgugcggguuccuaacuacaaucugauuaucauggaugaggcgcauuucacagaccccgccuccauugcugccagaggcuauaucagcacgcgcguggaaaugggggaggcugccggcauuuuuaugaccgccacaccgccuggaucccgggaucccuucccccagucuaacgcuccuaucaucgacgaggaaagagagauucccgaacggagcuggaacuccggccacgagugggucaccgauuuuaaggggaagacagugugguucguuccuagcaucaaagcgggaaacgacauugccgcuugccuccgcaagaauggcaaaaaggugauccaacugucuagaaaaaccuuugauuccgaauacgucaagacgcggacaaacgacugggauuucguggugaccaccgacauuagcgagaugggggccaauuuuaaagccgagcgcgucaucgauccgagacgguguaugaagcccguuauccuuacagacggagaagagagagugauucuggcuggcccuaugcccgugacccauucuagcgccgcgcagcgccgggggagaaucggccgcaacccuaagaaugaaaacgaccaguacauuuauaugggagagccccucgaaaaugaugaggacugcgcucacuggaaagaggccaagaugcugcuggauaacaucaauacaccggaaggcauuaucccuuccauguucgagcccgaacgggagaaagucgacgccauugauggggaauacagacuccgcggagaggcucggaagaccuuuguggaccuuaugagacgcggcgaucugccuguuuggcuggccuauaaaguggcggccgaggggaucaacuacgcugacagacggugguguuucgauggaaucaagaacaaucagauucucgaagagaacgucgaaguggagaucuggacgaaggagggcgaacgcaaaaagcugaaacccagauggcuugacgcccggauuuauucugauccucuggcucucaaggaguuuaaagaguucgccgcugggcgcaagagccugacacugaaucucaucaccgagaugggcagacuucccacauucaugacccaaaagacgcgggacgcccuggauaaccuggcgguucuccacaccgccgaagcuggaggcagagccuacaaucaugcucuguccgagcuuccggagacacuggaaacccuccugcugcucacacuucuggccaccgugacagggggaauuuuucuguuccucaugucuggccgcgggaucggaaaaaugacccugggcaugugcugcaucauuacggccagcauccuucugugguaugcucagauucagccucacuggaucgcggccuccauuauccucgaguuuuuccugaucguccugcucauucccgaacccgagaagcagcggacaccucaagacaaccagcuuaccuacguggucaucgcuauucugaccgugguugccgccacaauggcuaaugaaaugggcuuucuggagaaaaccaagaaagaccucgggcugggaagcaucgccacacagcagccggagucuaacauucuugauaucgaccugagacccgcguccgccuggacgcucuacgcuguggccaccacauucgugaccccuaugcugcgccauagcauugaaaauuccucugucaacguuagccugacagcuaucgccaaucaagcgaccgugcucaugggccuugggaagggauggccccuguccaagauggauaucggcgugccucugcucgccauuggguguuauucucaggucaaccccaucacgcugaccgcugcccuucugcuccugguggcucacuacgccauuaucggaccuggccugcaggcuaaagccacacgggaggcgcagaagagagccgcugccggcauuaugaaaaauccgaccguugacgggaucacagugaucgaucucgaccccauuccuuaugaucccaaguuugaaaaacaacuuggacaggucaugcugcugauccucugcgugacccagguccugaugaugcggacgacaugggcucuuugugaggcccugacccucgccacaggcccuauuagcacccugugggaagggaaccccggacgcuucuggaauaccacaaucgcgguguccauggcuaacauuuuuagaggcagcuaccuggccggggcuggacuccuuuucucuaucaugaagaauacgaccaacacacggcgcggcaccggcaacaucggggagacacugggagagaaauggaaguccagacugaaugcccucggcaagagcgaauuucaaauuuauaaaaagucugggauccaggagguugaccggacccuggccaaagaaggaauuaagcgcggcgagacggaucaccaugcuguguccagagggagcgccaaacuucggugguucgucgagcgcaacauggugacaccggaaggaaagguuguggaccugggcugcggcagagggggauggucuuacuauuguggcgggcucaagaauguccgggaggugaaaggacugaccaagggcgggccuggacacgaagaacccauccccaugagcaccuacggcuggaaccuggugagacuccaguccggcguugaugucuuuuucauuccucccgaaaaaugcgacacacuucugugugauaucggggagucuagcccuaauccgaccguggaggcgggacgcacacugcgggugcucaaccuggucgaaaauuggcuuaacaauaacacgcaguucugcaucaagguucugaaucccuacaugccuuccgugauugagaaaauggaagcccuccaaagaaaguauggcggggcucuggugcgcaacccccugagcagaaauuccacccaugagauguacugggucucuaacgccagcggaaauaucguguccucuguuaacaugauuagcagaaugcucaucaaccgcuuuacaaugcggcacaagaaagcuaccuaugaaccugacguggaccuuggcuccgggacaagaaauauuggaaucgagucugagauucccaaccuggauaucaucggcaagcgcauugagaaaaucaagcaggagcaugaaaccagcuggcacuacgaccaggaucacccguauaaaacgugggccuaccauggcuccuaugagaccaagcagacagggagcgcgucuuccauggucaauggagugguucggcugcucaccaagccuugggacgugcugcccacagucacccaaauggccaugacagauaccacgccuuucggccagcagagaguguuuaaagaaaagguggacacacgcacccaggagcccaaagaggggaccaagaaacuuaugaagauuacagcugaauggcuguggaaagagcucggaaagaagaaaacgccucggauguguaccagagaagaguucacacgcaaggucagaagcaacgccgcucugggcgccaucuuuaccgaugagaauaaauggaagucugcucgggaagccguugaggacucccgcuucugggaacugguggauaaagagagaaaccuccaccuggaagggaagugcgagacauguguguacaauaugaugggaaagcgggagaagaaacuuggcgaauuuggcaaagcgaaagggagcagagccauuugguacauguggcugggagcucgguuccucgaguuugaagcccugggcuuccuuaacgaggaccauugguuuucucgcgaaaauucccugagcggggucgagggagagggccuccacaaacugggguauauccugagagauguguccaagaaggaaggcggagcuauguacgccgacgacaccgccggcugggauacacggaucacccucgaggaccugaaaaacgaagagaugguuacgaaucacauggaaggggagcauaagaaacuugcggaggcuauuuucaagcugaccuaucaaaacaaagugguccgcgugcagagacccacaccgcggggaaccguuauggauaucauuagccgcagagaccagcggggcucugggcaagugggaacauacggccucaauaccuuuacgaacauggaagcccagcugauccgccagauggagggggaaggcgucuucaagaauauucagaaccuuacagugaccgaggagguugccgugcaaaacuggcuggcuagagucggacgggaacgccucagcagaauggccaucuccggcgaugacugcguggucaagccucuggaugaccgguucgcuaaugcccugacagcgcucaacgauauggggaaaauccgcaaggacauucagcagugggagcccucuaaaggauggaaugauuggacccaggugcccuuuugcagccaccauuuccacgaacugaucaugaaggacggcagaguucuuguggucccuugucggaaccaagaugagcugauugggagagcccgcaucucccagggagcuggcuggucucuccgggaaacggccugccuggggaaaagcuaugcucagauguggucccuuauguacuuucauagacgcgaccugcggcucgccgcgaaugccauuuguucugcugugccgagccacugggugcccaccuccagaacaaccuggagcauccacgccaagcaugaguggaugacaaccgaggacaugcugacaguuuggaaccgcguguggauucgggaaaauccuuggauggaggauaagacccccgucgaaucuugggaggaaaucccuuaucugggcaaaagagaggaccaguggugcggaucccucaucggccugacgagccgcgcuacaugggccaagaacauucaagcugccaucaaucaggugcggucucuuauugggaacgaggaauacaccgauuacaugcccuccaugaaaagauuccgccgggaggaagaggaagcgggaguucugugguga

SEQ ID NO: 20099 - RNA, 9876 nt, Artificial Sequence
  derived and/or modified CDS sequence (opt5) from DENV-2__EU482650__SS-prME
agcgccggaaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaacugaccauuaugacaggagauaucaagggcauuaugcaggcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaagacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccaaguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucagagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccaacagaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacaacgggcuggagugcugugggauguuccuucucccccucccaugggcaaggcggaacucgaggacggggccuaucgcauuaaacagaagggaauccugggcuacucccagaucggcgcugggguguacaaggaaggaaccuuccacacaauguggcaugucaccagaggcgccgugcuuaugcacaaagggaagcggauugagcccuccugggccgauguuaaaaaggaccugaucagcuauggaggcggguggaaacucgagggagaauggaaggagggcgaagaggugcagguccuggcucucgaaccuggcaagaauccgcgcgccgugcaaacaaaacccgggcuguuuaagaccaacacgggaaccauuggcgcggugucccuugauuucucuccugggacaagcggaucccccaucauugacaaaaagggcaaaguugucgggcuguacggaaacggcguggugaccagaagcggcgcuuaugucucugccaucgcccagacagagaaguccaucgaggauaauccugaaauugaggacgauaucuuucggaagcgcagacugaccauuauggaccuccaccccggggcuggaaaaacaaagcgguaccugccugccaucgugagagaagcgauuaaacgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaauccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccucagaaagaauggcaaaaaggugauccagcugagccggaaaacguuugauucugaauacgucaagacacgcaccaacgacugggauuucguggugaccacagacauuuccgagaugggggccaauuuuaaagccgagagagucaucgauccgcggagauguaugaagcccguuauccuuaccgacggagaggaacgcgugauucuggcuggcccuaugcccgugacacauagcucugccgcgcagcggagagggcgcaucggccggaacccuaaaaaugaaaacgaccaguacauuuauaugggagagccccucgaaaaugaugaggacugcgcucacuggaaggaggccaagaugcugcuggauaacaucaauaccccggaaggcauuaucccuagcauguucgagcccgaaagagagaaagucgacgccauugauggggaauaccgccuccggggagaggcuagaaagacguuuguggaccuuaugcgcagaggcgaucugccuguuuggcuggccuauaaaguggcggccgaggggaucaacuacgcugaccggcgcugguguuucgauggaaucaagaacaaucaaauucucgaagagaacgucgaaguggagaucuggacaaaagagggcgaaagaaagaagcugaaaccccgguggcuugacgcccgcauuuauuccgauccucuggcucucaaggaguuuaaagaguucgccgcugggagaaagucucugacccugaaucucaucacagagaugggccggcuucccaccuucaugacgcagaaaaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaagcaaagaaccccucaggacaaccagcuuaccuacguggucaucgcuauucugacagugguugccgccaccauggcuaaugaaaugggcuuucuggagaaaacaaagaaagaccucgggcugggauccaucgccacgcagcaaccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaggcgacggugcucaugggccuugggaagggauggccccugagcaaaauggauaucggcgugccucugcucgccauuggguguuauucccaggucaaccccaucacccugacagcugcccuucugcuccugguggcucacuacgccauuaucggaccuggccugcaggcuaaggccaccagagaggcgcaaaagcgggccgcugccggcauuaugaaaaauccgacaguugacgggaucaccgugaucgaucucgaccccauuccuuaugaucccaaguuugaaaaacagcuuggacaggucaugcugcugauccucugcgugacgcaaguccugaugaugcgcacaaccugggcucuuugugaggcccugacacucgccaccggcccuauuucuacccugugggaagggaaccccggaaaguucuggaauacaacgaucgcggugagcauggcuaacauuuuuagaggcuccuaccuggccggggcuggacuccuuuucagcaucaugaaaaauaccacaaacacccggcgcggcacaggcaacaugggggagacccugggagagaaguggaaaucuagacugaauacgcucggcaaguccgaauuucagaucuauaagaaaagcgggauucaggagguugaccggacacuggccaaggaaggaaucaaacgcggcgagaccgaucaccaugccgugucuagaggguccgcuaaacuucggugguucgucgagcgcaacauggugaccccggaaggaaaaguuguggaccugggcugcggcagagggggauggagcuacuauuguggcgggcucaagaauguccgggaggugaagggacugacaaaaggcgggccuggacacgaggaacccauucccaugucuaccuacggcuggaaccuggugagacuccagagcggcguugaugucuuuuucaucccucccgaaaagugcgacacacuucugugugauauuggggaguccucuccuaauccgacgguggaggccggacgcacccugcgggugcucaaccuggucgaaaauuggcuuaacaauaacacacaauucugcaucaaaguucugaaucccuacaugccuagcgugaucgagaagauggaagcgcuccagagaaaauauggcggggcccuggugcgcaacccccugucccggaauagcacccaugagauguacugggucuccaacgcuucuggaaauauugugagcuccguuaacaugaucucuagaaugcucauuaaccgcuuuacaaugcggcacaagaaggccaccuaugaaccugacguggaccuuggcagcgggacgagaaauaucggaauugaguccgagauccccaaccuggauauuaucggcaaacgcaucgaaaagauuaaacaggagcaugaaaccucuuggcacuacgaccaggaucacccguauaagacaugggcuuaccauggcagcuaugagaccaaacaaacaggguccgccagcucuauggucaauggagugguucggcugcucaccaagccuugggacgugcugcccacagucacccagauggcgaugacggauacaaccccuuucggccagcagagaguguuuaaggaaaaaguggacacccgcacacaagagcccaaggaggggacgaagaaacuuaugaaaaucaccgccgaauggcuguggaaagagcucggcaagaagaagacaccucggauguguaccagagaagaguucacacgcaaagucagauccaacgcugcccugggcgcuauuuuuaccgaugagaauaaguggaaaagcgcccgggaagcuguugaggacucucgcuucugggaacugguggauaaggagagaaaccuccaccuggaagggaaaugcgagacauguguguacaauaugaugggaaagcgggagaagaaacuuggcgaauuuggcaaggccaaaggguccagagcgaucugguacauguggcugggagcccgguuccucgaguuugaagcucugggcuuccuuaacgaggaccauugguuuagccgcgaaaauucucuguccggggucgagggagagggccuccacaagcugggguauauucugagagaugugagcaaaaaggaaggcggagccauguacgcugacgacaccgccggcugggauacgcggaucacccucgaggaccugaagaacgaagagaugguuacaaaucacauggaaggggagcauaagaaacuugccgaggcgaucuucaaacugaccuaucagaacaaagugguccgcgugcagagacccacaccgcggggaaccguuauggauauuaucucccgcagagaccaacggggcagcgggcaggucggaacguacggccucaauacauuuaccaacauggaagcucagcugauucgccagauggagggggaaggcgucuucaaaaauauccaacaccuuacagugaccgaggagguugccgugcagaacuggcuggccagagucggacgggaacgccucucuagaauggcuauuagcggcgaugacugcguggucaagccucuggaugaccgguucgccaacgcucugacggcccucaaugauauggggaagauccgcaaagacauccagcagugggagcccuccaagggauggaacgauuggacccaagugcccuuuugcucucaucacuuccaugaacugauuaugaaagacggcagaguucuuguggucccuugucggaaucaggaugagcugaucgggagagcgcgcauuagccagggagccggcuggucccuccgggaaacagcuugccuggggaagucuuaugcccagauguggagccuuauguacuuucacagacgcgaccugcggcucgcugccaacgcgaucuguuccgccgugccgucucacugggugcccaccagcagaacaaccugguccauucaugcuaaacacgaguggaugacaaccgaggacaugcugacgguuuggaaucgcguguggauccgggaaaacccuuggauggaggauaagacacccgucgaaagcugggaggaaauuccuuaucugggcaagagagaggaccaauggugcggaucucucaucggccugaccucccgcgccaccugggcuaaaaauauccaggccgcuauuaaccaggugcggagccuuaucgggaaugaggaauacacagauuacaugcccucuaugaagagauuccgccgggaggaagaggaagccggaguucugugguga

SEQ ID NO: 20100 - RNA, 9876 nt, Artificial Sequence
  derived and/or modified CDS sequence (opt5) from DENV-2__EU482651__SS-prME
agcgccggaaugaucauuaugcugauccccaccgucauggcuuuccaccugaccacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugcgccuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuacagaccuggauaccacacccagauuacgggccccuggcaucucgggaagcuggagauggacuucgauuuuugugacggaacaaccgugaucgucaccgaagauugcggcaaccgcgggcccagccugcggacaaccacggcuucuggaaagcucauuacagaguggugcuguagauccugcacccugccuccgcuucgguaucgcggcgaggacggcuguugguacgggauggaaaucagaccccugaaagagaaggaagagaaucucguuaacagccuggugacagccggacacggccagguggauaauuucucccuggggguccuuggaauggcccucuuucuggaagagaugcugcggaccagagugggcacaaaacaugcuauccuccugguuaccgugucuuucgucacgcuuauuaccgggaacaugagcuuuaaggaccugggacgcgugguugugauggucggcgcgacaauggccgaugacaucggcaugggggugaccuaucucgcucugcuggccgccuucaaaguucggccuacauuugcugccggacuucugcucagaaagcugaccuccaaggagcucaugaugacgacaauuggcaucgugcugcuuucucaaagcaccauucccgaaacaguccuggagcucaccgaugcgcuggcucuggggaugauggugcuuaaaaucgugcgcaauauggaaaaguaccagcuggccgucaccaucauggccauucucugcguuccuaacgcuguggugcugcagaaugccuggaaagucuccuguacaauccucgcggugguuucugugagcccccugcuucugacguccagccagcaaaagaccgacuggauuccucucgcucugacaaucaaaggacugaaccccaccgccauuuuccuuacaacccugucuagaacgaauaagaaacgguccuggccgcucaacgaggccaucauggcugucggcauggugagcauccuggccucuucccuccugaagaaugacauuccuaugacagggccccuuguugcuggaggccugcugaccgugugcuauguccucaccggccgcagcgccgaucuggaacuugagagagcgacagacgugaagugggaggaucaggccgaaaucucuggguccagcccuauucuguccaucaccauuagcgaggacggaucuaugagcaucaaaaacgaagaggaggaacagacacucacgauucugauccggaccggccuccuggucaucuccgggcuuuuucccauuucuaucccgauuacagcugccgcuugguaccugugggaggugaagaaacagcgcgccggaguucugugggaugugccuucucccccucccaugggcaaggccgaacucgaggacggggcuuauagaaucaaacaaaaggggauucugggcuacucccagaucggcgcgggggucuacaaggaaggaaccuuccacacaauguggcaugugacccggggcgccguucuuaugcacaaagggaagcgcaucgagcccuccugggcugaugugaaaaaggaccugauuagcuauggaggcggguggaaacucgagggagaauggaaggagggcgaagagguccaggugcuggcccucgaaccuggcaagaauccgagagccgugcagacgaaacccgggcuguuuaagaccaacacaggaaccaucggcgcuguuucccuugauuucucuccugggacaagcggaucccccauuaucgacaaaaagggcaaagucguggggcuguacggaaacggcguggucacccggagcggcgccuaugugucugcgauugcucaaacagagaaguccaucgaggauaauccugaaaucgaggacgauauuuuucgcaagagacggcugacgaucauggaccuccaccccggggccggaaaaaccaagagauaccugccugccauuguucgcgaagcuaucaaacggggccuuagaacacugauucucgccccgacccgcguggucgcggcugagauggaagaggcccugcgggggcuccccaucagauaucagaccccugccauuaaggcugagcauacaggacgcgaaaucguggaccugaugugucacgccacguucaccaugcggcuucugagccccguuagagugccuaacuacaaucugaucauuauggaugaggcucauuucacagaccccgccucuaucgcggcccgcggcuauauuuccacccgggucgaaaugggggaggcugccggcaucuuuaugacagcuaccccgccuggaagcagagaucccuucccccaguccaacgccccuauuaucgacgaggaacgggagauccccgaacgcucuuggaauagcggccacgagugggugacggauuuuaaagggaagacaguuugguucgugccuuccauuaaggccggaaacgacaucgcugcgugccuccgcaaaaauggcaagaaagucauucaacugagccggaagaccuuugauucugaauacgugaaaacccgcacaaacgacugggauuucguggucaccacagacaucuccgagaugggggccaauuuuaaggcugagagaguuauugauccgcggagauguaugaaacccgugauccuuaccgacggagaggaacgcgugauccuggccggcccuaugcccgucacgcauagcucugccgcucagcggagagggcgcauuggccggaacccuaagaaugaaaacgaccaguacaucuauaugggagagccccucgaaaaugaugaggacugcgcccacuggaaggaggcgaaaaugcugcuggauaacauuaauacaccggaaggcaucauuccuagcauguucgagcccgaaagagagaagguggacgcuaucgauggggaauaccgccuccggggagaggccagaaaaaccuuuguugaccuuaugcgcagaggcgaucugccuguguggcuggccuauaaggucgcugccgaggggauuaacuacgcggaccggcgcugguguuucgauggaaucaaaaacaaucagauccucgaagagaacguggaaguugagauuuggacaaaggagggcgaaagaaagaaacugaagccccgguggcuugacgcccgcaucuauuccgauccucuggcucucaaagaguuuaaggaguucgccgcugggagaaaaucucugacccugaaucucauuacggagaugggccggcuucccaccuucaugacacaaaagaccagagacgcccuggauaaccuggcugugcuccacacagccgaagcgggaggccgcgccuacaaucaugcucugagcgagcuuccggagacccuggaaacacuccugcugcucacccuucuggccacggucacagggggaaucuuucuguuccucauguccggccgggggauuggaaagaugacccugggcaugugcugcaucaucaccgcuucuauucuucugugguaugcccagauccagccucacuggauugccgcuagcaucauucucgaguuuuuccugaucgugcugcucauccccgaacccgagaaacagagaacaccucaagacaaccagcuuaccuacgucgugauugcgauccugacaguuguggccgcuacgauggccaaugaaaugggcuuucuggagaagaccaaaaaggaccucgggcugggauccauugccacacagcagccggagagcaacauccuugauauugaccugcgccccgcuucugccuggacccucuacgcgguggccacaaccuucgucacgccuaugcugcggcauuccaucgaaaauagcuccguuaacgugucucugaccgcuauugccaaucaagcuacagugcucaugggccuugggaaaggauggccccugagcaagauggauaucggcgucccucugcucgccaucggguguuauucccaggugaaccccauuacccugacagcggcccuucugcuccugguugcucacuacgccaucauuggaccuggccugcaggcuaaggccaccagagaggcucagaaacgggccgcggccggcaucaugaagaauccgacgguggacgggauuacagucaucgaucucgaccccaucccuuaugaucccaaauuugaaaagcaacuuggacaggugaugcugcugauucucugcgucacccaggugcugaugaugcgcacaaccugggcucuuugugaggcccugacccucgcuacaggcccuaucucuacgcugugggaagggaaccccggaagauucuggaauaccacaauugccguuagcauggccaacaucuuucggggcuccuaccuggcgggggcuggacuccuuuucagcauuaugaaaaauaccacaaacacccgcagaggcacgggcaacaucggggagacacugggagagaaguggaaaucucggcugaaugcccucggcaaguccgaauuucaaaucuauaagaaaagcgggauucaggagguggaccgcacccuggcuaaggaaggaaucaaaagaggcgagaccgaucaccaugccgucucucggggguccgccaaacuucgcugguucguggagagaaacaugguuacaccggaaggaaaaguggucgaccugggcugcggccggggaggauggagcuacuauuguggcgggcucaagaaugugagagaggugaagggacugaccaaaggcgggccuggacacgaagaacccauucccaugucuacauacggcuggaaccugguucgccuccagagcggcgucgauguguuuuucaucccucccgaaaagugcgacacgcuucugugugauauuggggaguccucuccuaauccgaccguggaggcuggacggacacugagaguccucaaccugguugaaaauuggcuuaacaauaacacccaguucugcaucaaagugcugaaucccuacaugccuagcgugaucgagaagauggaagcccuccaacgcaaauauggcggggcgcugguccggaacccccuguccagaaauagcacacaugagauguacuggguguccaacgccucuggaaauauuguuagcuccgugaacaugaucucucgcaugcucauuaaccgguuuaccaugagacacaagaaggcuacguaugaaccugacgucgaccuuggcagcgggacccgcaauaucggaauugaguccgagauccccaaccuggauauuaucggcaaacggaucgaaaagauuaaacaggagcaugaaacaucuuggcacuacgaccaggaucacccguauaagaccugggccuaccauggcagcuaugagacaaaacagaccggguccgcuagcucuauggugaauggaguugugagacugcucacaaagccuugggacguccugcccaccgugacgcaaauggccaugacagauaccaccccuuucggccagcagcgcguguuuaaggaaaaagucgacacacggacgcaggagcccaaggaggggaccaagaaacuuaugaaaaucacagcggaauggcuguggaaagagcucggcaagaagaagaccccuagaauguguacacgcgaagaguucaccagaaaaguucgguccaacgccgcucugggcgccauuuuuacagaugagaauaaguggaaaagcgcucgcgaagccguggaggacucuagauucugggaacugguggauaaggagcggaaccuccaccuggaagggaaaugcgagaccugugucuacaauaugaugggaaagagagagaagaaacuuggcgaauuuggcaaggcuaaagggucccgggccaucugguacauguggcugggagcgcgcuuccucgaguuugaagcccugggcuuccuuaacgaggaccauugguuuagcagagaaaauucucuguccgggguggagggagagggccuccacaagcugggguauauucugcgggauguuagcaaaaaggaaggcggagcuauguacgccgacgacacggcuggcugggauacccgcaucacacucgaggaccugaagaacgaagagauggugaccaaucacauggaaggggagcauaagaaacuugccgaggccaucuucaaacugacauaucaaaacaaagucgugagaguucagcggcccaccccgcgcggaacggugauggauauuaucuccagacgggaccagcgcggcagcgggcaagucggaacauacggccucaauaccuuuacaaacauggaagcgcagcugauuagacagauggagggggaaggcguguucaaaaauauccagcaccuuaccguuacggaggagguggcuguccaaaacuggcuggcccgggugggacgcgaaagacucucucggauggccauuagcggcgaugacugcgucgugaagccucuggaugaccgcuucgcuaacgcccugaccgcucucaaugauauggggaagaucagaaaagacauccagcagugggagcccuccaagggauggaacgauuggacacagguucccuuuugcucucaucacuuccaugaacugauuaugaaagacggccgggugcuugucgugccuuguagaaaucaagaugagcugaucgggcgcgcccggauuagccagggagcgggcuggucccucagagaaaccgccugccuggggaagucuuaugcucagauguggagccuuauguacuuucaccgccgggaccugagacucgccgcuaacgccaucuguuccgcggugccgucucacuggguucccacaagccgcaccacaugguccauucaugccaaacacgaguggaugaccacggaggacaugcugacaguguggaaucgggucuggaucagagaaaacccuuggauggaggauaagacccccguggaaagcugggaggaaauuccuuaucugggcaagcgcgaggaccaguggugcggaucucucaucggccugaccucccgggcuacaugggccaaaaauauccaagcugccauuaaccagguuagaagccuuaucgggaaugaggaauacaccgauuacaugcccucuaugaagcgcuuccggagagaggaagaggaagcuggagugcugugguga

SEQ ID NO: 20101 - RNA, 9876 nt, Artificial Sequence
  derived and/or modified CDS sequence (opt5) from DENV-2__EU482652__SS-prME
agcgccggcaugaucauuaugcugauccccaccgugauggcuuuccaccucacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaagacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacucccucuguacagggaaguucaaaguggucaaggagauugcugagacccagcacggaaccaucgugauucggguucaguaugaaggcgaugggagccccugcaaaauccccuucgagaucauggaccuggaaaagagauacgugcugggacgccucauuacagucaacccuaucgugacggagaaagauucuccgguuaacauugaagcggagcccccuuuuggcgacuccuacaucauuaucgggguggagcccggccaacugaaacuuaauugguucaagaaaggaagcucuauuggccagauguuugaaaccacaaugagaggggccaagagaauggcuauccugggagauaccgccugggacuucggcagccucgggggagucuuuacauccaucggcaaagcccugcaucagguguucggggcuauuuauggcgccgcguuuucuggagugagcuggaccaugaagauccugauuggcguuaucauuacguggaucgggaugaacucccgcagcacaucucuuuccgucagccucgugcuggugggaaucgucacccuguaccucggcgugaugguucaggcugauucuggguguguggucuccuggaaaaauaaggagcugaagugcggaagcggcauuuucaucaccgacaacgugcacacauggaccgaacaauauaaauuucagccugagucccccucuaaacuugccagcgccauucagaaagcucaggaagaggggaucuguggcauucgguccguuacaagacuggagaaucucauguggaagcaaaucacgccggaacugaaccacauccuggccgagaaugaagugaaacuuaccauuaugacaggagauaucaagggcauuaugcaggcugggaaacgcucucuccggccucagcccaccgagcugaaguacagcuggaagacauggggaaaagccaagaugcuguccaccgaaagcuauaaccagacguuccucaucgacggcccugagaccgcggagugccccaauacaaacagagccuggaacucucuggaagucgaggauuacggguuuggaguguucaccacaaacauuuggcuuaaacugaaggaaaaacaagacgcuuuuugugacuccaagcucaugagcgccgcuaucaaggauaaucgcgccguucaugcggacaugggcuauuggaucgagucugcccugaacgauaccuggaaaauugagaaggcuuccuucaucgaagugaaaaauugccacuggccuaagagccauacacuguggucuaacggcguccuugagagcgaaaugauuauccccaaaaaccucgccgggccggugucccagcacaauuaccggccuggauaccacacccagauugcuggccccuggcaucuggggaagcuggagauggacuucgauuuuugugacggaacgacagugaucgucaccgaagauugcggcaacagagggcccagccuccgcaccacaaccgccucuggaaagcugauuacggaguggugcugucgguccugcacacuuccuccgcugagauaucggggcgaggacggcuguugguacgggauggaaauccgcccccucaaagagaaggaagagaaucugguuaacagccuggugaccgccggacacggccaaguggauaauuucucccuugggguccucggaauggcucuguuucuggaagagaugcucagaacacgggugggcaccaaacaugcgauccugcuuguugccgugucuuucgucacacugauuaccgggaacaugagcuuuaaggaccucggaagagugguugugauggucggcgcuacgaugaccgaugacaucggcaugggggugacauaucuggcccugcuugccgcuuucaaaguucgcccuaccuuugccgcgggacugcuccugcggaagcucacauccaaggagcugaugaugaccacgauuggcaucgugcuucugucucagagcgcuauucccgaaacaguccucgagcugaccgaugcccuggcccuugggaugauggugcugaaaaucgugagaaauauggaaaaguaccagcucgcugucacaaucauggccauucugugcguuccuaacgcggugauccuccagaaugcuuggaaaguguccuguaccauucuggccgucgugucuguuagcccccuucugcucaccuccagccaacagaagacagacuggaucccucuggcccugacgauuaaaggacuuaaccccaccgcuaucuuccugacaacccucucucgcacaaauaagaaaagauccuggccgcugaacgaggccaucauggcugugggcauggucagcauucucgccucuucccugcuuaagaaugacaucccuaugaccgggccccugguggcgggaggccugcucacgguuugcuaugugcugacaggccggagcgccgaucuugaacuggagcgcgcuaccgacgucaagugggaggaucaggccgaaauuucuggguccagcccuauccucuccauuaccaucagcgaggacggaucuaugagcauuaaaaacgaagaggaggaacagacacugaccauccucaucagaacaggccugcuugugauuuccgggcuguuucccaucucuauuccgaucacggcugccgccugguaccugugggaggucaagaaacaacgggcuggagugcucugggauguuccuucucccccucccaugggcaaggcggaacuggaggacggggccuaucgcauuaaacagaagggaauccuuggcuacucccagaucggcgcugggguguacaaggaaggaaccuuccacacaauguggcaugucaccagaggcgccgugcugaugcacaaagggaagcggauugagcccuccugggccgauguuaaaaaggaccucaucagcuauggaggcggguggaaacuggagggagaauggaaggagggcgaagaggugcagguccucgcucuggaaccuggcaagaauccgcgcgccgugcaaacaaaacccgggcuuuuuaagaccaacacgggaaccauuggcgcggugucccuggauuucucuccugggacaagcggaucccccaucauugacaaaaagggcaaaguugucgggcuguacggaaacggcguggugaccagaagcggcgcuuaugucucugccaucgcccagacagagaaguccaucgaggauaauccugaaauugaggacgauaucuuucggaagcgcagacucaccauuauggaccugcaccccggggcuggaaaaacaaagcgguaccuuccugccaucgugagagaagcgauuaaacgcggccugcggacgcucauccuggcuccgaccagaguuguggccgccgagauggaagaggcucuccgcgggcugcccauucgguaucagaccccugccaucagagcugagcauaccggacgcgaaaucgucgaccuuaugugucacgccaccuucacaaugcggcugcugagccccgugagaguuccuaacuacaaucucauuaucauggaugaggcgcauuucacggaccccgccucuauugcugcccgcggcuauaucuccacccggguggaaaugggggaggcugccggcauuuuuaugacagccaccccgccuggaagcagagaucccuucccccaauccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccugagaaagaauggcaaaaaggugauccagcuuagccggaaaacguuugauucugaauacgucaagacacgcaccaacgacugggauuucguggugaccacagacauuuccgagaugggggccaauuuuaaagccgagagagucaucgauccgcggagauguaugaagcccguuauccugaccgacggagaagaacgcgugauucucgcuggcccuaugcccgugacacauagcucugccgcgcagcggagagggcgcaucggccggaacccuaaaaaugaaaacgaccaguacauuuauaugggagagccccuggaaaaugaugaggacugcgcucacuggaaggaggccaagaugcugcucgauaacaucaauaccccggaaggcauuaucccuagcauguucgagcccgaaagagagaaagucgacgccauugauggggaauaccgccuucggggagaggcuagaaagacguuuguggaccugaugcgcagaggcgaucugccuguuuggcucgccuauaaaguggcggccgaggggaucaacuacgcugaccggcgcugguguuucgauggaaucaagaacaaucaaauucuggaagagaacgucgaaguggagaucuggacaaaagagggcgaaagaaagaaacuuaaaccccgguggcuggacgcccgcauuuauuccgauccucucgcucugaaggaguuuaaagaguucgccgcugggagaaagucucugacccucaaucuuaucacagagaugggccggcugcccaccuucaugacgcagaaaaccagagacgcccuggauaaccucgcgguucugcacacagccgaagcuggaggccgcgccuacaaucaugcucuuagcgagcugccggagacccucgaaacacugcugcuccuuacccugcuggccacagugaccgggggaauuuuucucuuccugauguccggccgggggaucggaaagaugacgcuuggcaugugcugcaucauuacagccucuacccugcucugguaugcucagauccagccucacuggauugcggccagcaucauucuggaguuuuuccugaucguccuccuuauccccgaacccgagaagcaaagaaccccucaggacaaccagcugacauacguggucauugcuauccugaccgugguugccgccacaauggcuaaugaaaugggcuuucucgagaaaacgaagaaagaccuggggcuuggauccauugccacccagcaaccggagagcaacauccuggauauugaccuccgccccgcgucugccuggacacuguacgcuguggccaccacauucgugaccccuaugcugcggcauuccaucgaaaauagcuccgucaacguuucucucacggcuauugccaaucaggcgaccgugcuuaugggccuggggaagggauggccccugagcaaaauggauaucggcgugccucuccuggccaucggguguuauucccaggucaaccccauuacacuuaccgcugcccugcuccugcugguggcucacuacgccaucauuggaccuggccuccaggcuaaggccacaagagaggcgcaaaagcgggccgcugccggcaucaugaaaaauccgaccguugacgggauuacggugaucgaucuugaccccaucccuuaugaucccaaguuugaaaaacagcugggacaggucaugcugcucauucugugcgugacacaaguccuuaugaugcgcaccacaugggcucugugugaggcccucacccuggccaccggcccuaucucuacacugugggaagggaaccccggaagauucuggaauacgaccauugcggugagcauggcuaacaucuuucggggcuccuaccucgccggggcuggacuucuguucagcauuaugaagaauacaaccaacacacgcagaggcaccggcaacaugggggagacgcugggagagaaauggaagucucggcucaaugcccugggcaaauccgaauuucagaucuauaaaaagagcgggauccaggagguugaccgcacacuugccaaagaaggaauuaagagaggcgagaccgaucaccaugcugugucucggggguccgccaaacugcgcugguucgucgagagaaacauggugaccccggaaggaaagguuguggaccucggcugcggcagagggggauggagcuacuauuguggcgggcugaaaaauguccgggaggugaagggacugacaaagggcgggccuggacacgaggaacccauccccaugucuaccuacggcuggaaccucgugcgccuucagagcggcguugaugucuuuuucauuccucccgaaaaaugcgacacacugcugugugauaucggggaguccucuccuaauccgacgguggaggcgggacggacccucagagugcugaaccuugucgaaaauuggcugaacaauaacacacaauucugcauuaagguucucaaucccuacaugccuagcgugaucgagaaaauggaagcccugcagcgcaaguauggcggggcucuggugcggaacccccucuccagaaauagcacccaugagauguacugggucuccaacgccucuggaaauaucgugagcuccguuaacaugauuucucgcaugcuuaucaaccgguuuacaaugagacacaaaaaggcuaccuaugaaccugacguggaccugggcagcgggacgcgcaauauuggaaucgaguccgagauucccaaccuggauaucauuggcaagcggaucgagaagaucaagcaggagcaugaaaccucuuggcacuacgaccaggaucacccguauaaaacaugggccuaccauggcagcuaugagaccaagcaaacaggguccgcgagcucuauggucaauggagugguuagacuccugaccaaaccuugggacgugcuucccacagucacccagauggccaugacggauacaaccccuuucggccagcagcgcguguuuaaggaaaagguggacacccggacacaagagcccaaagaggggacgaagaaacugaugaagauuaccgcugaauggcucuggaaagagcugggaaagaaaaagacaccuagaauguguacccgcgaagaguucacaagaaagguccgguccaacgccgcucugggcgccaucuuuaccgaugagaauaaauggaaaagcgcucgcgaagccguugaggacucuagauucugggaacucguggauaaagagcggaaccugcaccuugaagggaagugcgagacauguguguacaauaugaugggaaaaagagagaagaagcugggcgaauuuggcaaagcgaaggggucccgggccauuugguacauguggcucggagcucgcuuccuggaguuugaagcccuuggcuuccugaacgaggaccauugguuuagcagagaaaauucucucuccggggucgagggagagggccugcacaaacugggguauauccuccgggaugugagcaagaaagaaggcggagcuauguacgccgacgacaccgccggcugggauacgcgcauuacccuggaggaccuuaagaacgaagagaugguuacaaaucacauggaaggggagcauaagaaacuggcggaggcuaucuucaagcucaccuaucagaacaaaguggucagagugcagcggcccacaccgcgcggaaccguuauggauaucauuuccagacgggaccaacgcggcagcgggcaggucggaacguacggccugaauacauuuaccaacauggaagcccagcuuaucagacagauggagggggaaggcgucuucaagaauauucaacaccugacagugaccgaggagguugccgugaaaaacuggcucgcucgggucggacgcgaaagacugucucggauggccaucagcggcgaugacugcguggucaagccucuggaugaccgcuucgcuaacgcccucacggcgcugaaugauauggggaagauuagaaaagacauccagcagugggagcccuccaagggauggaacgauuggacccaggugcccuuuugcucucaucacuuccaugaacuuaucaugaaagacggccggguucugguggucccuuguagaaaucaagaugagcucauugggcgcgcccggaucagccagggagcuggcuggucccugagagaaacagccugccuugggaagucuuaugcucagauguggagccugauguacuuucaccgccgggaccucagacuggccgcgaacgccauuuguuccgcugugccgucucacugggugcccaccagccgcacaaccugguccauccaugccaaacacgaguggaugacaaccgaggacaugcugacgguuuggaaucggguguggauuagagaaaacccuuggauggaggauaagacacccgucgaaagcugggaggaaaucccuuaucucggcaagcgcgaggaccaguggugcggaucucugauuggccuuaccucccgggcuaccugggccaaaaauauccaagcugccaucaaccaggugagaagccugauugggaaugaggaauacgcggauuacaugcccucuaugaagcgcuuccggagagaggaagaggaagccggaguucucugguga

SEQ ID NO: 20102 - RNA, 9876 nt, Artificial Sequence
  derived and/or modified CDS sequence (opt5) from DENV-2__EU482653__SS-prME
agcgccggcaugaucauuaugcugauccccaccgugauggcuuuccaccucacaacgagaaauggggaaccucauaugauugucggaauccaggaaaagggcaagagccugcuuuuuaagaccgaagacgggguuaauaugugcacacugauggccauggaucucggagaacugugugaagacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucgugaccgacaacguucacacauggaccgaacaguauaaguuucaaccugagucccccucuaaacuggccagcgccauccagaaggcucaggaagaggggauuuguggcauccgguccgugacaagacuugagaaucugauguggaaacagauuacgccggaacucaaccacauccuggccgagaaugaagucaagcugaccaucaugacaggagauauuaaaggcaucaugcaagcugggaagcgcucucuucggccucagcccaccgagcucaaguacagcuggaaaacauggggaaaggccaaaaugcuguccaccgaaagccauaaccagacguuccugauugacggcccugagaccgcggagugccccaauacaaacagagccuggaacucucucgaaguggaggauuauggguuuggaguuuucaccacaaacaucuggcugcgccuuaaggaaaaacaggacgcuuuuugugacuccaagcugaugagcgccgcuauuaaggauaaucgggccgugcacgcggacaugggcuacuggaucgagucugcccucaacgauaccuggaaaaucgagaaggcuuccuucauugaagucaaaaauugccauuggccuaagagccacacacuguggucuaacggcgugcuggagagcgaaaugaucauucccaaaaaccuugccgggccggugucccaacacaauuauagaccuggauaccauacccagaucgcuggccccuggcaccucgggaagcuggagauggacuucgauuuuugugacggaacgacagucauuguuaccgaagauugcggcaaccgcgggcccagccugcggaccacaaccgccucuggaaagcucaucacggaguggugcuguagauccugcacacugccuccgcuucgguaccgcggcgaggacggcuguugguaugggauggaaauuagaccccugaaagagaaggaagagaaucucgugaacagccuggugaccgccggacauggccaggucgauaauuucucccugggggugcuuggaauggcucucuuucuggaagagaugcugcggacaagaguuggcaccaaacacgcgauccuccugguggccgucucuuucgugacacuuaucaccgggaacaugagcuuuaaggaccugggacgcguuguggucauggugggcgcuacgauggccgaugacauuggcauggggguuaccuaccucgcccugcuggcugccuucaaagugcggccuacauuugcggcuggacuucugcucagaaagcugaccuccaaggagcucaugaugacaaccaucggcauuguccugcuuucucaaagcacgauccccgaaacagugcuggagcucaccgaugcccuggcccuggggaugauggugcuuaaaauuguccgcaauauggaaaaguaucagcuggcuguuacaaucauggccauccucugcgugccuaacgcggugauucugcagaaugcuuggaaagucuccuguaccauccucgccgugguuucugugagcccccugcuucugaccuccagccagcaaaagacagacuggauuccucucgcccugacgaucaaaggacugaaccccaccgcuauuuuccuuacaacccugucuagaacaaauaagaaacgguccuggccgcucaacgaggccaucauggcugucggcauggugagcauccuggccucuucccuccugaagaaugacauuccuaugaccgggccccuuguugcgggaggccugcugacggugugcuacguccucacaggccgcagcgccgaucuggaacuugagagagcuaccgacgugaagugggaggaucaggccgaaaucucuggguccagcccuauucuguccaucaccauuagcgaggacggaucuaugagcaucaaaaacgaagaggaggaacagacacucaccauucugauccggacaggccuccuggucaucuccgggcuuuuucccauuucuaucccgauuacggcugccgccugguaucugugggaggugaagaaacagcgcgcuggaguucugugggaugugccuucucccccucccaugggcaaggcggaacucgaggacggggccuacagaaucaaacaaaagggaauuuucggcuauucccagaucggcgcuggggucuacaaggaaggaaccuuucauacaauguggcacgugacccggggcgccguucugaugcacaaagggaagcgcaucgagcccuccugggccgaugugaaaaaggaccuuauuagcuacggaggcggguggaaacuggagggagaauggaaggagggcgaagagguccaggugcucgcucuggaaccuggcaagaauccgagagccgugcagacaaaacccgggcuguucaagaccaacacgggaaccaucggcgcgguuucccuggauuuuucuccugggacaagcggaucccccauuaucgacaaaaagggcaaagucguggggcuuuauggaaacggcguggucacccggagcggcgcuuacgugucugccauugcccaaacagagaaguccaucgaggauaauccugaaaucgaggacgauauuuuccgcaagagacggcugaccaucauggaccugcaucccggggcuggaaaaacaaagagauaucucccugccauuguucgcgaagcgaucaaacggggccugagaacgcuuauucuggcuccgacccgcguggucgccgccgagauggaagaggcucuccgggggcugcccaucagauaccagaccccugccauucgcgcugagcacaccggacgggaaaucguggaccucaugugucaugccaccuucacaaugagacugcuuagccccguucgcgugccuaacuauaaucugaucauuauggaugaggcgcacuuuacggaccccgccucuaucgcugcccggggcuacauuuccaccagagucgaaaugggggaggcugccggcaucuucaugacagccaccccgccuggaagccgggaucccuuuccccaguccaacgcuccuauuaucgacgaggaacgcgagauccccgaaagaucuuggaauagcggccaugagugggugacagauuucaaggggaaaaccguuugguuugugccuuccauuaaggcgggaaacgacaucgccgcuugccugcggaagaauggcaaaaaggucauucaacucagccgcaaaacguucgauucugaauaugugaagacaagaaccaacgacugggauuuuguggucaccacagacaucuccgagaugggggccaauuucaaagccgagcggguuauugauccgagacgcuguaugaagcccgugauccugaccgacggagaggaacgggugauccuugcuggcccuaugcccgucacacacagcucugccgcgcagagacgcgggcggauuggcagaaacccuaaaaaugaaaacgaccaguacaucuacaugggagagccccuggaaaaugaugaggacugcgcucacuggaaggaggccaagaugcuccuggauaacauuaauaccccggaaggcaucauuccuagcauguuugagcccgaacgcgagaaaguggacgccaucgauggggaauaucggcugagaggagaggcucgcaagacguucguugaccucaugagacggggcgaucuuccuguguggcuggccuacaaagucgcggccgaggggauuaacuaugcugaccgcagaugguguuuugauggaaucaagaacaaucagauccuggaagagaacguggaaguugagauuuggacaaaagagggcgaacggaagaagcucaaaccccgcuggcuggacgccagaaucuacuccgauccucuugcucugaaggaguucaaagaguucgccgcugggcggaagucucucacccugaaucugauuacagagaugggcagacuccccaccuuuaugacgcagaagacccgcgacgcccuugauaaccuggcggugcugcauacagccgaagcuggaggccgggccuauaaucacgcucucagcgagcugccggagacccuugaaacacugcuccugcugacccuccuugccacagucaccgggggaaucuuccuguuucugauguccggcagagggauuggaaagaugacgcucggcaugugcugcaucaucacagccucuauucugcuuugguacgcucagauccagccucauuggauugcggccagcaucauucuggaguucuuucucaucgugcugcugauccccgaacccgagaagcagcgcaccccucaagacaaccagcucaccuaugucgugauugcuauccuuacaguuguggccgccaccauggcuaaugaaaugggcuuccuggagaaaacaaagaaagaccuggggcucggauccauugccacgcagcagccggagagcaacauccuggauauugaccuucggcccgcgucugccuggacccuguacgcuguggccacaaccuuugucacaccuaugcucagacacuccaucgaaaauagcuccguuaacgugucucugaccgcuauugccaaucaagcgacggugcugaugggccucgggaagggauggccccuuagcaaaauggauaucggcgucccucugcuggccaucggguguuacucccaggugaaccccauuacccucacagcugcccugcuucugcucguugcucacuaugccaucauuggaccuggccugcaggcuaaggccacccgggaggcgcagaagcgcgccgcugccggcaucaugaaaaauccgacaguggacgggauuaccgucaucgaucuggaccccaucccuuacgaucccaaguucgaaaaacaacucggacaggugaugcuucugauucugugcgucacgcagguccucaugaugagaacaaccugggcucugugugaggcccuuacacuggccaccggcccuaucucuacccucugggaagggaaccccggacgguuuuggaauacaacgauugcgguuagcauggcuaacaucuuccgcggcuccuaucuggccggggcuggacugcucuuuagcauuaugaagaauaccacaaacgccagacggggcaccggcaacaugggggagacacuuggagagaaauggaagucucgccugaaugcccugggcaaauccgaguuccaaaucuacaaaaagagcgggauccaggagguggacagaacccucgcuaaagaaggaauuaagcggggcgagacggaucaucacgccgucucucgcggguccgcgaaacugagaugguuuguggagcggaacaugguuacaccggaaggaaagguggucgaccuuggcugcggcagagggggauggagcuauuacuguggcgggcugaaaaaugugcgcgaggugaagggacucaccaagggcgggccuggacaugaagaacccauccccaugucuaccuauggcuggaaccugguucggcugcagagcggcgucgauguguucuucauuccucccgaaaaaugcgacacacuccuuugugauaucggggaguccucuccuaauccgaccguggaggccggaagaacacugcgcguccugaaccucguugaaaauuggcugaacaauaacacgcaguuuugcauuaaggugcuuaaucccuacaugccuagcgugaucgagaaaauggaagcucugcaacggaaguacggcggggcccucgucagaaacccccugucccgcaauagcacccacgagauguauuggguguccaacgcuucuggaaauaucguuagcuccgugaacaugauuucucggaugcugaucaacagauucacaaugcgccauaaaaaggccaccuacgaaccugacgucgaccucggcagcgggacacggaauauuggaaucgaguccgagauucccaaccuugauaucauuggcaagagaaucgagaagaucaagcaggagcacgaaaccucuuggcacuaugaccaggaucauccguacaaaacgugggcguaucacggcagcuacgagaccaagcagacaggguccgccagcucuauggugaauggaguugugcgccugcugaccaaaccuugggacguccuccccacagugacccaaauggcuaugacagauaccacgccuuuuggccagcagcggguguucaaggaaaaggucgacacaagaacccaggagcccaaagaggggaccaagaaacugaugaagauuacagccgaauggcuuuggaaagagcugggaaagaaaaagacgccucgcauguguaccagagaagaguuuacacggaagguucgcuccaacgcugcccucggcgcuaucuucaccgaugagaauaaauggaaaagcgccagagaagcgguggaggacucucgguuuugggaacugguggauaaagagagaaaccugcaucucgaagggaagugcgagacaugugucuauaauaugaugggaaaacgggagaagaagcugggcgaguucggcaaagccaaggggucccgcgcuauuugguacauguggcuuggagccagauuucuggaguucgaagcucucggcuuucugaacgaggaccacugguucagccgggaaaauucucuuuccgggguggagggagagggccugcacaaacucggguacauccugcgcgauguuagcaagaaagaaggcggagccauguaugccgacgacaccgcgggcugggauacaagaauuacccuggaggaccucaagaacgaagagauggugacgaaucauauggaaggggagcacaagaaacuggcugaggccaucuuuaaacuuaccuaccaaaacaaagucgugcggguucagcgccccacaccgagaggaaccgugauggauaucauuucccggcgcgaccagagaggcagcgggcaagucggaacauauggccugaauaccuucacgaacauggaagcccagcucauccggcagauggagggggaaggcguguucaagaauauucagcaucugacaguuaccgaggagguggcuguccaaaacuggcuugcccgcgugggaagagaacggcugucucgcauggcuaucagcggcgaugacugcgucgugaaaccucucgaugacagauuugccaacgcgcugacagcccugaaugauauggggaagauucggaaggacauccagcagugggagcccuccaaaggauggaacgauuggacccagguucccuucugcucucaccauuuucacgaacucaucaugaaggacggcagagugcuggucgugccuugucgcaaucaagaugagcuuauugggcgggcuagaaucagccagggagccggcuggucccugcgcgaaacggcuugccucgggaaaucuuacgcccagauguggagccugauguauuuccaccggagagaccuucgccuggcggccaacgcuauuuguuccgccgugccgucucauuggguucccaccagccggacaaccugguccauccacgcuaagcaugaguggaugacaaccgaggacaugcucacaguguggaauagagucuggauucgcgaaaacccuuggauggaggauaaaacccccguggaaagcugggaggaaaucccuuaccugggcaagcgggaggaccaguggugcggaucucugauuggccucacguccagagccacaugggcuaagaauauccaagccgcgaucaaccagguucgcagccugauugggaaugaggaauauaccgauuacaugcccucuaugaaacgguuuagacgggaggaagaggaagccggagugcuuugguga

SEQ ID NO: 20103 - RNA, 9876 nt, Artificial Sequence
  derived and/or modified CDS sequence (opt5) from DENV-2__EU482654__SS-prME
agcgccggcaugaucauuaugcugauccccaccgugauggcuuuccaccucacaacgcggaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggccaggaaaucaaggugaccccucaauccagcaucacagaggcggaacugaccggguauggaacgguuaccauggaguguucucccagaacaggccuugauuucaaugaaauggugcugcuccagauggagaacaaagccuggcugguccaccggcagugguuucuugaccugccgcucccuuggcugcccggggcugauaagcaggaguccaauuggauucaaaaggaaacccuggugacauucaaaaacccucaugccaagaaacaggacguugugguccucggaagccaggagggcgcuaugcacaccgcccugacgggggccacagaaauccaaauguccucuggcaaucuucuguuuaccggacaucucaagugccgccugagaauggacaaacuucagcugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccaacucaagcugaauugguucaagaaaggaagcucuauuggccagauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaauauaaauuucagccugagucccccucuaagcuggccagcgccauucagaaagcucaggaagaggggaucuguggcauucgguccguuacaagacuugagaaucugauguggaagcaaaucacgccggaacucaaccacauccuggccgagaaugaagugaaaaugaccauuaugacaggagauaucaagggcauuaugcaggcugggaaacgcucucugcggccucagcccaccgagcuuaaguacagcuggaagacauggggaaaagccaagaugcucuccaccgaaagcuauaaccagacguuccugaucgacggcccugagaccgcggagugccccaauacaaacagagccuggaacucucuggaagucgaggauuacggguuuggaguguucaccacaaacauuuggcucaaacugaaggaaaaacaagacgcuuuuugugacuccaaacuuaugagcgccgcuaucaaggauaaucgcgccguucaugcggacaugggcuauuggaucgagucugcccugaacgauaccuggaaaauugagaaggcuuccuucaucgaagugaaaaauugccacuggccuaagagccauacacucuggucuaacggcguccuggagagcgaaaugauuauccccaaaaaccuggccgggccggugucccagcacaauuaccggccuggauaccacacccagauugcuggccccuggcaucuugggaagcucgagauggacuucgauuuuugugacggaacgacagugaucgucaccgaagauugcggcaacagagggcccagccugcgcaccacaaccgccucuggaaagcugauuacggaguggugcugucgguccugcacacucccuccgcugagauaucggggcgaggacggcuguugguacgggauggaaauccgcccccuuaaagagaaggaagagaaucugguuaacagccucgugaccgccggacacggccaaguggauaauuucucccuggggguccugggaauggcucuuuuucucgaagagaugcugagaacacgggugggcaccaaacaugcgauccugcucguugccgugucuuucgucacacugauuaccgggaacaugagcuuuaaggaccuuggaagagugguugugauggucggcgcuacgauggccgaugacaucggcaugggggugaccuaucuggcccuccuggcugccuucaaaguucgcccuacauuugcggcuggacugcuucugcggaagcucaccuccaaggagcugaugaugacaaccauuggcaucgugcuccugucucagagcacgauucccgaaacaguccuugagcugaccgaugcccucgcccuggggaugauggugcugaaaaucgugagaaauauggaaaaguaccagcuugcugucacaaucauggccauucugugcguuccuaacgcggugauccuccagaaugcuuggaaaguguccuguaccauucuggccgucgugucuguuagcccccuccugcuuaccuccagccaacagaagacagacuggaucccucuggcccucacgauuaaaggacugaaccccaccgcuaucuuccugacaacccuuucucgcacaaauaagaaaagauccuggccgcugaacgaggccaucauggcugugggcauggucagcauucucgccucuucccugcucaagaaugacaucccuaugaccgggccccugguggcgggaggccuucugacgguuugcuaugugcugacaggccggagcgccgaucucgaacuggagcgcgcuaccgacgucaagugggaggaucaggccgaaauuucuggguccagcccuauccuuuccauuaccaucagcgaggacggaucuaugagcauuaaaaacgaagaggaggaacagacacugaccauccucaucagaacaggccugcucgugauuuccgggcuguuucccaucucuauuccgaucacggcugccgccugguaccuuugggaggucaagaaacaacgggcuggagugcugugggauguuccuucucccccucccaugggcaaggcggaacuggaggacggggccuaucgcauuaaacagaagggaauccucggcuacucccagaucggcgcugggguguacaaggaaggaaccuuccacacaauguggcaugucaccagaggcgccgugcugaugcacaaagggaagcggauugagcccuccugggccgauguuaaaaaggaccuuaucagcuauggaggcggguggaaacuggagggagaauggaaggagggcgaagaggugcagguccucgcucuggaaccuggcaagaauccgcgcgccgugcaaacaaaacccgggcucuuuaagaccaacacgggaaccauuggcgcggugucccuggauuucucuccugggacaagcggaucccccaucauugacaaaaagggcaaaguugucgggcuuuacggaaacggcguggugaccagaagcggcgcuuaugucucugccaucgcccagacagagaaguccaucgaggauaauccugaaauugaggacgauaucuuucggaagcgcagacugaccauuauggaccugcaccccggggcuggaaaaacaaagcgguaccucccugccaucgugagagaagcgauuaaacgcggccugcggacgcuuauccuggcuccgaccagaguuguggccgccgagauggaagaggcucuccgcgggcugcccauucgguaucagaccccugccaucagagcugagcauaccggacgcgaaaucgucgaccucaugugucacgccaccuucacaaugcggcugcuuagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaauccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccugagaaagaauggcaaaaaggugauccagcucagccggaaaacguuugauucugaauacgucaagacacgcaccaacgacugggauuucguggugaccacagacauuuccgagaugggggccaauuuuaaagccgagagagucaucgauccgcggagauguaugaagcccguuauccugaccgacggagaggaacgcgugauucuugcuggcccuaugcccgugacacauagcucugccgcgcagcggagagggcgcaucggccggaacccuaaaaaugaaaacgaccaguacauuuauaugggagagccccuggaaaaugaugaggacugcgcucacuggaaggaggccaagaugcuccuggauaacaucaauaccccggaaggcauuaucccuagcauguucgagcccgaaagagagaaagucgacgccauugauggggaauaccgccugcggggagaggcuagaaagacguuuguggaccucaugcgcagaggcgaucuuccuguuuggcuggccuauaaaguggcggccgaggggaucaacuacgcugaccggcgcugguguuucgauggaaucaagaacaaucaaauucuggaagagaacgucgaaguggagaucuggacaaaagagggcgaaagaaagaagcucaaaccccgguggcuggacgcccgcauuuauuccgauccucuugcucugaaggaguuuaaagaguucgccgcugggagaaagucucucacccugaaucugaucacagagaugggccggcuccccaccuucaugacgcagaaaaccagagacgcccuugauaaccuggcgguucugcacacagccgaagcuggaggccgcgccuacaaucaugcucucagcgagcugccggagacccuugaaacacugcuccugcugacccuccuugccacagugaccgggggaauuuuucuguuccugauguccggccgggggaucggaaagaugacgcucggcaugugcugcaucauuacagccucuauccugcuuugguaugcucagauucagccucacuggaucgcggccagcauuauccuggaguuuuuccucaucguccugcugauucccgaacccgagaagcaaagaaccccucaggacaaccagcucaccuacguggucaucgcuauucuuacagugguugccgccaccauggcuaaugaaaugggcuuucuggagaaaacaaagaaagaccuggggcucggauccaucgccacgcagcaaccggagagcaacauucuggauaucgaccuucgccccgcgucugccuggacccuguacgcuguggccacaaccuucgugacaccuaugcuccggcauuccauugaaaauagcuccgucaacguuucucugaccgcuaucgccaaucaggcgacggugcugaugggccucgggaagggauggccccuuagcaaaauggauaucggcgugccucugcuggccauuggguguuauucccaggucaaccccaucacccucacagcugcccugcuucugcucguggcucacuacgccauuaucggaccuggccugcaggcuaaggccaccagagaggcgcaaaagcgggccgcugccggcauuaugaaaaauccgacaguugacgggaucaccgugaucgaucuggaccccauuccuuaugaucccaaguuugaaaaacagcucggacaggucaugcuucugauccugugcgugacgcaaguccucaugaugcgcacaaccugggcucugugugaggcccuuacacuggccaccggcccuauuucuacccucugggaagggaaccccggaagauucuggaauacaacgaucgcggugagcauggcuaacauuuuucggggcuccuaccuggccggggcuggacugcuguucagcaucaugaagaauaccacaaacacccgcagaggcacaggcaacaugggggagacccuuggagagaaauggaagucucggcugaauacgcugggcaaauccgaauuucagaucuauaaaaagagcgggauucaggagguugaccgcacacucgccaaagaaggaaucaagagaggcgagaccgaucaccaugccgugucucggggguccgcuaaacugcgcugguucgucgagagaaacauggugaccccggaaggaaagguuguggaccuuggcugcggcagagggggauggagcuacuauuguggcgggcugaaaaauguccgggaggugaagggacucacaaagggcgggccuggacacgaagaacccauucccaugucuaccuacggcuggaaccuggugcgccugcagagcggcguugaugucuuuuucaucccucccgaaaaaugcgacacacuccuuugugauauuggggaguccucuccuaauccgacgguggaggccggacggacccugagagugcugaaccucgucgaaaauuggcugaacaauaacacacaauucugcaucaagguucuuaaucccuacaugccuagcgugaucgagaaaauggaagcgcugcagcgcaaguauggcggggcccucgugcggaacccccuguccagaaauagcacccaugagauguacugggucuccaacgcuucuggaaauauugugagcuccguuaacaugaucucucgcaugcugauuaaccgguuuacaaugagacacaaaaaggccaccuaugaaccugacguggaccucggcagcgggacgcgcaauaucggaauugaguccgagacccccaaccuugauaucauuggcaagcggaucgagaagaucaagcaggagcaugaaacaucuuggcacuacgaccaggaucacccguauaaaaccugggcuuaccauggcagcuaugagacaaagcaaaccggguccgccagcucuauggucaauggagugguuagacugcugacaaaaccuugggacgugcuccccaccgucacgcagauggcgaugacagauaccaccccuuucggccagcagcgcguguuuaaggaaaagguggacacacggacgcaagagcccaaagaggggaccaagaaacugaugaagauuacagccgaauggcuuuggaaagagcugggaaagaaaaagaccccuagaauguguacacgcgaagaguucaccagaaagguccgguccaacgcugcccucggcgcuaucuuuacagaugagaauaaauggaaaagcgcccgcgaagcuguugaggacucuagauucugggaacugguggauaaagagcggaaccugcaccucgaagggaagugcgagaccuguguguacaauaugaugggaaaaagagagaagaagcugggcgaauuuggcaaagccaaggggucccgggcgauuugguacauguggcuuggagcccgcuuccuggaguuugaagcucucggcuuccugaacgaggaccauugguuuagcagagaaaauucucuuuccggggucgagggagagggccugcacaaacucggguauauccugcgggaugugagcaagaaagaaggcggagccauguacgcugacgacacggccggcugggauacccgcauuacacuggaggaccucaagaacgaagagaugguuaccaaucacauggaaggggagcauaagaaacuggccgaggcgaucuucaaacuuacauaucagaacaaaguggucagagugcagcggcccaccccgcgcggaacgguuauggauaucauuuccagacgggaccaacgcggcagcgggcaggucggaacauacggccugaauaccuuuacaaacauggaagcucagcucaucagacagauggagggggaaggcgucuucaagaauauucaacaccugaccgugacggaggagguugccgugcagaacuggcuugcccgggucggacgcgaaagacugucucggauggcuaucagcggcgaugacugcguggucaaaccucucgaugaccgcuucgccaacgcucugaccgcccugaaugauauggggaagauuagaaaggacauccagcagugggagcccuccaaaggauggaacgauuggacacaagugcccuuuugcucucaucacuuccaugaacucaucaugaaggacggccggguucugguggucccuuguagaaaucaggaugagcuuauugggcgcgcgcggaucagccagggagccggcuggucccugagagaaaccgcuugccucgggaaaucuuaugcccagauguggagccugauguacuuucaccgccgggaccuuagacuggcugccaacgcgauuuguuccgccgugccgucucacugggugcccacaagccgcaccacaugguccauccaugcuaagcacgaguggaugaccacggaggacaugcucacaguuuggaaucggguguggauuagagaaaacccuuggauggaggauaaaacccccgucgaaagcugggaggaaaucccuuaucugggcaagcgcgaggaccaauggugcggaucucugauuggccucaccucccgggccacaugggcuaagaauauccaggccgcuaucaaccaggugagaagccugauugggaaugaggaauacaccgauuacaugcccucuaugaaacgcuuccggagagaggaagaggaagccggaguucuuugguga

SEQ ID NO: 20104 - RNA, 9876 nt, Artificial Sequence
  derived and/or modified CDS sequence (opt5) from DENV-2__EU482656__SS-prME
agcgccggcaugaucauuaugcugauccccaccgugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucgugaccgacaacguucacacauggaccgaacaguauaaguuucaaccugagucccccucuaaacuggccagcgccauccagaaggcucaggaagaggggauuuguggcauccgguccgugacaagacuugagaaucugauguggaaacagauuacgccggaacucaaccacauccuggccgagaaugaagucaagcugaccaucaugacaggagauauuaaaggcaucaugcaagcugggaagcgcucucuucggccucagcccaccgagcucaaguacagcuggaaaacauggggaaaggccaaaaugcuguccaccgaaagccauaaccagacguuccugauugacggcccugagaccgcggagugccccaauacaaacagagccuggaacucucucgaaguggaggauuauggguuuggaguuuucaccacaaacaucuggcugaaacuuaaagaaaagcaggacgcuuuuugugacuccaagcugaugagcgccgcuauuaaagauaaucgcgccgugcacgcggacaugggcuacuggaucgagucugcccucaacgauaccuggaagaucgagaaggcuagcuucauugaagucaagaauugccauuggccuaaaagccacacacuguggucuaacggcgugcuggagagcgaaaugaucauucccaagaaccuugccgggccggugucccaacacaauuaucggccuggauaccauacccagaucgcuggccccuggcaccucgggaagcuggagauggacuucgauuuuugugacggaacgacagucauuguuaccgaagauugcggcaacagagggcccagccugcgcaccacaaccgccucuggaaaacucaucacggaguggugcugucgguccugcacacugccuccgcuuagauaccggggcgaggacggcuguugguaugggauggaaauucgcccccugaaggagaaagaagagaaucucgugaacagccuggugaccgccggacauggccaggucgauaauuucucccugggggugcuuggaauggcucucuuucuggaagagaugcugagaacacggguuggcaccaagcacgcgauccuccugguggccgucucuuucgugacacuuaucaccgggaacaugagcuuuaaagaccugggaagaguuguggucauggugggcgcuacgauggccgaugacauuggcauggggguuaccuaccucgcccugcuggcugccuucaaggugcgcccuacauuugcggcuggacuucugcuccggaagcugaccuccaaagagcucaugaugacaaccaucggcauuguccugcuuucucaaagcacgauccccgaaacagugcuggagcucaccgaugcccuggcccuggggaugauggugcuuaagauugucagaaauauggaaaaauaucagcuggcuguuacaaucauggccauccucugcgugccuaacgcggugauucugcagaaugcuuggaaggucuccuguaccauccucgccgugguuucugugagcccccugcuucugaccuccagccagcagaagaccgacuggauuccucucgcccugacgaucaagggacugaaccccaccgcuauuuuccuuacaacccugucucgcacaaauaaaaagagauccuggccgcucaacgaggccaucauggcugucggcauggugagcauccuggccucuucccuccugaagaaugacauuccuaugaccgggccccuuguugcgggaggccugcugacggugugcuacguccucacaggccggagcgccgaucuggaacuugagcgcgcuaccgacgugaaaugggaggaucaggccgaaaucucuggguccagcccuauucuguccaucaccauuagcgaggacggaucuaugagcaucaagaacgaagaggaggaacagacacucaccauucugaucagaacaggccuccuggucaucuccgggcuuuuucccauuucuaucccgauuacggcugccgccugguaucugugggaggugaaaaagcagcgggcuggaguucugugggaugugccuucucccccucccaugggcaaagcggaacucgaggacggggccuaccgcaucaagcaaaaggggauucugggcuauucccagaucggcgcuggggucuacaaagaaggaaccuuccauacaauguggcacgugaccagaggcgccguucuuaugcacaaggggaaacggaucgagcccuccugggccgaugugaagaaagaccugauuagcuacggaggcggguggaagcucgagggagaauggaaggagggcgaagagguccaggugcuggcucucgaaccuggcaaaaauccgcgcgccgugcagacaaagcccgggcuguuuaaaaccaacacgggaaccaucggcgcgguuucccuugauuucucuccugggacaagcggaucccccauuaucgacaagaaaggcaaggucguggggcuguauggaaacggcguggucaccagaagcggcgcuuacgugucugccauugcccaaacagagaaguccaucgaggauaauccugaaaucgaggacgauauuuuucggaaacgcagacugaccaucauggaccuccaucccggggcuggaaagacaaaacgguaucugccugccauuguuagagaagcgaucaagcgcggccuucggacgcugauucucgcuccgaccagaguggucgccgccgagauggaagaggcucugcgcgggcuccccauccgguaccagaccccugccauuagagcugagcacaccggacgcgaaaucguggaccugaugugucaugccaccuucacaaugcggcuucugagccccguuagagugccuaacuauaaucugaucauuauggaugaggcgcacuucacggaccccgccucuaucgcugcccgcggcuacauuuccacccgggucgaaaugggggaggcugccggcaucuuuaugacagccaccccgccuggaagcagagaucccuucccccaguccaacgcuccuauucucgacgaggaacgggagauccccgaacgcucuuggaauagcggccaugagugggugacagauuuugaagggaaaaccguuugguucgugccuuccaucaaggcgggaaacgacauugccgcuugccugagaaagaauggcaaaaaggucauccaacuuagccggaaaacguuugauucugaguaugugaagacacgcaccaacgacugggauuucguggucaccacagacauuuccgagaugggggccaauuuuaaagccgaaagaguuaucgauccgcggagauguaugaagcccgugauucugaccgacggagaggaacgcgugauccucgcuggcccuaugcccgucacacacagcucugccgcgcagcggagagggcgcaucggccggaacccuaaaaaugagaacgaccaguacauuuacaugggagaaccccuggagaaugaugaggacugcgcucacuggaaggaagccaagaugcugcucgauaacaucaauaccccggagggcauuaucccuagcauguucgaacccgagagagaaaaaguggacgccauugauggggaguaucgccuucggggagaggcuagaaagacguuuguugaccugaugcgcagaggcgaucugccuguguggcucgccuacaaagucgcggccgaagggaucaacuaugcugaccggcgcugguguuucgauggaauuaagaacaaucagauccuggaggaaaacguggagguugagaucuggacaaaagaaggcgagagaaagaaacuuaaaccccgguggcuggacgcccgcauuuacuccgauccucucgcucugaaggaauuuaaagaguucgccgcugggagaaagucucugacccucaaucuuaucacagaaaugggccggcugcccaccuucaugacgcagaagaccagagacgcccuggauaaccucgcggugcugcauacagccgaggcuggaggccgcgccuauaaucacgcucuuagcgagcugccggaaacccucgagacacugcugcuccuuacccugcuggccacagucaccgggggaauuuuucucuuccugauguccggccgggggaucggaaagaugacgcuuggcaugugcugcauuaucacagccucuauccugcucugguacgcucagauucagccucauuggaucgcggccagcauuauccuggaauuuuuccugauugugcuccuuauccccgagcccgaaaagcagagaaccccucaagacaaccagcugaccuaugucgugaucgcuauucugacaguuguggccgccaccauggcuaaugagaugggcuuucucgagaaaacaaagaaagaccuggggcuuggauccguggccacgcagcagccggaaagcaacauccuggauauugaccuccgccccgcgucugccuggacccuguacgcugucgccacaaccuucguuacaccuaugcugcggcacuccaucgagaauagcuccgugaacgugucucucaccgcuauugccaaucaagcgacgguccuuaugggccuggggaagggauggccccugagcaaaauggauaucggcgugccucuccuggccauuggguguuacucccagguuaaccccaucacccuuacagcugcccugcuccugcugguggcucacuaugccaucauuggaccuggccuccaggcuaaggccaccagagaagcgcagaagcgggccgcugccggcaucaugaaaaauccgacagucgacgggauuaccgugaucgaucuugaccccauuccuuacgaucccaaguuugagaaacaacugggacaggucaugcugcucauccugugcgugacgcagguucuuaugaugcgcacaaccugggcucugugugaagcccucacacuggccaccggcccuaucucuacccugugggaggggaaccccggaagauucuggaauacaacgauugcggugagcauggcuaacaucuuucggggcuccuaucucgccggggcuggacuucuguucagcauuaugaagaauaccacaaacacccgcagaggcacaggcaacaugggggagacccugggagaaaaauggaagucucggcucaaugcccugggcaaauccgaguuucaaaucuacaaaaagagcgggauucaggaagucgaccgcacgcuugccaaagagggaaucaagagaggcgagacagaucaucacgcugugucucggggguccgccaaacugcgcugguucguugaaagaaacauggugaccccggagggaaaggucguggaccucggcugcggccggggaggauggagcuauuacuguggcgggcugaaaaaugugagagaaguuaagggacugaccaagggcgggccuggacaugaggaacccauccccaugucuacauauggcuggaaccucguccgccuucagagcggcguggauguguuuuucauuccucccgagaaaugcgacacccugcugugugauaucggggaguccucuccuaauccgacagucgaagcgggacggacgcucagaguucugaaccuuguggagaauuggcugaacaauaacacccaguucugcauuaaggugcucaaucccuacaugccuagcgucaucgagaagauggaggcccugcaacgcaaguacggcggggcucuggugcggaacccccucuccagaaauagcacacacgaaauguauuggguuuccaacgccucuggaaauauugugagcuccgucaacaugaucucucgcaugcuuaucaaccgguuuaccaugagacauaaaaaggcuacauacgagccugacguggaccugggcagcgggacccgcaauauuggaaucgaguccgaaauucccaaccuggauaucauuggcaagcggaucgagaaaauuaagcaggaacacgagacgucuuggcacuaugaccaggaucauccguacaaaaccugggccuaucacggcagcuacgaaacaaagcagaccggguccgcgagcucuaugguuaauggaguggucagacuccugacaaaaccuugggacgugcuucccaccgugacacaaauggccaugaccgauacgacaccuuucggccagcagcgcgucuuuaaggagaagguugacacccggacccaggagcccaaagaagggacaaagaaacugaugaagaucacggcugaguggcucuggaaagaacugggaaagaaaaagaccccuagaauguguacacgcgaggaguucaccagaaaggugcgguccaacgccgcucugggcgccaucuuuacagaugaaaauaaauggaaaagcgcucgcgaggccguggaagacucuagauucugggagcucgucgauaaagaacggaaccugcaucuugaggggaagugcgagaccuguguguauaauaugaugggaaaaagagaaaagaagcugggcgaguuuggcaaagcgaaggggucccgggccauuugguacauguggcucggagcucgcuuccuggaauuugaggcccuuggcuuccugaacgaagaccacugguuuagcagagaaaauucucucuccgggguugagggagaaggccugcacaaacugggguacauccuccgggaugugagcaagaaagagggcggagcuauguaugccgacgacacagccggcugggauacccgcauuacgcuggaagaccuuaagaacgaggaaauggucaccaaucauauggagggggagcacaagaaacuggcggaagcuaucuucaagcucacauaccaaaacaaagugguuagagugcagcggcccaccccgcgcggaacagucauggauauuaucuccagacgggaccagcgcggcagcgggcaagugggaaccuauggccugaauacguuuacaaacauggaggcccagcuuaucagacagauggaaggggagggcguuuucaagaauauucagcaucugaccgugacagaggaagucgccgugcaaaacuggcucgcucgggucggacgcgagagacugucucggauggccaucagcggcgaugacugcgugguuaaaccucuggaugaccgcuucgcuaacgcccucaccgcgcugaaugauauggggaagauuagaaaggacauccagcagugggaacccuccaaaggauggaacgauuggacgcaaguccccuuuugcucucaccauuuccacgagcuuauuaugaaggacggccggguccugguggugccuuguagaaaucaagaugaacucaucgggcgcgcccggaucagccagggagcuggcuggucccugagagagaccgccugccuugggaaaucuuacgcucagauguggagccugauguauuuucaccgccgggaccucagacuggccgcgaacgccauuuguuccgcuguuccgucucauugggugcccacaagccgcaccacaugguccauccacgccaagcaugaguggaugaccacagaagacaugcugaccgucuggaaucggguguggauuagagagaacccuuggauggaagauaaaacgcccguugagagcugggaagagaucccuuaccucggcaagcgcgaggaccaguggugcggaucucugauuggccuuacaucccgggcuaccugggccaagaauauccaagcugccauuaaccaggugagaagccugaucgggaaugaagaguauaccgauuacaugcccucuaugaaacgcuuccggagagaagaggaagaggcgggaguccucugguga

SEQ ID NO: 20105 - RNA, 9876 nt, Artificial Sequence
  derived and/or modified CDS sequence (opt5) from DENV-2__EU482657__SS-prME
agcgccggaaugaucauuaugcugauccccaccgugauggcuuuccaccucacaacgagaaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauuaugcggcaucccggguucaccaucauggccgcuauucuggccuacacaaucggaaccacccacuuucagcgcguucucauuuucauccugcuuacagcuguggccccuuccaugacgaugagaugcauuggcaucucuaaccgggauuuugucgaaggggugagcggaggcuccuggguugacaucgugcuggagcacgggagcugugucaccacaauggcgaagaauaagcccacccucgauuucgaacugauuaaaacagaggccaagcagccugcuacccuucgcaaauauugcaucgaagccaagcugacgaacacaaccaccgagucuagauguccgacacaaggagagcccucccucaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucuggaauacacgauuguggugacaccccacucuggggaggagcaugccgucggaaacgacacaggcaaacacggcaaggaaaucaaagugaccccucaguccagcaucacagaggcggaacucaccggguauggaacgguuaccauggaguguucucccagaacaggccuggauuucaaugaaauggugcuucugcaaauggagaacaaggccuggcucguccaccggcagugguuucuggaccuuccgcugccuuggcuccccggggcugauaagcaggaguccaauuggauucagaaagaaacccuggugacauucaagaacccucaugccaaaaagcaagacguugugguccugggaagccaggagggcgcuaugcacaccgcccucacgggggccacagaaauccagauguccucuggcaaucugcuuuuuaccggacaucugaaaugccgccucagaauggacaagcugcaacuuaagggcaugagcuacuccauguguacagggaaauucaagguggucaaagagauugcugagacccagcacggaaccaucgugauucggguucaguaugaaggcgaugggagccccugcaagauccccuucgagaucauggaccuggagaagcgguacgugcucggacgccugauuacagucaacccuaucgugacggagaaggauucuccgguuaacauugaagcggagcccccuuuuggcgacuccuacaucauuaucgggguggagcccggccagcugaagcucaauugguucaaaaagggaagcucuauuggccaaauguuugaaaccacaaugagaggggccaaaagaauggcuauccugggagauaccgccugggacuucggcagccuugggggagucuuuacauccaucggcaaggcccugcaucagguguucggggcuauuuauggcgccgcguuuucuggagugagcuggaccaugaaaauccucauuggcguuaucauuacguggaucgggaugaacucccgcagcacaucucuguccgucagccuggugcuugugggaaucgucacccucuaccugggcgugaugguucaggcugauucuggguguguggucuccuggaagaauaaggagcugaaaugcggaagcggcauuuucaucaccgacaacgugcacacauggaccgaacaguauaaguuucaaccugagucccccucuaaacucgccagcgccauucagaaggcucaggaagaggggaucuguggcauucgguccguuacaagacuggagaaucuuauguggaaacagaucacgccggaacugaaccacauccucgccgagaaugaagugaagcugaccauuaugacaggagauauccgcggcauuaugcaagcugggaaacggucucugagaccucagcccaccgagcuuaaguacagcuggaagacauggggaaaagccaagaugcucuccaccgaaagcuauaaccagacguuccugaucgacggcccugagaccgcggagugccccaauacaaaccgcgccuggaacucucuggaagucgaggauuacggguuuggaguguucaccacaaacauuuggcucaaacugaaggaaaaacaggacgcuuuuugugacuccaaacuuaugagcgccgcuaucaaggauaaucgggccguucaugcggacaugggcuauuggauggagucugcccugaacgauaccuggaaaaucgagaaggcuuccuucauugaagugaaaaauugccacuggccuaagagccauacacucuggucuaacggcguccuggagagcgaaaugaucauucccaaaaaccuggccgggccggugucccaacacaauuacagaccuggauaccacacccagaucgcuggccccuggcaucuugggaagcucgagauggacuucgauuuuugugacggaacgacagugauugucaccgaagauugcggcaaccgcgggcccagccugcggaccacaaccgccucuggaaagcugaucacggaguggugcuguagauccugcacacucccuccgcugcgguaucgcggcgaggacggcuguugguacgggauggaaauuagaccccuuaaagagaaggaagagaaucugguuaacagccucgugaccgccggacacggccagguggauaauuucucccuggggguccugggaauggcucuuuuucucgaagagaugcugcggacaagagugggcaccaaacaugcgauccugcucguugccgugucuuucgucacacugaucaccgggaacaugagcuuuaaggaccuuggacgcgugguugugauggucggcgcuacgauggccgaugacauuggcaugggggugaccuaucuggcccuccuggcugccuucaaaguucggccuacauuugcggcuggacugcuucugagaaagcucaccuccaaggagcugaugaugacaaccaucggcauugugcuccugucucaaagcacgauccccgaaacaguccuugagcugaccgaugcccucgcccuggggaugauggugcugaaaauugugcgcaauauggaaaaguaccagcuugcugucacaaucauggccauccugugcguuccuaacgcggugauucuccagaaugcuuggaaaguguccuguaccauccuggccgucgugucuguuagcccccuccugcuuaccuccagccagcaaaagacagacuggauuccucuggcccucacgaucaaaggacugaaccccaccgcuauuuuccugacaacccuuucuagaacaaauaagaaacgguccuggccgcugaacgaggccaucauggcugugggcauggucagcauccucgccucuucccugcucaagaaugacauuccuaugaccgggccccugguggcgggaggccuucugacgguuugcuaugugcugacaggccgcagcgccgaucucgaacuggagagagcuaccgacgucaagugggaggaucaggccgaaaucucuggguccagcccuauucuuuccaucaccauuagcgaggacggaucuaugagcaucaaaaacgaagaggaggaacagacacugaccauucucauccggacaggccugcucgugaucuccgggcuguuucccauuucuaucccgauuacggcugccgccugguaccuuugggaggucaagaaacagcgcgcuggagugcugugggauguuccuucucccccucccaugggcaaggcggaacuggaggacggggccuauagaaucaaacaaaagggcauucugggcuacucccagaucggcgcugggguguacaaggaaggaaccuuccacacaauguggcaugucacccggggcgccgugcugaugcacaaagggaagcgcaucgagcccuccugggccgauguuaaaaaggaccuuauuagcuauggaggcggguggaaacuggagggagaauggaaggagggcgaagaggugcagguccucgcucuggaaccuggcaagaauccgagagccgugcagacaaaacccgggcucuuuaagaccaacacgggaaccaucggcgcggugucccuggauuucucuccugggacaagcggaucccccauuaucgacaaaaagggcaaaguugucgggcuuuacggaaacggcguggugacccggagcggcgcuuaugucucugccauugcccaaacagagaaguccaucgaggauaauccugaaaucgaggacgauauuuuucgcaagagacggcugaccaucauggaccugcaccccggggcuggaaaaacaaagagauaccucccugccauugugcgcgaagcgaucaaacggggccugagaacgcuuauucuggcuccgacccgcguuguggccgccgagauggaagaggcucuccgggggcugcccaucagauaucagaccccugccauucgcgcugagcauaccggacgggaaaucgucgaccucaugugucacgccaccuucacaaugagacugcuuagccccgugcgcguuccuaacuacaaucugaucauuauggaugaggcgcauuucacggaccccgccucuaucgcugcccggggcuauauuuccaccagaguggaaaugggggaggcugccggcaucuuuaugacagccaccccgccuggaagccgggaucccuucccccaguccaacgcuccuauuaucgacgaggaacgcgagauccccgaaagaucuuggaauagcggccacgagugggucacagauuuuaaggggaaaaccgugugguucguuccuuccauuaaggcgggaaacgacaucgccgcuugccugcggaagaauggcaaaaaggugauucaacucagccgcaaaacguuugauucugaauacgucaagacaagaaccaacgacugggauuucguggugaccacagacaucuccgagaugggggccaauuuuaaagccgagcgggucauugauccgagacgcuguaugaagcccguuauccugaccgacggagaagaacgggugauccuugcuggcccuaugcccgugacacauagcucugccgcgcagagacgcgggcggauuggcagaaacccuaaaaaugaaaacgaccaguacaucuauaugggagagccccuggaaaaugaugaggacugcgcucacuggaaggaggccaagaugcuccuggauaacauuaauaccccggaaggcaucauuccuagcauguucgagcccgaacgcgagaaagucgacgccaucgauggggaauaccggcugagaggagaggcucgcaagacguuuguggaccucaugagacggggcgaucuuccuguuuggcuggccuauaaaguggcggccgaggggauuaacuacgcugaccgcagaugguguuucgauggaaucaagaacaaucagauccuggaagagaacgucgaaguggagauuuggacaaaagagggcgaacggaagaagcucaaaccccgcuggcuggacgccagaaucuauuccgauccucuugcucugaaggaguuuaaagaguucgccgcugggcggaagucucucacccugaaucugauuacagagaugggcagacuccccaccuucaugacgcagaagacccgcgacgcccuugauaaccuggcgguucugcacacagccgaagcuggaggccgggccuacaaucaugcucucagcgagcugccggagacccuugaaacacugcuccugcugacccuccuugccacagugaccgggggaaucuuucuguuccugauguccggcagagggauuggaaagaugacgcucggcaugugcugcaucaucacagccucuacccugcuuugguaugcucagauucagccucacuggaucgcggccagcauuauccuggaguuuuuccucauuguccugcugauccccgaacccgagaagcagcgcaccccucaagacaaccagcucacauacguggucaucgcuauucuuaccgugguugccgccacaauggcuaaugaaaugggcuuucuggagaaaacgaagaaagaccuggggcucggauccaucgccacccagcagccggagagcaacauucuggauaucgaccuucggcccgcgucugccuggacacuguacgcuguggccaccacauucgugaccccuaugcucagacauuccauugaaaauagcuccgucaacguuucucugacggcuaucgccaaucaagcgaccgugcugaugggccucgggaagggauggccccuuagcaaaauggauauuggcgugccucugcuggccaucggguguuauucccaggucaaccccaucacacucaccgcugcccugcuucugcucguggcucacuacgccauuaucggaccuggccugcaggcuaaggccacacgggaggcgcagaagcgcgccgcugccggcauuaugaaaaauccgaccguugacgggaucacggugauugaucuggaccccaucccuuaugaucccaaguuugaaaaacaacucggacaggucaugcuucugauccugugcgugacacagguccucaugaugagaaccacaugggcucugugugaggcccuuacccuggccaccggcccuauuucuacacucugggaagggaaccccggacgguucuggaauacgaccaucgcggugagcauggcuaacauuuuucgcggcuccuaccuggccggggcuggacuccucuucagcaucaugaagaauacaaccaacacaagacggggcaccggcaacauuggggagacgcuuggagagaaauggaagucucgccugaaugcccugggcaaauccgaauuucaaaucuauaaaaagagcgggauccaggagguugacagaacacucgccaaagaaggaauuaagcggggcgagaccgaucaccaugcugugucucgcggguccgccaaacugagaugguucgucgagcggaacauggugaccccggaaggaaagguuguggaccuuggcugcggcagagggggauggagcuacuauuguggcgggcugaaaaauguccgcgaggugaagggacucacaaagggcgggccuggacacgaagaacccauccccaugucuaccuacggcuggaaccuggugcggcugcagagcggcguugaugucuuuuucauuccucccgaaaaaugcgacacacuccuuugugauaucggggaguccucuccuaauccgacgguggaggcgggaagaacccugcgcgugcugaaccucgucgaaaauuggcugaacaauaacacacaguucugcauuaagguucuuaaucccuacaugccuagcgugaucgagaaaauggaagcccugcaacggaaguauggcggggcucucgugagaaacccccugucccgcaauagcacccaugagauguacugggucuccaacgccucuggaaauaucgugagcuccguuaacaugauuucucggaugcugaucaacagauuuacaaugcgccacaaaaaggcuaccuaugaaccugacguggaccucggcagcgggacgcggaauauuggaaucgaguccgagauucccaaccuugauaucauuggcaagagaaucgagaagaucaagcaggagcaugaagccucuuggcacuacgaccaggaucacccguauaaaaccugggcguaccauggcagcuaugagacaaagcagaccggguccgccagcucuauggucaauggagugguucgccugcugacaaaaccuugggacgugcuccccaccgucacacaaauggcuaugaccgauacgacaccuuucggccagcagcggguguuuaaggaaaagguggacaccagaacccaggagcccaaagaggggacaaagaaacugaugaagauuacggccgaauggcuuuggaaagagcugggaaagaaaaagaccccucgcauguguacaagagaagaguucacccggaagguccgcuccaacgcugcccucggcgcuaucuuuacagaugagaauaaauggaaaagcgccagagaagcgguugaggacucucgguucugggaacugguggauaaagagagaaaccugcaccucgaagggaagugcgagaccuguguguacaauaugaugggaaaacgggagaagaagcugggcgaauuuggcaaagccaaggggucccgcgcuauuugguacauguggcuuggagccagauuccuggaguuugaagcucucggcuuccugaacgaggaccauugguuuagccgggaaaauucucuuuccggggucgagggagagggccugcacaaacucggguauauccugcgcgaugugagcaagaaagaaggcggagccauguacgccgacgacacagcgggcugggauaccagaauuacgcuggaggaccucaagaacgaagagaugguuaccaaucacauggaaggggagcauaagaaacuggcugaggccaucuucaaacuuacauaucaaaacaaagugguccgggugcagcgccccaccccgagaggaacaguuauggauaucauuucccggcgcgaccagagaggcagcgggcaagugggaaccuacggccugaauacguuuacaaacauggaagcccagcucauccggcagauggagggggaaggcgucuucaagaauauucagcaccugaccgugacagaggagguugcugugcauaacuggcuugcccgcgucggaagagaacggcugucucgcauggcuaucagcggcgaugacugcguggucaaaccucucgaugacagauucgccaacgcgcugaccgcccugaaugauauggggaagauucggaaggacauccaacagugggagcccuccaaaggauggaacgauuggacgcagguccccuuuugcucucaccauuuccacgaacucaucaugaaggacggcagaguucugguggucccuugucgcaaucaggaugagcuuauugggcgggcuagaaucagccaaggagccggcuggucccugcgcgaaaccgcuugccucgggaaaucuuaugcccagauguggagccugauguacuuucaccggagagaccuucgccuggcggccaacgcuauuuguuccgccgugccgucucauugggugcccacaagccggaccacaugguccauccacgcuaagcaugaguggaugaccacagaggacaugcucaccguuuggaauagaguguggauucgcgaaaacccuuggauggaggauaaaacgcccgucgaaagcugggaggaaaucccuuaucugggcaagcgggaggaccaguggugcggaucucugauuggccucacauccagagccaccugggcuaagaauauccaggccgcgaucaaccaagugcgcagccugauugggaaugaggaauacaccgauuacaugcccucuaugaaacgguucagacgggaggaagaggaagccggaguucuuugguga

SEQ ID NO: 20106 - RNA, 9876 nt, Artificial Sequence
  derived and/or modified CDS sequence (opt5) from DENV-2__EU482658__SS-prME
agcgccggaaugaucauuaugcugauccccaccgugauggcuuuccaccugaccacgagaaauggggagccucauaugauuguuggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauuguuaccugcgcuauguuuacaugcaagaaaaacauggaaggcaagaucguccagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguuaucgugcucggaagccaggagggcgcuaugcacaccgcccugacgggggccacagaaauucagauguccucuggcaaucuucuguuuaccggacaucucaaaugccgccugagaauggacaaacuucaacugaagggcaugagcuacuccauguguacagggaaauucaaggucgugaaagagaucgcugagacccagcacggaaccauugucauccgggugcaguaugaaggcgaugggagccccugcaagauccccuucgagauuauggaccucgagaagcgguacguucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccacagagugccccaauaccaacagagcguggaacucucucgaaguggaggauuacggguuuggagucuucacaaccaacaucuggcugaaacuuaaagaaaagcaggacgccuuuugugacuccaagcugaugagcgcugccaucaaagauaaucgcgcugugcaugccgacaugggcuauuggauugagucugcgcucaacgauacauggaagaucgagaaagccuccuucauugaaguuaagaauugccacuggccuaaaagccauacccuguggucuaacggcgugcuggagagcgaaaugaucauucccaagaaccuugcugggccggucucccaacacaauuaccggccuggauaccacacgcagaucgccggccccuggcaucucgggaagcuggagauggacuucgauuuuugugacggaacaaccgugauugugaccgaagauugcggcaacagagggcccagccugcgcacaaccacggcuucuggaaaacucaucacagaguggugcugucgguccugcacccugccuccgcuuagauaucggggcgaggacggcuguugguacgggauggaaauccgcccccugaaggagaaagaagagaaucucgucaacagccugguuacagccggacacggccagguggauaauuucucccugggggugcuuggaauggcccucuuucuggaagagaugcugagaacccgggucggcacaaagcaugcuauucuccuggugaccguuucuuucgugacgcuuaucaccgggaacaugagcuuuaaagaccugggaagagucgugguuauggugggcgcgacaauggccgaugacauuggcaugggggucaccuaucucgcucugcuggccgccuucaaggugcgcccuacauuugcugccggacuucugcuccggaagcugaccuccaaagagcucaugaugacgacaaucggcauuguucugcuuucucaaagcaccauccccgaaacagugcuggagcucaccgaugcgcuggcucuggggaugaugguccuuaagaucgugagaaauauggaaaaauaccagcuggccgugaccauuauggccauccucugcgucccuaacgcuguuauucugcagaaugccuggaagguguccuguacaauccucgcgguggucucugugagcccccugcuucugacguccagccagcagaagaccgacuggauuccucucgcucugacaaucaagggacugaaccccaccgccaucuuccuuacaacccugucucgcacgaauaaaaagagauccuggccgcucaacgaggccauuauggcuguuggcauggugagcauccuggccucuucccuccugaagaaugacauuccuaugacagggccccuugucgcuggaggccugcugaccgugugcuauguucucaccggccggagcgccgaucuggaacuugagcgcgcgacagacgugaaaugggaggaucaggccgaaaucucuggguccagcccuauucuguccaucaccauuagcgaggacggaucuaugagcaucaagaacgaagaggaggaacagacacucacgauccugauuagaaccggccuccuggucaucuccgggcuuuuucccauuucuaucccgauuacagcugccgcuugguaccugugggaggugaaaaagcagcgggccggaguccugugggaugugccuucucccccucccaugggcaaagccgaacucgaggacggggcuuaucgcaucaagcaaaagggaauccugggcuacucccagauuggcgcggggguuuacaaagaaggaaccuuccacacaauguggcaugugaccagaggcgccguccuuaugcacaaggggaaacggaucgagcccuccugggcugaugugaagaaagaccugauuagcuauggaggcggguggaagcucgagggagaauggaaggagggcgaagagguucaggugcuggcccucgaaccuggcaaaaauccgcgcgccguccagacgaagcccgggcuguuuaaaaccaacacaggaaccaucggcgcugugucccuugauuucucuccugggacaagcggaucccccauuaucgacaagaaaggcaaggugguugggcuguacggaaacggcgucgugaccagaagcggcgccuaugugucugcgaucgcucaaacagagaaguccauugaggauaauccugaaaucgaggacgauauuuuucggaaacgcagacugacgaucauggaccuccaccccggggccggaaagaccaaacgguaccugccugccauugucagagaagcuaucaagcgcggccuucggacacugauucucgccccgaccagagugguugcggcugagauggaagaggcccugcgcgggcuccccauccgguaucagaccccugccaucagagcugagcauacaggacgcgaaauuguggaccugaugugucacgccacguucaccaugcggcuucugagccccgucagagugccuaacuacaaucugaucauuauggaugaggcucauuucacagaccccgccucuaucgcggcccgcggcuauauuuccacccggguugaaaugggggaggcugccggcaucuuuaugacagcuaccccgccuggaagcagagaucccuucccccaguccaacgccccuaucauugacgaggaacgggagauccccgaacgcucuuggaauagcggccacgagugggugacggauuuuaaagggaagacagucugguucgugccuuccauuaaggccggaaacgacaucgcugcgugccuccgcaaaaauggcaagaaaguuauucaacugagccggaagaccuuugauucugaauacgugaaaacccgcacaaacgacugggauuucgucgugaccacagacaucuccgagaugggggccaauuuuaaggcugagagagugaucgauccgcggagauguaugaaacccgucauucuuaccgacggagaggaacgcguuauccuggccggcccuaugcccgugacgcauagcucugccgcucagcggagagggcgcauuggccggaacccuaagaaugaaaacgaccaguacaucuauaugggagagccccucgaaaaugaugaggacugcgcccacuggaaggaggcgaaaaugcugcuggauaacauuaauacaccggaaggcaucauuccuagcauguucgagcccgaaagagagaagguggacgcuaucgauggggaauaccgccuccggggagaggccagaaaaaccuuugucgaccuuaugcgcagaggcgaucugccuguguggcuggccuauaagguugcugccgaggggaucaacuacgcggaccggcgcugguguuucgauggaauuaaaaacaaucagauccucgaagagaacguggaagucgagauuuggacaaaggagggcgaaagaaagaaacugaagccccgguggcuugacgcccgcaucuauuccgauccucuggcucucaaagaguuuaaggaguucgccgcugggagaaaaucucugacccugaaucucauuacggagaugggccggcuucccaccuucaugacacaaaagaccagagacgcccuggauaaccuggcugugcuccacacagccgaagcgggaggccgcgccuacaaucaugcucugagcgagcuuccggagacccuggaaacacuccugcugcucacccuucuggccacgguuacagggggaaucuuucuguuccucauguccggccgggggaucggaaagaugacccugggcaugugcugcauuaucaccgcuucuauucuucugugguaugcccagauccagccucacuggauugccgcuagcaucauccucgaguuuuuccugauugugcugcucauccccgaacccgagaaacagagaacaccucaagacaaccagcuuaccuacgucgugauugcgauccugacagucguggccgcuacgauggccaaugaaaugggcuuucuggagaagaccaaaaaggaccucgggcugggauccauugccacacagcagccggagagcaacauccuugauauugaccugcgccccgcuucugccuggacccucuacgcgguugccacaaccuucgugacgccuaugcugcggcauuccaucgaaaauagcuccgugaacgucucucugaccgcuaucgccaaucaagcuacaguucucaugggccuugggaaaggauggccccugagcaagauggauauuggcgugccucugcucgccaucggguguuauucccaggugaaccccauuacccugacagcggcccuucugcuccuggucgcucacuacgccaucauuggaccuggccugcaggcuaaggccaccagagaggcucagaaacgggccgcggccggcaucaugaagaauccgacgguggacgggaucacaguuauugaucucgaccccaucccuuaugaucccaaauuugaaaagcaacuuggacaggugaugcugcugauucucugcgucacccaggugcugaugaugcgcacaaccugggcucuuugugaggcccugacccucgcuacaggcccuaucucuacgcugugggaagggaaccccggaagauucuggaauaccacaauugccgucagcauggccaacaucuuucggggcuccuaccuggcgggggcuggacuccuuuucagcaucaugaaaaauaccacaaacacccgcagaggcacgggcaacauuggggagacacugggagagaaguggaaaucucggcugaaugcccucggcaaguccgaauuucaaaucuauaagaaaagcgggauucaggagguggaccgcacccuggcuaaggaaggaaucaaaagaggcgagaccgaucaccaugccguuucucggggguccgccaaacuucgcugguucguggagagaaacauggucacaccggaaggaaaagugguugaccugggcugcggcagagggggauggagcuacuauuguggcgggcucaagaaugugcgggaggucaagggacugaccaaaggcgggccuggacacgaagaacccauucccaugucuacauacggcuggaaccuggugcgccuccagagcggcguggaugucuuuuucaucccucccgaaaagugcgacacgcuucugugugauaucggggaguccucuccuaauccgaccgucgaggcuggacggacacugagagugcucaaccugguggaaaauuggcuuaacaauaacacccaguucugcauuaaaguccugaaucccuacaugccuagcguuaucgagaagauggaagcccuccaacgcaaauauggcggggcgcuggugcggaacccccuguccagaaauagcacacaugagauguacuggguguccaacgccucuggaaauauugucagcuccgugaacaugaucucucgcaugcucauuaaccgguuuaccaugagacacaagaaggcuacguaugaaccugacguugaccuuggcagcgggacccgcaauaucggaauugaguccgagauccccaaccuggauaucauuggcaaacggaucgaaaagauuaaacaggagcaugaaacaucuuggcacuacgaccaggaucacccguauaagaccugggccuaccauggcagcuaugagacaaaacagaccggguccgcuagcucuauggugaauggagucgugagacugcucacaaagccuugggacguucugcccaccgugacgcaaauggccaugacagauaccaccccuuucggccagcagcgcgucuuuaaggaaaaaguggacacacggacgcaggagcccaaggaggggaccaagaaacuuaugaaaaucacagcggaauggcuguggaaagagcucggcaagaagaagaccccuagaauguguacacgcgaagaguucaccagaaaagugcgguccaacgccgcucugggcgccauuuuuacagaugagaauaaguggaaaagcgcucgcgaagccgucgaggacucuagauucugggaacugguugauaaggagcggaaccuccaccuggaagggaaaugcgagaccuguguguacaauaugaugggaaagagagagaagaaacuuggcgaauuuggcaaggcuaaagggucccgggccaucugguacauguggcugggagcgcgcuuccucgaguuugaagcccugggcuuccuuaacgaggaccauugguuuagcagagaaaauucucuguccgggguggagggagagggccuccacaagcugggguauauccugcgggaugucagcaaaaaggaaggcggagcuauguacgccgacgacacggcuggcugggauacccgcauuacacucgaggaccugaagaacgaagagauggugaccaaucacauggaaggggagcauaagaaacuugccgaggccaucuucaaacugacauaucaaaacaaaguugugagaguccagcggcccaccccgcgcggaacggugauggauauuaucuccagacgggaccagcgcggcagcgggcaaguuggaacauacggccucaauaccuuuacaaacauggaagcgcagcugauuagacagauggagggggaaggcguguucaaaaauauccagcaccuuaccgucacggaggagguggcuguucaaaacuggcuggcccgggugggacgcgaaagacucucucggauggccaucagcggcgaugacugcgucgugaagccucuggaugaccgcuucgcuaacgcccugaccgcucucaaugauauggggaagauuagaaaagacauccagcagugggagcccuccaagggauggaacgauuggacacagguccccuuuugcucucaucacuuccaugaacugauuaugaaagacggccgggugcuuguugugccuuguagaaaucaagaugagcugaucgggcgcgcccggauuagccagggagcgggcuggucccucagagaaaccgccugccuggggaagucuuaugcucagauguggagccuuauguacuuucaccgccgggaccugagacucgccgcuaacgccaucuguuccgcggucccgucucacugggugcccacaagccgcaccacaugguccauucaugccaaacacgaguggaugaccacggaggacaugcugacaguguggaaucggguuuggaucagagauaacccuuggauggaagacaagacccccguggagagcugggaagagaucccuuaucugggcaagcgcgaagaucaguggugcggaucucucauuggccugaccucccgggcuacaugggccaaaaauauccaagcugccauuaaccaggucagaagccuuaucgggaaugaggaguacaccgacuacaugcccucuaugaagcgcuuccggagagaagaggaagaggcuggagugcugugguga

SEQ ID NO: 20107 - RNA, 9876 nt, Artificial Sequence
  derived and/or modified CDS sequence (opt5) from DENV-2__EU482659__SS-prME
agcgccggaaugaucauuaugcugauccccaccgucauggcuuuccaccugaccacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggcuaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccacagagugccccaauaccaacagagcguggaacucucucgaagucgaggauuacggguuuggaguguucacaaccaacauuuggcugaaacuuaaagaaaagcaggacgccuuuugugacuccaagcugaugagcgcugccaucaaagauaaucgcgcuguucaugccgacaugggcuauuggaucgagucugcgcucaacgauacauggaagauugagaaagccuccuucaucgaagugaagaauugccacuggccuaaaagccauacccuguggucuaacggcguccuggagagcgaaaugauuauccccaagaaccuugcugggccggugucccaacacaauuaccggccuggauaccacacgcagauugccggccccuggcaucucgggaagcuggagauggacuucgauuuuugugacggaacaaccgugaucgucaccgaagauugcggcaacagagggcccagccugcgcacaaccacggcuucuggaaaacucauuacagaguggugcugucgguccugcacccugccuccgcuuagauaucggggcgaggacggcuguugguacgggauggaaauccgcccccugaaggagaaagaagagaaucucguuaacagccuggugacagccggacacggccagguggauaauuucucccuggggguccuuggaauggcccucuuucuggaagagaugcugagaacccgggugggcacaaagcaugcuauccuccugguugcggugucuuucgucacccuuauuacggggaacaugagcuuuaaagaccugggaagagugguugugauggucggcgccaccauggcugaugacaucggcaugggggugacauaucucgcccugcuggccgcuuucaagguucgcccuaccuuugccgcgggacuucugcuccggaagcugacauccaaagagcucaugaugaccacgauuggcaucgugcugcuuucucaaagcacaauucccgaaaccguccuggagcucacagaugcucuggcccuggggaugauggugcuuaagaucgugagaaauauggaaaaauaccagcuggccgucaccaucauggcuauucucugcguuccuaacgccgugauccugcagaaugcguggaagguguccuguaccauucucgcugucgugucuguuagcccccugcuucugacauccagccagcagaagacggacuggaucccucucgcccugaccauuaagggacugaaccccacagccaucuuccuuaccacacugucucgcaccaauaaaaagagauccuggccgcucaacgaggcuaucauggccgugggcauggucagcauucuggcuucuucccuccugaagaaugacaucccuaugacggggccccuuguggccggaggccugcugacaguuugcuaugugcucaccggccggagcgcggaucuggaacuugagcgcgccaccgacgucaaaugggaggaucaggcugaaauuucuggguccagcccuauccuguccauuacaaucagcgaggacggaucuaugagcauuaagaacgaagaggaggaacagacccucacaauccugaucagaacgggccuccuggugauuuccgggcuuuuucccaucucuauuccgaucaccgccgcugccugguaccugugggaggucaaaaagcagcgggccggagugcugugggauguuccuucucccccucccaugggcaaagcugaacucgaggacggggcguaucgcauuaagcaaaagggaauccugggcuacucccagaucggcgccgggguguacaaagaaggaacauuccacaccauguggcaugucacaagaggcgcugugcuuaugcacaaggggaaacggauugagcccuccugggccgauguuaagaaagaccugaucagcuauggaggcggguggaagcucgagggagaauggaaggagggcgaagaggugcagguccuggcccucgaaccuggcaaaaauccgcgcgcugugcagaccaagcccgggcuguuuaaaacgaacaccggaacaauuggcgccgugucccuugauuucucuccugggaccagcggaucccccaucauugacaagaaaggcaagguugucgggcuguacggaaacggcguggugacaagaagcggcgcguaugucucugcuaucgcccaaaccgagaaguccaucgaggauaauccugaaauugaggacgauaucuuucggaaacgcagacugacaauuauggaccuccaccccggggccggaaagacgaaacgguaccugccugcuaucgugagagaagccauuaagcgcggccuucggacccugauccucgcgccgacaagaguuguggcugccgagauggaagaggcccugcgcgggcuccccauucgguaucagaccccugcuaucagagccgagcauaccggacgcgaaaucgucgaccugaugugucacgcuacauucacgaugcggcuucugagccccgugagaguuccuaacuacaaucugauuaucauggaugaggcccauuucaccgaccccgcgucuauugccgcucgcggcuauaucuccacacggguggaaaugggggaggccgcuggcauuuuuaugaccgccacaccgccuggaagcagagaucccuucccccaguccaacgccccuaucaucgacgaggaacgggagauucccgaacgcucuuggaauaccggccacgagugggucacggauuuuaaagggaagacagugugguucguuccuagcaucaaggcuggaaacgacauugcggccugccuccgcaaaaauggcaagaaagugauccaacugucccggaagaccuuugauagcgaauacgucaaaacccgcacaaacgacugggauuucguggugaccacagacauuucugagaugggggcuaauuuuaaggccgagagagucaucgauccgcggagauguaugaaacccguuauccuuaccgacggagaggaacgcgugauucuggccggcccuaugcccgugacgcauuccagcgcugcccagcggagagggcgcaucggccggaacccuaagaaugaaaacgaccaguacauuuauaugggagagccccucgaaaaugaugaggacugcgcgcacuggaaggaggcuaaaaugcugcuggauaacaucaauacaccggaaggcauuaucccuucuauguucgagcccgaaagagagaaggucgacgccauugauggggaauaccgccuccggggagaggccagaaaaaccuuuguggaccuuaugcgcagaggcgaucugccuguuuggcuggcuuauaagguggccgcggaggggaucaacuacgccgaccggcgcugguguuucgauggaaucaaaaacaaucagauucucgaagagaacgucgaaguggagaucuggacaaaggagggcgaaagaaagaaacugaagccccgguggcuugacgcucgcauuuauagcgauccucuggcccucaaagaguuuaaggaguucgcugccgggagaaaaucccugacccugaaucucaucacggagaugggccggcuucccaccuucaugacacaaaagaccagagacgcucuggauaaccuggccguucuccacacagcggaagccggaggccgcgcuuacaaucaugcccugucugagcuuccggagacccuggaaacacuccugcugcucacccuucuggcuacggugacagggggaauuuuucuguuccucaugagcggccgggggaucggaaagaugacccugggcaugugcugcaucauuaccgccuccauccuucugugguaugcccagauucagccucacuggaucgcugcgucuauuauccucgaguuuuuccugaucguccugcucauucccgaacccgagaaacagagaacaccucaagacaaccagcuuaccuacguggucaucgccauucugacagugguugcugccacgauggccaaugaaaugggcuuucuggagaagaccaaaaaggaccucgggcugggaagcaucgcuacacagcagccggaguccaacauucuugauaucgaccugcgccccgccagcgcguggacccucuacgccguggcuacaaccuucgugacgccuaugcugcggcauucuauugaaaauuccagcgucaacguuucccugaccgccaucgcuaaucaagccacagugcucaugggccuugggaaaggauggccccugucuaagauggauaucggcgugccucugcucgcgauuggguguuauagccaggucaaccccaucacccugacagccgcccuucugcuccugguggcccacuacgcuauuaucggaccuggccugcaggccaaggcuaccagagaggcccagaaacgggcggccgcuggcauuaugaagaauccgacgguugacgggaucacagugaucgaucucgaccccauuccuuaugaucccaaauuugaaaagcaacuuggacaggucaugcugcugauccucugcgugacccagguccugaugaugcgcacaaccugggcccuuugugaggcucugacccucgccacaggcccuauuuccacgcugugggaagggaaccccggaagauucuggaauaccacaaucgccgugucuauggcgaacauuuuucggggcagcuaccuggcuggggccggacuccuuuucuccaucaugaaaaauaccacaaacacccgcagaggcacgggcaacaucggggagacacugggagagaaguggaaaagccggcugaaugcucucggcaagucugaauuucaaauuuauaagaaauccgggauccaggagguugaccgcacccuggccaaggaaggaauuaaaagaggcgagaccgaucaccaugccgugagccgggggucugcuaaacuucgcugguucgucgagagaaacauggugacaccggaaggaaaaguuguggaccugggcugcggcagagggggaugguccuacuauuguggcgggcucaagaauguccgggaggugaagggacugaccaaaggcgggccuggacacgaagaacccauccccaugagcacauacggcuggaaccuggugcgccuccagucuggcguugaugucuuuuucauuccucccgaaaagugcgacacgcuucugugugauaucggggagagcuccccuaauccgaccguggaggccggacggacacugagagugcucaaccuggucgaaaauuggcuuaacaauaacacccaguucugcaucaaaguucugaaucccuacaugccuucugugauugagaagauggaagcgcuccaacgcaaacauggcggggcccuggugcggaacccccugagcagaaauuccacacacgagauguauugggucagcaacgcuuccggaaauaucgugucuagcguuaacaugauuucccgcaugcucaucaaccgguuuaccaugagacauaagaaggccacguacgaaccugacguggaccuuggcucugggacccgcaauauuggaaucgagagcgagauucccaaccuggauaucaucggcaaacggauugaaaagaucaaacaggagcacgaaacauccuggcacuaugaccaggaucauccguacaagaccugggcuuaucacggcucuuacgagacaaaacagaccgggagcgccuccagcauggucaauggagugguuagacugcucacaaagccuugggacgugcugcccaccgucacgcaaauggcgaugacagauaccaccccuuucggccagcagcgcguguuuaaggaaaaaguggacacacggacgcaggagcccaaggaggggaccaagaaacuuaugaaaauuacagccgaauggcuguggaaagagcucggcaagaagaagaccccuagaauguguacacgcgaagaguucaccagaaaaguccggucuaacgcugcccugggcgcuaucuuuacagaugagaauaaguggaaauccgcccgcgaagcuguugaggacagcagauucugggaacugguggauaaggagcggaaccuccaucuggaagggaaaugcgagaccuguguguauaauaugaugggaaagagagagaagaaacuuggcgaauuuggcaaggccaaagggucucgggcgauuugguacauguggcugggagcccgcuuccucgaguuugaagcucugggcuuccuuaacgaggaccacugguuuuccagagaaaauagccugucuggggucgagggagagggccuccacaagcugggguacauccugcgggauguguccaaaaaggaaggcggagccauguaugcugacgacacggccggcugggauacccgcaucacacucgaggaccugaagaacgaagagaugguuaccaaucauauggaaggggagcacaagaaacuugccgaggcgauuuucaaacugacauaccaaaacaaaguggucagagugcagcggcccaccccgcgcggaacgguuauggauaucauuagcagacgggaccagcgcggcuccgggcaagugggaacauauggccucaauaccuuuacaaacauggaagcucagcugaucagacagauggagggggaaggcgucuucaaaaauauucagcaucuuaccgugacggaggagguugccgugcaaaacuggcuggcccgggucggacgcgaaagacucagccggauggcuaucucuggcgaugacugcguggucaagccucuggaugaccgcuucgccaacgcucugaccgcccucaaugauauggggaagaucagaaaagacauucagcagugggagcccagcaagggauggaacgauuggacacaggugcccuuuugcucccaccauuuccacgaacugaucaugaaagacggccggguucuuguggucccuuguagaaaucaagaugagcugauugggcgcgcgcggaucucucagggagccggcuggagccucagagaaaccgcuugccuggggaaguccuacgcccagauguggucucuuauguauuuucaccgccgggaccugagacucgcugccaacgcgauuuguagcgccgugccgucccauugggugcccacaucucgcaccacauggagcauccacgcuaaacaugaguggaugaccacggaggacaugcugacaguuuggaaucggguguggauuagagaaaacccuuggauggaggauaagacccccgucgaauccugggaggaaaucccuuaccugggcaagcgcgaggaccaguggugcggaagccucaucggccugaccucucgggccacaugggcuaaaaauauucaagccgcuaucaaccaggugagaucccuuauuggggaugaggaauauaccgacuacaugcccagcaugaagcgcuuccggagagaggaagaggaagccggaguucugugguga

SEQ ID NO: 20108 - RNA, 9876 nt, Artificial Sequence
  derived and/or modified CDS sequence (opt5) from DENV-2__EU482661__SS-prME
agcgccggcaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagacggacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugagggggacaucuuucggaaacgcagacugaccauuauggaucuccaccccggagcuggcaagacaaaacgguaccugccugccaucgugagagaagcgauuaagcgcgggcuucggacgcugauccucgcuccgaccagaguuguggccgccgagauggaagaggcucugcgcggacuccccauucgguaucagaccccugccaucagagcugagcauaccggccgcgaaaucgucgaccugaugugucacgccaccuucacaaugcggcuucugagccccgugagaguuccuaacuacaaucugauuaucauggacgaggcgcauuucacggaucccgccucuauugcugcccgcggguauaucuccacccggguggaaaugggcgaggcugccggaauuuuuaugacagccaccccgccuggcagcagagaccccuucccccaguccaacgcuccuaucaucgaugaggaacgggagauucccgaacgcucuuggaauagcgggcacgagugggucacagacuuuaaaggaaagaccgugugguucguuccuuccaucaaggcgggcaacgauauugccgcuugccuccgcaaaaaugggaagaaagugauccaacugagccggaagacguuugacucugaauacgucaaaacacgcaccaacgauugggacuucguggugaccacagauauuuccgagaugggagccaauuuuaaggccgagagagucaucgacccgcggagauguaugaaacccguuauccuuaccgauggcgaggaacgcgugauucuggcugggccuaugcccgugacacauagcucugccgcgcagcggagaggccgcaucggacggaacccuaagaaugaaaacgaccaguacauuuauaugggcgagccccucgaaaaugacgaggauugcgcucacuggaaggaggccaaaaugcugcuggacaacaucaauaccccggaagggauuaucccuagcauguucgagcccgaaagagagaaggucgaugccauugacggagaauaccgccuccggggcgaggcuagaaaaacguuuguggaucuuaugcgcagaggggaccugccuguuuggcuggccuauaagguggcggccgagggaaucaacuacgcugaucggcgcugguguuucgacggcaucaaaaacaaucagauucucgaagagaacgucgaaguggagaucuggacaaaggagggggaaagaaagaaacugaagccccgguggcuugaugcccgcauuuauuccgacccucuggcucucaaagaguuuaaggaguucgccgcuggcagaaaaucucugacccugaaucucaucacagagaugggacggcuucccaccuucaugacgcaaaagaccagagaugcccuggacaaccuggcgguucuccacacagccgaagcuggcgggcgcgccuacaaucaugcucugagcgagcuuccggagacccuggaaacacuccugcugcucacccuucuggccacagugaccggaggcauuuuucuguuccucauguccgggcggggaaucggcaagaugacgcugggcaugugcugcaucauuacagccucuauccuucugugguaugcucagauucagccucacuggaucgcggccagcauuauccucgaguuuuuccugaucguccugcucauucccgaacccgagaaacagagaaccccucaagauaaccagcuuaccuacguggucaucgcuauucugacagugguugccgccaccauggcuaaugaaaugggguuucuggagaagaccaagaaggaccucggacugggcuccaucgccacgcagcagccggagagcaacauucuugacaucgaucugcgccccgcgucugccuggacccucuacgcuguggccacaaccuucgugacaccuaugcugcggcauuccauugaaaauagcuccgucaacguuucucugaccgcuaucgccaaucaagcgacggugcucauggggcuuggaaaaggcuggccccugagcaagauggacaucggggugccucugcucgccauuggauguuauucccaggucaaccccaucacccugacagcugcccuucugcuccugguggcucacuacgccauuaucggcccuggccugcaggcuaaggccaccagagaggcgcagaaacgggccgcugccgggauuaugaagaauccgacaguugauggaaucaccgugaucgaccucgaucccauuccuuaugaccccaaauuugaaaagcaacuuggccaggucaugcugcugauccucugcgugacgcagguccugaugaugcgcacaaccugggcucuuugugaggcccugacacucgccaccgggccuauuucuacccugugggaaggaaaccccggcagauucuggaauacaacgaucgcggugagcauggcuaacauuuuucggggguccuaccuggccggagcuggccuccuuuucagcaucaugaaaaauaccacaaacacccgcagaggcacagggaacaucggagagacccugggcgagaaguggaaaucucggcugaaugcccucgggaaguccgaauuucaaauuuauaagaaaagcggaauccaggagguugaucgcacgcuggccaaggaaggcauuaaaagaggggagacagaccaccaugcugugucucggggauccgccaaacuucgcugguucgucgagagaaacauggugaccccggaaggcaaaguuguggaucugggcugcgggcggggaggcuggagcuacuauugugggggacucaagaaugucagagaggugaagggccugaccaaagggggaccuggccacgaagaacccauccccaugucuacauacggcuggaaccuggugcgccuccagagcgggguugacgucuuuuucauuccucccgaaaagugcgauacccuucugugugacaucggagaguccucuccuaauccgacaguggaggcgggccggacgcugagagugcucaaccuggucgaaaauuggcuuaacaauaacacccaguucugcaucaaaguucugaaucccuacaugccuagcgugauugagaagauggaagcccuccaacgcaaauaugggggagcucuggugcggaacccccuguccagaaauagcacacaugagauguacugggucuccaacgccucuggcaauaucgugagcuccguuaacaugauuucucgcaugcucaucaaccgguuuaccaugagacacaagaaggcuacauaugaaccugauguggaccuugggagcggaacccgcaauauuggcaucgaguccgagauucccaaccuggacaucaucggcaaacggauugaaaagaucaaacaggagcaugaaacgucuuggcacuacgaucaggaccacccguauaagaccugggccuaccaugggagcuaugagacaaaacagaccggauccgcgagcucuauggucaauggcgugguuagacugcucacaaagccuugggaugugcugcccaccgucacacaaauggccaugaccgacacgacaccuuucgggcagcagcgcguguuuaaggaaaaaguggauacccggacccaggagcccaaggagggaaccaagaaacuuaugaaaauuacggcugaauggcuguggaaggagcucggcaaaaagaagaccccuagaauguguacacgcgaagaguucaccagaaaaguccgguccaacgccgcucugggggccaucuuuacagacgagaauaaguggaaaagcgcucgcgaagccguugaggauucuagauucugggaacugguggacaaggagcggaaccuccaccuggaaggaaaaugcgagaccuguguguacaauaugaugggcaagagagagaagaaacuuggcgaauuugggaaggcgaaaggaucccgggccauuugguacauguggcugggcgcucgcuuccucgaguuugaagcccugggguuccuuaacgaggaucauugguuuagcagagaaaauucucuguccggagucgagggcgaggggcuccacaagcugggcuauauccugcgggacgugagcaaaaaggaaggaggcgcuauguacgccgaugacacagccgggugggacacccgcaucacgcucgaggaucugaagaacgaagagaugguuaccaaucacauggaaggagagcauaagaaacuugcggaggcuauuuucaaacugacauaucaaaacaaaguggucagagugcagcggcccaccccgcgcggcacaguuauggacaucauuuccagacgggaucagcgcgggagcggacaagugggcaccuacgggcucaauacguuuacaaacauggaagcccagcugaucagacagauggagggcgaaggagucuucaaaaauauucagcaccuuaccgugacagaggagguugccgugcaaaacuggcuggcucgggucggccgcgaaagacucucucggauggccaucagcggggacgauugcguggucaagccucuggacgaucgcuucgcuaacgcccugaccgcgcucaaugacaugggaaagaucagaaaagauauucagcagugggagcccuccaagggcuggaacgacuggacacaggugcccuuuugcucucaucacuuccaugaacugaucaugaaagaugggcggguucuuguggucccuuguagaaaucaagacgagcugauuggacgcgcccggaucagccagggcgcuggguggucccucagagaaaccgccugccugggcaagucuuaugcucagauguggagccuuauguacuuucaccgccgggaucugagacucgccgcgaacgccauuuguuccgcugugccgucucacugggugcccacaagccgcaccacaugguccauccaugccaaacacgaguggaugaccacagaggacaugcugaccguuuggaaucggguguggauuagagaaaacccuuggauggaggacaagacgcccgucgaaagcugggaggaaaucccuuaucugggaaagcgcgaggaucaguggugcggcucucucaucgggcugacaucccgggcuaccugggccaaaaauauucaagcugccaucaaccaggugagaagccuuauuggaaaugaggaauacaccgacuacaugcccucuaugaagcgcuuccggagagaggaagaggaagcgggcguucugugguga

SEQ ID NO: 20109 - RNA, 9876 nt, Artificial Sequence
  derived and/or modified CDS sequence (opt5) from DENV-2__EU482662__SS-prME
accgccggagugaucauuaugcugauccccacagcuauggccuuccaccucacgaccagaaauggggagccucauaugauugucggacggcaggaaaagggaaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagaaggcccugauuuucauccuucugacggcgguugccccuagcaugaccaugagaugcauuggcaucuccaaccgggauuuuguggaaggggucucuggaggcagcuggguggacaucguucucgagcacggguccugugugacaaccauggcuaagaauaaacccacacuggauuucgaacuuauuaagaccgaggccaaacagccugcuacgcugcgcaaguauugcaucgaagccaaacucacaaacaccaccacagagagcagauguccgacccaaggagagcccucucugaaugaagaacaggacaagcgguuugucugcaagcauuccaugguggaucgcggcuggggcaacggguguggacuguucggcaaagggggaauugugacaugcgcgauguuuacgugcaagaaaaauauggaaggcaagaucguccagccugagaaccucgaauacaccauuguuaucacaccccacagcggggaggagcaugccgugggaaaugacaccggcaaacacggcaaggaaaucaaaauuacaccucagucuuccaucaccgaggcugaacugacgggguauggaaccgugacaauggaguguagccccagaaccggccuugauuucaacgaaaugguccugcuccaaauggaggacaaggccuggcuggugcaccggcagugguuucuugaucugccgcucccuuggcugcccggggcugacacacagggaucuaauuggauucagaaggagacccugguuacguucaaaaacccucaugccaagaaacaagacguggucgugcucggcucccaggaaggggccaugcacacagcucugaccggcgcgacagagauccagaugagcuccggaaaucuucuguuuaccggccaucucaagugccgccugagaauggauaaacuucaacugaaggggaugucuuacagcauguguaccggaaaguucaaaauuguuaaggaaaucgccgagacacagcacggcacgaucgugauucggguccaguaugagggggacggaucccccugcaaaauccccuucgaaauuauggaucucgagaagagacaugugcugggccgccugaucaccgucaacccuauugugacagaaaaagacagcccgguuaacaucgaggcugaacccccuuuuggggauucuuacauuaucaucggcguggagcccggacagcucaagcugaauugguucaagaaaggcuccagcauugggcaaauguuugagaccacaaugcggggagccaagagaauggccauccuuggcgacaccgcuugggauuucgggucucugggaggcgucuuuacgagcauugggaaagcccuccaccagguguucggcgcgaucuacggagcugccuuuuccggcguuucuuggacaaugaagauucugaucggggccaucauuaccuggaucggaaugaacagccgcuccaccagccugucugugucccuuguccucgugggcgugauuacacuguaucugggggcuaugguucaggccgacagcggaugugucgugucuuggaaaaauaaggaacucaagugcggcuccgggaucuucauuaccgauaacgugcacacauggacggagcaguacaaauuucaaccugaaagccccuccaagcuggcuucugccauccagaaagcgcaugaggaaggcaucuguggcauucggagcgucaccagacuugagaaucugauguggaagcagaucacaccggagcucaaccacauucuguccgaaaaugaggugaaacugaccaucaugacaggcgacauuaaggggaucaugcaggccggaaaacgcucucuucggccucaacccaccgaacucaaguauagcuggaagacguggggcaaagcuaagaugcuguccaccgagagccauaaccagacauuccugaucgaugggccugaaaccgccgagugccccaauacaaacagagcuuggaacucucucgagguugaagacuacggauuuggcguguucaccacaaacauuuggcugaaacuucgcgagaagcaggacgucuuuugugauuccaaacugaugagcgccgcgaucaaggacaaucgggccgugcacgcugauaugggcuauuggauugaaucugcccucaacgacaccuggaagauggagaaggcuuccuucaucgagguuaagagcugccacuggccuaaaucucauacgcuguggagcaauggggugcuggaauccgagaugauuauccccaagagcuucgccggaccggucucucagcacaacuacagaccuggcuauuacacacaaaccgccgggcccuggcaucuuggaaaacucgaaauggauuuugacuucugugagggcaccacagugguugugaccgaagauugcgggaaccgcggacccucccugcggacgacaaccgcuagcggcaagcugauuacagaguggugcuguagauccugcacccucccuccgcugcgguaccgcggcgaggacggguguugguauggaauggaaaucagaccccuuaaggagaaagaagagaaucuggucaacucucucgugacagcgggccacgggcagaucgauaauuuuagccugggagugcugggcauggcccuuuuccucgaagagaugcugcggaccagagucgggacgaagcaugcuauucugcucguugccguguccuuuaugacccugaucacaggaaacaugucuuuccgcgaccuuggccgggugauggucauggugggcgccaccaugacagaugacauugggaugggaguuaccuaccuggcucuccuggccgcguuuaaagugagaccuacguucgcugccggccugcuucugcgcaagcucacaagcaaagagcugaugauggccaccaucgggauugcucuccugucccagucuacaauccccgaaaccauccuugagcugaccgaugcccucgcgcugggaaugaugguccugaagauugugagaaauauggaaaaguaucaacuugcuguuacaaucauggccauuagcugcgugccuaacgccgucauccugcagaaugcuuggaaaguguccuguacgauucucgccgcuguuagcgugucuccccugcuccugaccuccagccagcagaaggccgacuggaucccucuugcgcugacaaucaaaggccucaaccccaccgccauuuuucugacaacccugucucggacguccaagaaacgcagcuggccgcuuaaugaggcuaucauggccgucgggauggugucuauucuggcuuccagccuccugaagaacgacaucccuaugacaggaccccucguggccggcggccugcuuaccgucugcuacguucugaccgggagauccgccgaucuggaacucgagcgggcuacagacgugaaaugggaggaucaagcggaaauuagcggaucuagcccuauccuguccauuaccaucucugaggacggcagcauguccaucaagaaugaagaggaggaacagacacuuacgauucugauccgcaccgggcuccuggugauuucuggacucuuccccgucagcaucccgauuacagccgcugccugguaucugugggaggugaagaaacagagagccggcguucuuugggaugugccuucucccccucccgucgggaaggcugaacuggaggacggagccuaccggaucaaacagaagggcauccugggcuauagccaaauuggggcgggaguguacaaagaaggcaccuuucacacaauguggcacguuacccgcggggcugugcucaugcauagaggaaagcggaucgagcccagcugggccgaugucaagaaagaccugauuuccuacggcgggggauggaaacuugagggcgaauggaaagagggcgaagaggugcagguccuggcccucgaaccugggaagaacccgcgcgcugugcagacgaaacccggacuguucaagaccaauacaggcaccaucggggccguuagccucgauuuuucuccuggaacauccggcagccccauuguggacagaaaggggaaagucgugggacuguauggcaacggcguugugacccggucuggggcguacgucuccgcuaucgcccagacagaaaagagcaucgaggauaauccugaaauugaggacgauaucuuccgcaagaagcgccuuacgauuauggaccugcaccccggagccggcaaaaccaagcgguaucugccugcuaucgugagagaagccauuaagcgcgggcuccggacacugauccuugcuccgaccagagugguugccgcggagauggaagaggcccugcgcggacuccccauucgguaccaaaccccugcuaucagagccgagcauacaggccgcgaaaucgucgaccugaugugucacgcuacguucaccaugcggcuccugucccccgugagagugccuaacuauaaccuuauuaucauggaugaggcccauuuuacagaccccgccucuauugcugcgcggggguacaucagcacccgcgucgaaaugggcgaggccgcuggaauuuucaugacagccaccccgccuggcuccagagaucccuuuccccagagcaaugccccuaucaucgacgaggaacgggagauucccgaacgcucuuggaacuccgggcacgagugggugacggauuucaaaggaaagacaguuugguuugugccuagcaucaaagcuggcaaugacauugccgcgugccugagaaagaacgggaaaaaggucauccagcugucucggaagaccuucgauagcgaauaugugaaaaccagaacaaaugacugggauuuuguugugaccacagacauuuccgagaugggagcuaacuucaaggccgagcgcgucaucgauccgcggagauguaugaaacccgugauccucaccgacggcgaagagagaguuauucuggccgggccuaugcccgugacgcacucuagcgcugcccaacggagaggccgcaucggacggaauccuaagaacgaaaaugaccaguacauuuacaugggcgagccccuugaaaacgaugaggacugcgcgcauuggaaagaggccaagaugcugcucgauaauaucaacacaccggaagggauuaucccuuccauguuugagcccgaaagagagaaagucgacgcuauugauggagaauaucgccugagaggcgaggcccggaagaccuucguggaccugaugcgcagaggggaucucccuguguggcuugcuuaccgggucgccgcugagggaaucaauuaugccgaccgcagaugguguuuugauggcguuaagaacaaucagauccuggaagagaacguggaaguggagauuuggacaaaagagggggaacggaagaaacugaagcccagauggcucgacgcgcgcaucuacucugauccucuggcccuuaaagaguucaaggaguucgcugccggccggaagucccugacccucaaccugauuacggagaugggaagacugcccaccuuuaugacacagaaagcucgcgacgcccucgauaaucuugccguccugcacaccgcugaagcgggcgggcgggccuauaaccaugcucuguccgagcucccggagacacuggaaacccuucugcuccugacacugcucgccaccgugacgggaggcaucuuccuuuuucugaugagcgggaagggaguuggcaaaaugacacugggcaugugcugcauuaucaccgccucuauccuccugugguacgcucaaauucagccucacuggaucgccgcguccauuauccuugaguucuuucugauugugcuccugauccccgaacccgagaagcagagaaccccucaggacaaucaacugacauaugucgugaucgccauucucaccguuguggcugccacaauggcuaacgaaaugggguuccuugagaaaacgaagaaggaccugggacugggcagcaucgccacccaggagccggaauccaauauucucgauaucgaccugcggcccgcgucugccuggacacuuuacgcugucgccaccacauuugugaccccuaugcugcgccacagcauugagaacuccucugucaaugugagccucacggcuaucgccaaccaggcuaccguucugauggggcugggaaaaggcuggccccucuccaagauggauauuggggugccucuucuggccaucggauguuacagccaggugaaucccaucacacugaccgcggcccuccugcuucugauugcucauuaugccaucauuggcccuggccuccaagcuaaagccacaagagaagcccagaagcgggcggcugccgggaucaugaaaaacccgaccgucgacggaauuacgguuaucgaucuggaccccaucccuuacgaucccaaguucgagaagcagcugggccaggugaugcuccuuauucugugcgugacacaaguccugaugaugcgcaccacaugggcucucugugaagcccugacccuugccaccgggccuaucucuacacugugggagggaaaucccggcagauuuuggaacacgaccauugcuguguccauggccaauaucuuccgggggagcuaucucgcgggagccggccugcuguuuucuauuaugaaaaacacaaccaauacacgcagaggcaccgggaacaucggagagacgcucggcgaaaaguggaaaucccggcuuaaugcucugggaaagagcgaguuccagaucuacaaaaagucuggcauucaggaaguugaccgcacacuggccaaagagggcaucaagagaggggagaccgaucaccaugcugugagccggggauccgccaagcucagaugguuugucgaacgcaacauggugaccccggagggcaaagucguggaccugggcugcgggcggggaggcuggucuuauuacugugggggacuuaagaacguuagagaagugaaaggccugacaaaaggcgggccugggcacgaggaacccauucccaugagcaccuauggcuggaaucucguccgccugcaauccgggguggauguuuucuucacaccucccgagaaaugcgacacgcugcucugugauaucggagagagcuccccuaacccgaccauugaagcgggccggacacuuagagugcugucucuggucgagaauuggcucaacaaugacacccaguuuugcaucaaggugcugaaccccuacaugccuagcgugaucgaaaagauggagacacuucagcgcaaauacgggggagcccugguucggaauccccucuccagaaacucuacccaugaaauguauugggucagcaaugcuacgggcaacauuguguccucugugaauaugaucagccgcaugcugauuaaccgguucaccaugaagcacaaaaaggccacauacgagccugacgucgaucugggguccggaaccagaaauaucggcauugagagcgaaauccccaaccucgacauuaucggcaaacgcaucgagaagauuaagcaggaacacgagacaucuuggcauuaugaucaagaccacccguacaaaaccugggcuuaucauggguccuacgaaacaaagcagaccggaagcgccucuuccaugguuaauggcguggugcggcuucugacgaaaccuugggaugucgugcccaugguuacacagauggcuaugaccgacaccacaccuuuugggcagcaaagaguguucaaggagaaagucgauacgcgcacccaggagcccaaggaaggaacaaagaaacugaugaagaucaccgccgaguggcucuggaaagaacugggcaagaaaaagacaccuagaauguguacccgggaggaguuuacacgcaaagugagaagcaacgcggcccuuggggcuauuuucaccgacgaaaacaaguggaagucugcccgggaggcuguugaagauuccagauuuugggagcugguggacaaagaacggaaucuccaccuggagggaaagugcgagacgugugucuauaacaugaugggcaaacgcgaaaagaaacugggcgaguucgggaaggccaagggaagcagagccaucugguacauguggcucggcgcgcgguuucuggaguucgaggcucuuggguuucugaaugaagaucacugguucucccgcgagaacagccucucuggaguggagggcgaagggcugcauaaacuuggcuacauucugagagacgugagcaagaaagagggaggcgccauguaugccgacgauaccgcugggugggacacacggaucacccucgaagaucugaagaaugaggaaauggucacaaaccacauggagggagagcauaaacgccuggccgaagcuaucuuuaagcucaccuaccagaauaagguugugagagugcagcggcccacgccgcgcggcacagucauggacauuaucuccagacgggaucaacgcgggucuggacaggugggcaccuaugggcugaacacauucaccaauauggaggcccagcuuauuagacaaauggaaggcgagggaaucuucaaaagcauucagcaccugacgguuaccgaggaaaucgcggugcagaacuggcucgcccgggucggccgcgagagacugucccggauggcuaucucuggggacgauugcgugguuaagccucuugacgauagauuugccagcgcucugacagcccucaaugacaugggaaaagugcgcaaggauauucagcaaugggaacccuccaaaggcuggaacgacuggacccagguccccuucugcucucaucacuuucacgagcugaucaugaaggaugggcgggugcugguugugccuuguagaaaucaggacgaacucauuggacgcgcgcggaucagccagggcgccggguggucccugaaggagacagcuugccuuggcaaaagcuacgcccaaauguggucucugauguauuuccauagacgcgaccuccggcuggcugccaacgcuauuuguuccgccgucccgagccacugggugcccaccucuagaacaaccugguccauccaugcgaagcacgaguggaugacgacagaagauaugcuuaccgucuggaaucgcguguggauucaggagaacccuuggauggaagacaaaacccccguugagagcugggaagaggugccuuaccugggaaagcgggaggaucaguggugcggcucccucaucgggcugacaucuagagccaccugggcuaaaaacauccagacagccauuaaucaaguccgcagccugaucggaaacgaagaguauacggacuacaugcccuccaugaagcgguuuagacgggaagaggaagaggccggcgugcucugguga

SEQ ID NO: 20110 - RNA, 9876 nt, Artificial Sequence
  derived and/or modified CDS sequence (opt5) from DENV-2__EU482663__SS-prME
agcgccggcaugaucauuaugcugauccccacagugauggcuuuccaccugacgacgagaaauggggaaccucauaugauugucggaauccaggaaaagggcaaaagccugcuuuuuaagaccgaagacgggguuaauaugugcacacugauggccauggaucucggagaacugugugaagacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauuguuacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgucuuuugugacuccaagcugaugagcgcugccaucaaagauaaucgcgcugugcaugccgacaugggcuauuggaucgagucugcgcucaacgauaccuggaagauugagaaagccuccuucaucgaagucaagaauugccacuggccuaaaagccauacacuguggucuaacggcgugcuggagagcgaaaugauuauccccaagaaccuugcugggccggugucccaacacaauuaccggccuggauaccacacccagauugccggccccuggcaucucgggaagcuggagauggacuucgauuuuugugacggaacgacagucaucguuaccgaagauugcggcaacagagggcccagccugcgcaccacaaccgcuucuggaaaacucauuacggaguggugcugucgguccugcacacugccuccgcuuagauaucggggcgaggacggcuguugguacgggauggaaauccgcccccugaaggagaaagaagagaaucucgugaacagccuggugaccgccggacacggccaggucgauaauuucucccugggggugcuuggaauggcccucuuucuggaagagaugcugagaacacggguuggcaccaagcaugcuauccuccugguggcggucucuuucgugacacuuauuaccgggaacaugagcuuuaaagaccugggaagaguuguggucauggugggcgccacgauggcugaugacaucggcauggggguuaccuaucucgcccugcuggccgcuuucaaggugcgcccuacauuugccgcgggacuucugcuccggaagcugaccuccaaagagcucaugaugacaaccauuggcaucguccugcuuucucaaagcacgauucccgaaacagugcuggagcucaccgaugcucuggcccuggggaugauggugcuuaagaucgucagaaauauggaaaaauaccagcuggccguuacaaucauggcuauucucugcgugccuaacgccgugauccugcagaaugcguggaaggucuccuguaccauucucgcugugguuucugugagcccccugcuucugaccuccagccagcagaagaccgacuggaucccucucgcccugacgauuaagggacugaaccccaccgccaucuuccuuacaacccugucucgcacaaauaaaaagagauccuggccgcucaacgaggcuaucauggccgucggcauggugagcauucuggcuucuucccuccugaagaaugacaucccuaugaccgggccccuuguugccggaggccugcugacggugugcuauguccucacaggccggagcgcggaucuggaacuugagcgcgccaccgacgugaaaugggaggaucaggcugaaauuucuggguccagcccuauccuguccauuaccaucagcgaggacggaucuaugagcauuaagaacgaagaggaggaacagacacucaccauccugaucagaacaggccuccuggucauuuccgggcuuuuucccaucucuauuccgaucacggccgcugccugguaccugugggaggugaaaaagcagcgggccggaguucugugggaugugccuucucccccucccaugggcaaagcugaacucgaggacggggcguaucgcauuaagcaaaagggaauccugggcuacucccagaucggcgccggggucuacaaagaaggaaccuuccacacaauguggcaugugaccagaggcgcuguucuuaugcacaaggggaaacggauugagcccuccugggccgaugugaagaaagaccugaucagcuauggaggcggguggaagcucgagggagaauggaaggagggcgaagagguccaggugcuggcccucgaaccuggcaaaaauccgcgcgcugugcagacaaagcccgggcuguuuaaaaccaacacgggaaccauuggcgccguuucccuugauuucucuccugggacaagcggaucccccaucauugacaagaaaggcaaggucguggggcuguacggaaacggcguggucaccagaagcggcgcguaugugucugcuaucgcccaaacagagaaguccaucgaggauaauccugaaauugaggacgauaucuuucggaaacgcagacugaccauuauggaccuccaccccggggccggaaagacaaaacgguaccugccugcuaucguuagagaagccauuaagcgcggccuucggacgcugauccucgcgccgaccagaguggucgcugccgagauggaagaggcccugcgcgggcuccccauucgguaucagaccccugcuaucagagccgagcauaccggacgcgaaaucguggaccugaugugucacgcuaccuucacaaugcggcuucugagccccguuagagugccuaacuacaaucugauuaucauggaugaggcccauuucacggaccccgcgucuauugccgcucgcggcuauaucuccacccgggucgaaaugggggaggccgcuggcauuuuuaugacagccaccccgccuggaagcagagaucccuucccccaguccaacgccccuaucaucgacgaggaacgggagauucccgaacgcucuuggaauagcggccacgagugggugacagauuuuaaagggaagaccguuugguucgugccuuccaucaaggcuggaaacgacauugcggccugccuccgcaaaaauggcaagaaagucauccaacugagccggaagacguuugauucugaauacgugaaaacacgcaccaacgacugggauuucguggucaccacagacauuuccgagaugggggcuaauuuuaaggccgagagaguuaucgauccgcggagauguaugaaacccgugauccuuaccgacggagaggaacgcgugauucuggccggcccuaugcccgucacacauagcucugcugcccagcggagagggcgcaucggccggaacccuaagaaugaaaacgaccaguacauuuauaugggagagccccucgaaaaugaugaggacugcgcgcacuggaaggaggcuaaaaugcugcuggauaacaucaauaccccggaaggcauuaucccuagcauguucgagcccgaaagagagaagguggacgccauugauggggaauaccgccuccggggagaggccagaaaaacguuuguugaccuuaugcgcagaggcgaucugccuguguggcuggcuuauaaggucgccgcggaggggaucaacuacgccgaccggcgcugguguuucgauggaaucaaaaacaaucagauucucgaagagaacguggaaguugagaucuggacaaaggagggcgaaagaaagaaacugaagccccgguggcuugacgcucgcauuuauuccgauccucuggcccucaaagaguuuaaggaguucgcugccgggagaaaaucucugacccugaaucucaucacagagaugggccggcuucccaccuucaugacgcaaaagaccagagacgcucuggauaaccuggccgugcuccacacagcggaagccggaggccgcgcuuacaaucaugcccugagcgagcuuccggagacccuggaaacacuccugcugcucacccuucuggcuacagucaccgggggaauuuuucuguuccucauguccggccgggggaucggaaagaugacgcugggcaugugcugcaucauuacagccucuauccuucugugguaugcccagauucagccucacuggaucgcugcgagcauuauccucgaguuuuuccugaucgugcugcucauucccgaacccgagaaacagagaaccccucaagacaaccagcuuaccuacgucgugaucgccauucugacaguuguggcugccaccauggccaaugaaaugggcuuucuggagaagaccaagaaggacuucgggcucggauccaucgcuacgcagcagccggagagcaacauucuggauaucgaccuucgccccgccucugcguggacccuguacgccguggcuacaaccuuugucacaccuaugcuccggcauuccauugaaaauagcuccguuaacgugucucugaccgccaucgcuaaucaagccacggugcugaugggccucgggaaaggauggccccuuagcaagauggauaucggcgucccucugcuggcgauuggguguuauucccaggugaaccccaucacccucacagccgcucugcuucugcucguugcccacuacgcuauuaucggaccuggccugcaggccaaggcuaccagagaggcccagaaacgggcggccgcuggcauuaugaagaauccgacaguggacgggaucaccgucaucgaucuggaccccauuccuuaugaucccaaauucgaaaagcaacucggacaggugaugcuucugauccugugcgucacacaggugcucaugaugcgcacaaccugggcccugugugaggcucuuacacuggccaccggcccuauuucuacccucugggaagggaaccccggaagauuuuggaauacaacgaucgccguuagcauggcgaacauuuuccggggcuccuaccuggcuggggccggacugcucuuuagcaucaugaaaaauaccacaaacacccgcagaggcacaggcaacaucggggagacccuuggagagaaguggaaaucucggcugaaugcucugggcaaguccgaguuccaaauuuauaagaaaagcgggauccaggagguggaccgcacgcucgccaaggaaggaauuaaaagaggcgagacagaucaccaugccgucucucggggguccgcuaagcugcgcugguuuguggagagaaacaugguuaccccggaaggaaaaguggucgaccuuggcugcggcagagggggauggagcuacuauuguggcgggcugcggaaugugcgcgaggugaagggacucaccaagggcgggccuggacacgaagaacccauccccaugucuacauacggcuggaaccugguucggcugcagagcggcgucgauguguucuucauuccucccgaaaaaugcgacacccuccuuugugauaucggggaguccucuccuaauccgacaguggaggccggaagaacgcugcgcguccugaaccucguugaaaauuggcugaacaauaacacccaguuuugcaucaaggugcuuaaucccuacaugccuagcgugauugagaaaauggaagcgcugcaacggaaguauggcggggcccucgucagaaacccccugucccgcaauagcacacaugagauguacuggguguccaacgcuucuggaaauaucguuagcuccgugaacaugauuucucggaugcugaucaacagauucaccaugcgccacaaaaaggccacauaugaaccugacgucgaccucggcagcgggacccggaauauuggaaucgaguccgagauucccaaccuugauaucaucggcaagagaauugagaagaucaagcaggagcaugaaacgucuuggcacuacgaccaggaucacccguauaaaaccugggcuuaccauggcagcuaugagacaaagcagaccggguccgccagcucuauggugaauggaguugugcgccugcugacaaaaccuugggacguccuccccaccgugacacaaauggcgaugaccgauacgacaccuuuuggccagcagcggguguucaaggaaaaggucgacaccagaacccaggagcccaaagaggggacaaagaaacugaugaagauuacggccgaauggcuuuggaaagagcugggaaagaaaaagaccccucgcauguguacaagagaagaguuuacccggaagguucgcuccaacgcugcccucggcgcuaucuucacagaugagaauaaauggaaaagcgccagagaagcuguggaggacucucgguuuugggaacugguggauaaagagagaaaccugcaccucgaagggaagugcgagaccugugucuacaauaugaugggaaaacgggagaagaagcugggcgaguucggcaaagccaaggggucccgcgcgauuugguacauguggcuuggagccagauuucuggaguucgaagcucucggcuuucugaacgaggaccauugguucagccgggaaaauucucuuuccgggguggagggagagggccugcacaaacucggguauauccugcgcgauguuagcaagaaagaaggcggagccauguacgcugacgacacagccggcugggauaccagaaucacgcuggaggaccucaagaacgaagagauggugaccaaucacauggaaggggagcauaagaaacuggccgaggcgauuuuuaaacuuacauaucaaaacaaagucgugcggguucagcgccccaccccgagaggaacagugauggauaucauuucccggcgcgaccagagaggcagcgggcaagucggaaccuacggccugaauacguucacaaacauggaagcucagcucauccggcagauggagggggaaggcguguucaagaauauucagcaccugaccguuacagaggagguggccguccaaaacuggcuugcccgcgugggaagagaacggcugucucgcauggcuaucagcggcgaugacugcgucgugaaaccucucgaugacagauuugccaacgcucugaccgcccugaaugauauggggaagauccggaaggacauucagcagugggagcccuccaaaggauggaacgauuggacgcagguucccuucugcucucaucacuuucaugaacucaucaugaaggacggcagagugcuggucgugccuugucgcaaucaagaugagcuuauugggcgggcgagaaucagccagggagccggcuggucccugcgcgaaaccgcuugccucgggaaaucuuaugcccagauguggagccugauguacuuccaccggagagaccuucgccuggcugccaacgcgauuuguuccgccgugccgucucacuggguucccacaagccggaccacaugguccauccaugcuaagcacgaguggaugaccacagaggacaugcucaccguguggaauagagucuggauucgcgaaaacccuuggauggaggauaaaacgcccguggaaagcugggaggaaaucccuuaucugggcaagcgggaggaccaguggugcggaucucugaucggccucacauccagagccaccugggcuaagaauauucaagccgcuaucaaccagguucgcagccugauugggaaugaggaauacaucgauuacaugcccucuaugaaacgguuuagacgggaggaagaggaagccggagugcuuugguga

SEQ ID NO: 20111 - RNA, 9876 nt, Artificial Sequence
  derived and/or modified CDS sequence (opt5) from DENV-2__EU482664__SS-prME
accgccggcgugaucauuaugcugauccccacagcuauggccuuccaccucacgacccggaauggggagccucauaugauugucggacggcaggaaaagggcaagucccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauuccacaucuaccugggugacguauggcaccuguacaaccacaggggagcaccggcgggaaaagcgcagcguggcucucgucccucaugugggaaugggccuggagaccagaacggaaacauggauguccucugagggcgccuggaaacacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaagcagccugcuacgcugagaaaauauugcaucgaagccaagcucacaaacaccaccacagagagccgguguccgacccaaggagagcccucucugaaugaagaacaggacaaacgcuuugucugcaagcauuccaugguggauagaggcuggggcaacggguguggacuguucggcaaagggggaauugugacaugcgcgauguuuacgugcaaaaagaauauggaaggcaaaaucguccagccugagaaccucgaauacaccauuguuaucacaccccacagcggggaggagcaugccgugggaaaugacaccggcaagcacggcaaagaaaucaagauuacaccucagucuuccaucaccgaggcugaacugacgggguauggaaccgugacaauggaguguagcccccggaccggccuugauuucaacgaaaugguccugcuccaaauggaggacaaagccuggcuggugcaccgccagugguuucuugaucugccgcucccuuggcugcccggggcugacacacagggaucuaauuggauucagaaggagacccugguuacguucaagaacccucaugccaaaaagcaagacguggucgugcucggcucccaggaaggggccaugcacacagcucugaccggcgcgacagagauccagaugagcuccggaaaucuucuguuuaccggccaucucaaaugcagacugcggauggauaaacuucaacugaaagggaugucuuacagcauguguaccggaaaguucaagauuguuaaagaaaucgccgagacacagcacggcacgaucgugauuagaguccaguaugagggggacggaucccccugcaagauccccuucgaaauuauggaucucgagaaacgccaugugcugggccggcugaucaccgucaacccuauugugacagaaaaggacagcccgguuaacaucgaggcugaacccccuuuuggggauucuuacauuaucaucggcguggagcccggacagcucaaacugaauugguucaagaagggcuccagcauugggcaaauguuugagaccacaaugagaggagccaaacgcauggccauccuuggcgacaccgcuugggauuucgggucucugggaggcgucuuuacgagcauugggaaggcccuccaccagguguucggcgcgaucuacggagcugccuuuuccggcguuucuuggacaaugaaaauucugaucggggccaucauuaccuggaucggaaugaacagccgguccaccagccugucugugucccuuguccucgugggcgugauuacacuguaucugggggcuaugguucaggccgacagcggaugugucgugucuuggaagaauaaagaacucaagugcggcuccgggaucuucauuaccgauaacgugcacacauggacggagcaguacaaguuucaaccugaaagccccuccaaacuggcuucugccauccagaaggcgcaugaggaaggcaucuguggaauuagaagcgucacccgccuugagaaucugauguggaaacagaucacaccggagcucaaccacauucuguccgaaaaugaggugaagcugaccaucaugacaggcgacauuaaagggaucaugcaggccggaaagcggucucuuagaccucaacccaccgaacucaaauauagcuggaagacguggggcaaggcuaaaaugcuguccaccgagagccauaaccagacauuccugaucgaugggccugaaaccgccgagugccccaauacaaaccgcgcuuggaacucucucgagguugaagacuacggauuuggcguguucaccacaaacauuuggcugaaacuucgggagaaacaggacgucuuuugugauuccaagcugaugagcgccgcgaucaaagacaauagagccgugcacgcugauaugggcuauuggauugaaucugcccucaacgacaccuggaagauggagaaggcuuccuucaucgagguuaaaagcugccacuggccuaagucucauacgcuguggagcaauggggugcuggaauccgagaugauuauccccaagagcuucgccggaccggucucucagcacaacuaccgcccuggcuauuacacacaaaccgccgggcccuggcaucuuggaaagcucgaaauggauuuugacuucugugagggcaccacagugguugugaccgaagauugcgggaaccggggacccucccugagaacgacaaccgcuagcggcaaacugauuacagaguggugcugucgguccugcacccucccuccgcugcgcuacagaggcgaggacggguguugguauggaauggaaauccggccccuuaaggagaaggaagagaaucuggucaacucucucgugacagcgggccacgggcagaucgauaauuuuagccugggagugcugggcauggcccuuuuccucgaagagaugcugagaacccgcgucgggacgaaacaugcuauucugcucguugccguguccuuugugacccugaucacaggaaacaugucuuuccgggaccuuggcagagucauggugaugguuggcgccaccaugacagaugacauugggaugggagugaccuaccuggcucuccuggccgcguuuaagguccgcccuacguucgcugccggccugcuucugagaaaacucacaagcaaggagcugaugauggccaccaucgggauugcucuccugucccagucuacaauccccgaaaccauccuugagcugaccgaugcccucgcgcugggaaugauggugcugaaaauuguucggaauauggaaaaguaucaacuugcugugacaaucauggccauuagcugcgucccuaacgccgugauccugcagaaugcuuggaagguuuccuguacgauucucgccgcugugagcgucucuccccugcuccugaccuccagccagcagaaagccgacuggaucccucuugcgcugacaaucaagggccucaaccccaccgccauuuuucugacaacccugucucgcacguccaaaaagagaagcuggccgcuuaaugaggcuaucauggccguggggauggugucuauucuggcuuccagccuccugaaaaacgacaucccuaugacaggaccccucgucgccggcggccugcuuaccguuugcuacgugcugaccgggcgguccgccgaucuggaacucgagcgcgcuacagacgugaagugggaggaucaagcggaaauuagcggaucuagcccuauccuguccauuaccaucucugaggacggcagcauguccaucaaaaaugaagaggaggaacagacacuuacgauucugaucagaaccgggcuccuggucauuucuggacucuuccccgugagcaucccgauuacagccgcugccugguaucugugggagguuaagaagcagcgggccggcgugcuuugggaugucccuucucccccucccguggggaaagcugaacuggaggacggagccuaccgcaucaagcagaaaggcauccugggcuauagccaaauuggggcgggaguuuacaaggaaggcaccuuucacacaauguggcacgugaccagaggggcuguccucaugcaucggggaaaacgcaucgagcccagcugggccgaugugaagaaggaccugauuuccuacggcgggggauggaaacuugagggcgaauggaaggagggcgaagagguccaggugcuggcccucgaaccugggaaaaacccgagagcuguucagacgaagcccggacuguucaaaaccaauacaggcaccaucggggccgugagccucgauuuuucuccuggaacauccggcagccccauugucgaccggaaggggaaggugguuggacuguauggcaacggcguggucaccagaucuggggcguacguguccgcuaucgcccagacagagaaaagcaucgaggauaauccugaaauugaggacgauaucuuccgcaagaaacggcuuacgauuauggaccugcaccccggagccggcaagaccaaaagauaucugccugcuaucgugcgcgaagccauuaagcgggggcucagaacacugauccuugcuccgacccgcguugucgccgcggagauggaagaggcccugcggggacuccccauuagauaccaaaccccugcuauccgcgccgagcauacaggccgggaaaucguggaccugaugugucacgcuacguucaccaugagacuccugucccccgugcgggucccuaacuauaaccuuauuaucauggaugaggcccauuuuacagaccccgccucuauugcugcgcgcggguacaucagcaccagaguggaaaugggcgaggccgcuggaauuuucaugacagccaccccgccuggcucccgggaucccuuuccccagagcaaugccccuaucaucgacgaggaacgcgagauucccgaaagaucuuggaacuccgggcacgaguggguuacggauuucaagggaaaaacagugugguuugucccuagcaucaaggcuggcaaugacauugccgcgugccugcggaaaaacgggaagaaagugauccagcugucuagaaagaccuucgauagcgaauauguuaagacccgcacaaaugacugggauuuuguggucaccacagacauuuccgagaugggagcuaacuucaaagccgagcgggugaucgauccgagacgcuguaugaagcccguuauccucaccgacggcgaagaacgggugauucuggccgggccuaugcccgucacgcacucuagcgcugcccaaagacgcggccggaucggaagaaauccuaaaaacgaaaaugaccaguacauuuacaugggcgagccccuugaaaacgaugaggacugcgcgcauuggaaggaggccaaaaugcugcucgauaauaucaacacaccggaagggauuaucccuuccauguuugagcccgaacgcgagaagguggacgcuauugauggagaauauagacugcggggcgaggcccgcaaaaccuucguggaccugaugagaagaggggaucucccugucuggcuugcuuaccgcguugccgcugagggaaucaauuaugccgacagacggugguguuuugauggcgugaagaacaaucagauccuggaagagaacguggaagucgagauuuggacaaaggagggggaacgcaagaagcugaaaccccgcuggcucgacgcgcggaucuacucugauccucuggcccuuaaggaguucaaagaguucgcugccggcagaaagagccugacccucaaccugauuacggagaugggacgccugcccaccuuuaugacacagaaggcucgggacgcccucgauaaucuugccgugcugcacaccgcugaagcgggcgggagagccuauaaccaugcucuguccgagcucccggagacacuggaaacccuucugcuccugacacugcucgccaccguuacgggaggcaucuuccuuuuucugaugagcgggaaaggagugggcaagaugacacugggcaugugcugcauuaucaccgccucuauccuccugugguacgcucaaauucagccucacuggaucgccgcguccauuauccuugaguucuuucugauuguccuccugauccccgaacccgagaaacagcggaccccucaggacaaucaacugacauaugugguuaucgccauucucaccguggucgcugccacaauggcuaacgaaaugggguuccuugagaagacgaaaaaggaccugggacugggcagcguggccacccaggagccggaauccaauauccucgauauugaccugcgccccgcgucugccuggacacuuuacgcugucgccaccacauuugugaccccuaugcugagacacagcaucgagaacuccucuguuaaugugagccucacggcuauugccaaccaggcuaccgugcugauggggcugggaaagggcuggccccucuccaaaauggauaucggggucccucuucuggccauuggauguuacagccagguuaaucccaucacacugaccgcggcccuccugcuucugaucgcucauuaugccauuaucggcccuggccuccaagcuaaggccacacgggaagcccagaaacgcgcggcugccgggauuaugaagaacccgaccguggacggaaucacggugauugaucuggaccccaucccuuacgaucccaaauucgagaagcagcugggccaggucaugcuccuuauccugugcgugacacaaguucugaugaugagaaccacaugggcucucugugaagcccugacccuugccaccgggccuauuucuacacugugggagggaaaucccggccgguuuuggaacacgaccaucgcuguguccauggccaauauuuuccgcgggagcuaucucgcgggagccggccugcuguuuucuaucaugaagaacacaaccaauacaagacggggcaccgggaacauuggagagacgcucggcgaaaaauggaagucccgccuuaaugcucuggggaaaagcgaguuccagaucuacaagaaaucuggaauccaggaagucgacagaacacuggccaaggagggcauuaaaagaggggaaaccgaucaccaugcugugagcagaggauccgccaagcuccgcugguuugucgaacggaacauggugaccccggagggcaagguuguggaccugggcugcgggagaggaggcuggucuuauuacugugggggacuuaaaaacguccgcgaagugaagggccugacaaaagggggaccuggccacgaggaacccauccccaugagcaccuauggcuggaaucucguucggcugcaauccgggguggaugucuucuucacaccucccgagaagugcgacacgcugcucugugauauuggagagagcuccccuaacccgaccaucgaagcgggcagaacacuucgcgugcugucucugguggagaauuggcucaacaaugacacccaguuuugcauuaaaguucugaaccccuacaugccuagcgucaucgaaaagauggagacacuucagcggaaguacgggggagcccuggugagaaauccccucucccgcaacucuacccaugaaauguauugggugagcaaugcuacgggcaacaucgucuccucuguuaauaugauuagccggaugcugaucaacagauucaccaugaaacacaagaaagccacauacgagccugacguggaucugggguccggaacccgcaauauuggcaucgagagcgaaauucccaaccucgacaucauuggcaagcggaucgagaaaaucaagcaggaacacgagacaucuuggcauuaugaucaagaccacccguacaagaccugggcuuaucauggguccuacgaaacaaaacagaccggaagcgccucuuccauggugaauggcgucgugagacuucugacgaagccuugggauguugugcccauggucacacagauggcuaugaccgacaccacaccuuuugggcagcaacgcguguucaaagagaagguugauacgagaacccaggagcccaaagaaggaacaaagaagcugaugaaaauuaccgccgaguggcucuggaaggaacugggcaaaaagaaaacaccucggauguguacccgcgaggaguuuacaagaaaggugcggagcaacgcggcccuuggggcuaucuucaccgacgaaaacaaauggaagucugccagagaggcugucgaagauucccgguuuugggagcugguggacaaggaacgcaaucuccaccuggagggaaaaugcgagacguguguguauaacaugaugggcaagagagagaagaagcugggcgaguucgggaaagccaagggaagccgggccauuugguacauguggcucggcgcgcgcuuucuggaguucgaggcucuuggguuucugaaugaagaucacugguucuccagagagaacagccucucuggagucgagggcgaagggcugcauaaacuuggcuacauccugcgggacguuagcaaaaaggagggaggcgccauguaugccgacgauaccgcugggugggacacacgcauuacccucgaagaucugaaaaaugaggaaauggugacaaaccacauggagggagagcauaagagacuggccgaagcuaucuuuaaacucaccuaccagaauaaggugguccgggugcagcgccccacgccgagaggcacaguuauggacaucauuucccggcgcgaucaaagagggucuggacaggugggcaccuaugggcugaacacauucaccaauauggaggcccagcuuauccggcaaauggaaggcgagggaauuuucaagagcauccagcaccugacggucaccgaggaaauugcggugcagaacuggcucgcccgcguuggcagagagcggcuguccagaauggcuaucucuggggacgauugcguggucaaaccucuugacgaucgcuuugccagcgcucugacagcccucaaugacaugggaaaggugcggaaagauauccagcaaugggaacccuccaagggcuggaacgacuggacccagguucccuucugcucucaucacuuucacgagcugauuaugaaagaugggagagugcuggucgugccuugucgcaaucaggacgaacucaucggacgggcgagaauuagccagggcgccggguggucccugaaggagacagcuugccuuggcaagagcuacgcccaaauguggucucugauguauuuccaucgccgggaccucagacuggcugccaacgcuaucuguuccgccgucccgagccacugggugcccaccucucgcacaaccugguccauucaugcgaaacacgaguggaugacgacagaagauaugcuuaccguuuggaaucggguguggauccaggagaacccuuggauggaagacaagacccccgucgagagcugggaagaggugccuuaccugggaaaaagagaggaucaguggugcggcucccucauugggcugacaucucgcgccaccugggcuaagaacauccagacagccaucaaucaagugcggagccugauuggaaacgaagaguauacggacuacaugcccuccaugaaaagauuucggagagaagaggaagaggccggcguucucugguga

SEQ ID NO: 20112 - RNA, 9876 nt, Artificial Sequence
  derived and/or modified CDS sequence (opt5) from DENV-2__EU482665__SS-prME
agcgccggaaugaucauuaugcugauccccacagugauggcuuuccaccugacaacgagaaauggggaaccucauaugauugucggaauccaggaaaagggcaaaucccugcuuuuuaagaccgaagacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaaaacggacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccgaucacggcugccgccugguaccugugggaggucaaaaagcagcgggcuggagugcugugggauguuccuucucccccucccaugggcaaagcggaacucgaggacggggccuaucgcauuaagcaaaagggaauccugggcuacucccagaucggcgcugggguguacaaagaaggaaccuuccacacaauguggcaugucaccagaggcgccgugcuuaugcacaaggggaaacggauugagcccuccugggccgauguuaagaaagaccugaucagcuauggaggcggguggaagcucgagggagaauggaaggagggcgaagaggugcagguccuggcucucgaaccuggcaaaaauccgcgcgccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugaccagaagcggcgcuuaugucucugccaucgcccaaacagagaaguccaucgaggauaauccugaaauugaggacgauaucuuucggaaacgcagacugaccauuauggaccuccaccccggggcuggaaagacaaaacgguaccugccugccaucgugagagaagcgauuaagcgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaagggaagaccgugugguucguuccuuccaucaaggcgggaaacgacauugccgcuugccuccgcaaaaauggcaagaaagugauccaacugagccggaagacguuugauucugaauacgucaaaacacgcaccaacgacugggauuucguggugaccacagacauuuccgagaugggggccaauuuuaaggccgagagagucaucgauccgcggagauguaugaaacccguuauccuuaccgacggagaggaacgcgugauucuggcuggcccuaugcccgugacacauagcucugccgcgcagcggagagggcgcaucggccggaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaaagagagaaggucgacgccauugauggggaauaccgccuccggggagaggcuagaaaaacguuuguggaccuuaugcgcagaggcgaucugccuguuuggcuggccuauaagguggcggccgaggggaucaacuacgcugaccggcgcugguguuucgauggaaucaaaaacaaucagauucucgaagagaacgucgaaguggagaucuggacaaaggagggcgaaagaaagaaacugaagccccgguggcuugacgcccgcauuuauuccgauccucuggcucucaaagaguuuaaggaguucgccgcugggagaaaaucucugacccugaaucucaucacagagaugggccggcuucccaccuucaugacgcaaaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacagagaaccccucaagacaaccagcuuaccuacguggucaucgcuauucugacagugguugccgccaccauggcuaaugaaaugggcuuucuggagaagaccaaaaaggacuucgggcucggauccaucgccacgcagcagccggagagcaacauucuggauaucgaccuucgccccgcgucugccuggacccuguacgcuguggccacaaccuuugugacaccuaugcuccggcauuccauugaaaauagcuccgucaacguuucucugaccgcuaucgccaaucaagcgacggugcugaugggccucgggaaaggauggccccuuagcaagauggauaucggcgugccucugcuggccauuggguguuauucccaggucaaccccaucacccucacagcugcccugcuucugcucguggcucacuacgccauuaucggaccuggccugcaggcuaaggccaccagagaggcgcagaaacgggccgcugccggcauuaugaagaauccgacaguugacgggaucaccgugaucgaucuggaccccauuccuuaugaucccaaauucgaaaagcaacucggacaggucaugcuucugauccugugcgugacgcagguccucaugaugcgcacaaccugggcucugugugaggcccuuacacuggccaccggcccuauuucuacccucugggaagggaaccccggaagauuuuggaauacaacgaucgcggugagcauggcuaacauuuuccggggcuccuaccuggccggggcuggacugcucuuuagcaucaugaaaaauaccacaaacacccgcagaggcacaggcaacaucggggagacccuuggagagaaguggaaaucucggcugaaugcccugggcaaguccgaguuccaaauuuauaagaaaagcgggauccaggagguugaccgcacgcucgccaaggaaggaauuaaaagaggcgagacagaucaccaugcugugucucggggguccgccaagcugcgcugguuugucgagagaaacauggugaccccggaaggaaaaguuguggaccuuggcugcggcagagggggauggagcuacuauuguggcgggcugaagaauguccgggaggugaagggacucaccaaaggcgggccuggacacgaagaacccauccccaugucuacauacggcuggaaccuggugcgccugcagagcggcguugaugucuucuucauuccucccgaaaagugcgacacccuccuuugugauaucggggaguccucuccuaauccgacaguggaggcgggacggacgcugagagugcugaaccucgucgaaaauuggcugaacaauaacacccaguuuugcaucaaaguucuuaaucccuacaugccuagcgugauugagaagauggaagcccugcaacgcaaauauggcggggcucucgugcggaacccccuguccagaaauagcacacaugagauguacugggucuccaacgccucuggaaauaucgugagcuccguuaacaugauuucucgcaugcugaucaaccgguucaccaugagacacaagaaggcuacauaugaaccugacguggaccucggcagcgggacccgcaauauuggaaucgaguccgagauucccaaccuugauaucaucggcaaacggauugaaaagaucaaacaggagcaugaaacgucuuggcacuacgaccaggaucacccguauaagaccugggccuaccauggcagcuaugagacaaaacagaccggguccgcgagcucuauggucaauggagugguuagacugcugacaaagccuugggacgugcuccccaccgucacacaaauggccaugaccgauacgacaccuuuuggccagcagcgcguguucaaggaaaaaguggacacccggacccaggagcccaaggaggggaccaaaaagcugaugaaaauuacggcugaauggcuuuggaaggagcugggcaaaaagaagaccccuagaauguguacacgcgaagaguuuaccagaaaaguccgguccaacgccgcucucggcgccaucuucacagaugagaauaaguggaaaagcgcucgcgaagccguugaggacucuagauuuugggaacugguggauaaggagcggaaccugcaccucgaagggaaaugcgagaccuguguguacaauaugaugggaaagagagagaagaaacugggcgaguucggcaaggcgaaagggucccgggccauuugguacauguggcuuggagcucgcuuucuggaguucgaagcccucggcuuucugaacgaggaccauugguucagcagagaaaauucucuuuccggggucgagggagagggccugcacaagcucggguauauccugcgggaugugagcaaaaaggaaggcggagcuauguacgccgacgacacagccggcugggauacccgcaucacgcuggaggaccucaagaacgaagagaugguuaccaaucacauggaaggggagcauaaaaagcuggcggaggcuauuuuuaaacuuacauaucaaaacaagguggucagagugcagcggcccaccccgcgcggaacaguuauggauaucauuuccagacgggaccagcgcggcagcgggcaagugggaaccuacggccugaauacguucacaaacauggaagcccagcucaucagacagauggagggggaaggcgucuucaaaaauauucagcaccugaccgugacagaggagguugccgugcaaaacuggcuugcucgggucggacgcgaaagacugucucggauggccaucagcggcgaugacugcguggucaagccucucgaugaccgcuuugcuaacgcccugaccgcgcugaaugauauggggaagaucagaaaagacauucagcagugggagcccuccaagggauggaacgauuggacacaggugcccuucugcucucaucacuuucaugaacucaucaugaaagacggccggguucugguggucccuuguagaaaucaagaugagcuuauugggcgcgcccggaucagccagggagcuggcuggucccugagagaaaccgccugccucgggaagucuuaugcucagauguggagccugauguacuuccaccgccgggaccuuagacuggccgcgaacgccauuuguuccgcugugccgucucacugggugcccacaagccgcaccacaugguccauccaugccaaacacgaguggaugaccacagaggacaugcucaccguuuggaaucggguguggauuagagaaaacccuuggauggaggauaagacgcccgucgaaagcugggaggaaaucccuuaucugggcaagcgcgaggaccaguggugcggaucucugaucggccucacaucccgggcuaccugggccaaaaauauucaagcugccaucaaccaggugagaagccugauugggaaugaggaauacaccgauuacaugcccucuaugaagcgcuuucggagagaggaagaggaagcgggaguucuuugguga
